United States Patent 10,240,205 (METHODS FOR ASSESSING RISK OF DEVELOPING A VIRAL DISEASE USING A GENETIC TEST) - sequence listing, part 19

SEQ ID NO: 1963 - DNA, 38444 bp, Homo sapiens
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcaggtagagcacaggccccgaggaaaggactgcgggtgggtggagcttcagccaggacggggtgtgcttccctctcccggcccattccagccaggcccctccgggccagaggcagcgtctgtcataaaaagggctggtgttccaggtggggtcagagagaggattgacaagtaaaaacgatcgtcctttgaagggggccggcccctccacacctgtgggtatttctcatcaggcgggacgagagactgagaaaatgaataagacacagagacaaagtatagagagaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccacccatgttagacttctgtgtggaagagctcacacagtggtctgagacagccagccggcaagactgcctctggctggtgcctggggccttggattttgggaaggctccctccatttcctgatgagagggtctccctgcacctaacctgctggtgcaaacagtaggggttttgctgaacaccggctttctcttcggggactttgttgcttgcccagcagcaggtgctccagtgaccggccctcataccatcttgggagggtgtcctggaagccgtgtctggcctcccgcgaccctgccccgtgtgtctttttcctgtgctgaccttgctgcggaaaattatggccctgagtgtgactccaggctgagtcctgtgggtccaacacgggatgccttggggcctcttctggagacgggatgtgagtgacaggagccggccggggcagcttgccctgtgactgcacgtggccacagcctgtgagggccgggggtgcttctccacccacgtggctgcccctcgggtatgtcaagggcttctggggctcatcacggggtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctgggacctggtggggacgctgggcctggtacctggtggggatgctgggcctgggacctggtggggaggcctctgactgcctcctggtgctgcttccgtctgtgttaggcctctgggtattggggcccccatctgtctcctcctccaggcctgtggactcagaccaggaagacacaggccagcccctgcctgtcccccttggcttgggctctcactgcccgacctggcgggaggttgcctagccgtgaaccttcgcaccctgtctgccaccggacaggctgtgagggggtgtctgcagcacctgcaccggcctgagcatcttcagagtgggctgcagctcctggaggggtctgagaggaagggaggcaggtattttgggcgaatgaggagacagctggagagctggcacccttcctggcctgcgtcctgtgaggactctggttggggacagcaagcttggggtcagcctggggcagagcctctgggacggccccgcccctcgtgccccttcccctcgcagctcctgtcctcgccccgccctcagctctccgccaggcaaggtttggcaagtgccgctgtgcggcagtgcctgctgattggctggtctgttgctatggtgctgcccaggggtgtgcttttcctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatttcttcacttttctttgttcctttttaaattatgaaactaaccaccattcagtacgaaaaagtttaagcagctctgaggaagatagagtaaaaaattgtctccctcttccctggccctcagccatccccggtggccaccgtggagtgtggacggagccctgcaggcctgtgtctgtgcggaagcacgcgcagttttgtctgcacagactgtcctgcagttggctgttttcactcagcgttgtgggtatagcttcccatgctggtgctggcagctcggccttgttcttttgaggacagcagatgtctcctatgtctacctcttacagcttcagagattcaagttataataaagctcttcttatattgagggggaaacctccctcccccttttttttgaaacagggtctcgctctgctacccaggctgcagtgcagtgtcacagtcttggctcactgcagcctcagcctcccaggctcaagcgattttcccacctcagcctcccaagtagccgggactgcaggcacacaccaccatgcctggttaatttttgtattttttgtacagacagggtctcactctgttgctcaggccagtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccaggatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgggtgctattccaggcatagcaagactggcttcactcacatggagctttgattctagtggtggggacaggtggacagcaaaagagtaagcacgtgagctgatgatactgaagggaaatagagcagagggaggaggcggagaccgagccaagcgggcccaagtgcgatgtcggcgggaggtggggaatgctggtgggtctgaggggagcctcagcaggtgcagcagagcaagggaagaggtgagtgggggcggctggggggccgactcctgggaagctgtagcagaaccccacagagagctggtgaggtttgccgtggttgtgggtgactcggtgctttgagccctggctgcccctgggaaccatctggagagcttctaacccaaccaggcccctccctgggacagttatatcacagctggtaagccgagtctaacactttcacggaaacgcagaagatctaaaacagcaagatgaccgtgaagaagaacagagctggaggactcacctcgctggtttcaagactcctctaaagctgcaggagtggaggtggagatggcccagctcaggcacaggcctgcaggccatggagaaggcagcaagctcaagctgacccacacgcatgtggtcattgttttttttttcagttggaatctcactctgtcacccaggttggagtgcagtggcaccatctcggctcactgcagcccccgcccctaggttctagcgattctcccacatcagcctcccgagtagctgggattacaggcgtgcgccaccatgcctggcccttggtgattgttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctgtggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggcgcccgccaccacgcctggctaattttttttttttttttgtatttttagtagagacggggtttcacagtgttcgccaggctggtctcgatctcctgacctcgtgatccgcctgcctcggcctccgaaagtgctgggcttgcaggcgtgagccaccatgcccggccaatgtgtgaaaatttaaaagtaccaaagctggaccccaccccagattgctcccatgacactctgtgggtgggacctgggagttgggttttgttttgttttgttttgtttttgagatgaagtctcactctgtcgcctaggctggagtgcagtgacacaatctcggctcacattaacctctgcctcccagatgaaagcgattctcctgcctcagccttctgagtagctgggattacaggcacacaccaccaccccctgctaatttttgtatttttagtagagacggggttttaccatgttggccaggctggtcttgaactcctgacctcgtgatccgcccgcctcggcctcccaaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccggcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtgtcaaaaaaaaaaatgttgactgggcgcgctagctcatgcctataatcccagcactttgggaggctgaggtgggcggatcacgaggtcaagagatcaagaccatcctggccaacatagtgaaacaccgtctctactaaaaatacaaaaaaattagctgggcgtggtggcgtgtgcctatagtcccagctactcaggaggctgaggcaggagaatcactcgaacccaggaggtagaggttgcaatgagccaagatcacaccactgtactccagcctggtgacagagcaagactccgtctcaaaaaaaataaaatcaaaaagaataattggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccagtatcaacttggcctctactgtgtaaaactggaaaactctactttgtgaagctgagttgggagcatcgcttgaggccaggagtttgagaccagcctgggcaacatggcggaacctcgcccctgccaaaaaattagccaggtgtggtggtgtgctcctgtggtccaagcttttccggaggccgaagtgggaggcgtgcttgagcctgggaggcagagcttccggtgccccagatgactccactgcactccagcctgggcggcagagtgaggccatctcaaaaaaaaaaaaaaggaaaactaaatatattcactgtaagggcattttgcatctttaaatgacccacaaatctggcatgcatcagctgctctgcctgtaggttccttcccagtgtttgtccagaggtgtatttccacacagcgctagtcacggcatacgtggaaaacgtggaaacccttcatggatgttgtcagttggtctatattttctttcttttttttttttttgagatggagtttcacttttgttgcccaggctggagtgcaatggcgcgatcttggctcactgcaacctccgcctcctgggttcaagcaattctcctgcctcagcctcccaagtagctgggatcacaggcgtgcaccaccacgcccagctaattttgtatttttagtagagatggtttctccgtgttggccaggctggtctcgaactcctgacctcacgtgatccacccgcttcggcctcccaaagtgctgggattacaggcgtgagccgccacgcccggcctttgtccatattttctacatggcttctgtaaacagctgactaggagtctgtgtgaatatcttcataggttctgctgtgacactacttgctcgtgagcatctccaggtgtaaacagcatcagcttcccccattttcctttaaaatcgcacatgtggacggacaccacggggaccctggaccctggggagccccgtcctcacccttctcaccaggatggctgcttggtagagagtgagtttgcaaagttggcatttgtttagtacagaagttatcaggtgttctggctttagaatccctttatatatatatatatatacatatatttaagtgacagggtctcactctgttgcccaggctggaatgtggtggtacaatcaaagttccctgtagcctcggcctcctgggctcatgggatcttcccgtctcagcgtcttaaagcgccgggaccacaggtgtgcaccactgccaccggctctcaagattgccacgcagggagttgcagtgggggaaggggttcctgggactttgaacgctccacctccctcctctccacagtcccccaaccccacctctctaacggggtggacggccgcctctttccatccttcgcttggcgcagggtggggagagtgacaggtctccttccctcatctcggcagctgccatttcatcgcttacataacgtgggagaaacatccacccacccccaggcctgtgtgaacatcaccacggggccttctccactcttcagttttgttagttacttgatgtgcagggctttttgttgtaactagtgggggacgtgtggtggggtgggcttctgccatctcattcaggaccagaacttcagttttcatccctatctgttcccccacccctttggagatggggtctcactctgtcacccaggctggagagcggtggtgccatcacggctcactgcagcctccacctcctgcagcctccacctcttgggctcaagtgatcctcctgcctcggcctcccaagctcctgggactacaggcgtgtgccactgtgcttggcagggtccattcttttcctcacactttatttattgaagagcccaggccgtttaccctgcagagtcggaatctgtacaggaggggcagccacacgagttccccggtttactctgaacttaggtggcttgagggccccagttagactgcggccaccgtttgccgggctccagatgggacgtcctttctatcagaaggctcacagtatctcctttcccgtttcttcccatgtgaacattgttgctgctgaacacctgaatatgttaatcactgggggcttgcaagatggcagtgtgctaattccatcatctagtcagttagcaggaataacttaggaccacgccctgcaccatatcagctatgtggtgatcccattcacacaggaaaggtgggacaaatgctgggggtgggccgggtgtgctgtctcacacctgtcatcccagcactttgggaggcccaggcaggcggatcacgaggtcagagattgagaccatcctggccaacacggtgaaaccccgtctctactaaaaatacaaaaaaattagccaggtgtggtggtgcatgcttgtaatcccagctacttgggaggctgaggcaggagaatcacttgaacccaggaggcggaggttgcagtgagccgagatcgcaccattgcactccagcctggcgacagagcgagactccgtctcaaaaatcaatcagtcaatcaagtgtcatcactgaatgtttgtgtgtgaacgtggggattggtcctgccccatgctccctcctgaatctcactcctgacctcagttgctgcaccttgaggtgttttcatgtgggctcttgtgtcctgaccccggcggttgtggcctctttgctgtctgggagtcaggatttttcacactcatgtcctgctccagacctggaatcagccaagtctccaagaagccctgctttcttttcctgcaagacggtatttcaagacccgccatgcggcagcgggttggtcatggttactgggttggtcgttgttactgggtgttttcgtggagatacagccatacgcacaggtgtgttcacaaatgttaattctaaaggtcaaacacccggccaggcataagggctcagcggtaatcccagcactttgggagaccaagactggtggatcacctgaggtcaggagtttaagaccagcctgagcaacagggtgaaaccccatctctactaaaaatgcgaaaattagccgggcatggtggcgcacacctatagtcccagctagtcgggagacagacacgagaattgcttgaacctgggacatggaggttgcagtgagcagagatggcgctgctgcacccctgcctgggtgacagagtgacaccctgtctcaaaaatgaatagataaataaagataaaacacctgctcctcttggtgtctccagtttggatttggcctgtgtagcctcttccttcgcctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcggcagctacatctttgaccagtgtcgtcccccctcaggcccgagcctgccttcttctcctcagttcccaaagctgcagtctggtccccccgccaggctcgagcctgccttcttctcctcggcagctacatctttgagctgtttgctgaagcccagatcacgtttcagaccaagggctgcatcctggactcgctggaccagatcatccagcacctggcaggacgtgagtgctggcacggggtctttggtgcgggcaaatgtggcgtagggggtgcagcaggcctccatcttggcagtcagggctcccctggccgtcacctggccgtcagcaggaacaggcccacagaacctcatcttctgatcggggcgtggaggcgttagtgccacttgccagctgccgtagagcctgtcccagttctgcagctggcggcttcgtcctacagcctcatcccattattctgcttttgagaaagagcagcccaaggccctagctggcttgtggggcctctggcttctccacaccaccccgagttctgcttctcagagttgtggggtccagaggctttgcccagaggcggtgtccccatgggctgctctggtttgagacgccgggcccagcggggtctctcctctgctgcgctcccgggtgctggggagggtggcttttgctgcttcaacccttaggcgaccatagagcctcttttcaagtcccactgacccccttggagactctgtccctgcctggcttctctcctggctgctgggaagagcaggcgaactgcccgccctgaatggatgctgcgctccaccctgggccccccattgggcaggagatggagcttggcagtcgggctgagcgggctcatgctggaagggccggggctggggtcggggcctcccctgcctgcagtgtgggtgtcagcgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggaccaggtggggtgggcacagggtggtggggcccaggctcagccctccctccactgtggccgtctctgtggccagtgacgccacagcctgtgtcttctctgtgcggtagctggggctggaaggacagcactgccttgtcctcccaactcctccccaaaggcacggtgggcatcccaggcccagacccctctgtctgtggctcctgcctgccaagggctgctgtgctgtcccgcatggagtgtggttggctcttcaagcaggaggccgtgcacctatcaggcggacctgcttccatgtccctgatgggtcactgcaaagcacctccagcacatggccaggcgaggtagccctgcagcccagggcctggagggcaggtgtgagctggcccgggcctgtccctccctggaatacagcttcccaggctcccacttatggagaagtctcctccacactatggaactgaatcctagaatgtggcttctgaggttcctacactcgaactgaatcctggaatgcggcttccaaggcttccagctatggagaagactccacactctggaaccgaatcctggaacgcggcctcccaggcccccagctatggagaagactccacactctggaaccgaatcctggaacgcggcctcccaggcccccagctatggagaagactccacactctggaaccggatcctggaacgcggcctcccagcctcccacttaaggagaagtctccacactctggaaccggatcctggaacgtggcctcccaggcccccacttaaggagaagactccacactctggaaccgaatcctgcacactccatcggtttggaatttcctttggctgctgctctaagtagccgctggtggatgactcagcttctgccagccctcgggtgcctggaggatgagggactgcacacagtgctcacccgcgttggctcctgagcccctgcaggtgtgggcggtgcccatagggctggtgctgggttgggcctgcagccctgagtcacaggtgaccctgggggcagagtggggccagtggccccaggaagaggatgtgggatgcacagctcagctggaggcgaactccaggcagggtcaggccgtgtgctcggaagtcagggcttagctggaggcaaactctgggcagtgctggcccgtgttggggaaccagttgcccctgggcccccgtgagactgctgggtcctcatccctctctgcctgaggccggagctgccctgggctgaggcacagggggatttgtggtggtgtttttttgagaaagggtctcgctttgtcaccccggctggagtgcaggggcttgatcacagctcactgcagcctcaacctcctgggcccaagtgatcctcttgcctcagccacccgaggagctgtgaacacaggtgtgcaccaccgcactcagctaatttttaaaatttttttgtagagatgaggtcttgccatgtttcccaggctggtctcaaactcctgggctcaggcagtctgcccgccttggcctcccaaagtgctgggattacaggcaagagcttccatgcctgcccagcagaaggcttttcgaaggaagctgtttcctgaggcagactcagccctgctcatggcagccaccagcgtgggggtgaacttgttctgttacttccatccccgtgggccaaatgctttggtaaaacacaaggccctgtgtttagctgtcttgacagtgaaaatggctgggaaggaaggaaggaacggaaggaaatttctctctccttctgtgcgtacccaggcacgtgcacatgcatgcagagtacgcacacacgcacgcacgcctgcacaaatccacgcatgttgccaagtctctgtgttccagccgtggtgtctgccccccggtgttctctagttcggcttctccgcatttctgtgaatgattccggcttcttggtgttcccagcagaactccctcaagtctgcggcggggctctgacggcggtggcttggctgacatggccacattgctgagcctgttgggggctttgcgttcctgttctggccgtttttggctcgttttccaggaacggtcgtcacgcgctcctctcctagtgcaggcatcattcctttcccattgatttgcagggttctctgtaagttctgaggatcccatatacatatactctctgtaagttctgaggatcccatatacatattctctctctaagttctgaggatcccatatacatattctctctctaagttctgaggatcccatgccgacatacatattctttccttgtctcatgctggtcattttttccattttcatgacaggtttggtgaacacatgtttccttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggccttacagtcctataaggtaggggccacctccaggaggcaggtggagggcagcccttgttccccggcagggctgggggccttacagtcctataaggtgggggccacctccaggaggcaggtggggctgggggtcttctggtcctaaaaggtaaggggctgcccccaggacatgggcggggcctccacactcctggtcctgtcccctccaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttactgagagacgtaggagatggcctgatggcaccgtgacctgcccagagtcacctggttggtggtggcagagccacagcccagccaggcctccctgctgggacacgctcgtttatgccgaggccgtcagcacagagcctccacagtgaggcacggctctgcctgctgcctccacgcagcgcctggccgggccaagcctcagggtcacatctgaagggggcccggctggccctgttgtccgaagcccctggtgcgctcagccccgaggccccacgtgccttcttggcttcctgtgctccgtggcgtcttcgagtcggtgctgccggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacagtgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaactttccttccagaccatcagtgcttactatgcaagggttgccgcccctgggtccaccggcgccaccttcctggcggtctgccggggcaaggtgagctctccagggccctctgccctgacctggttgcctgttccctggtgggtgcttatggctccccagcagactctgggccctgggggctgcccggtcccctccttgggtcccacgagagcgactgctggccctgctgggagcgtgtcctgctctgggcctgggcaggcaggatgggagtttcctggccacaagagttggaggtggcgtctgggagctgtggaccccaagtggggtcctgacccacagatggagcttcctcccacccctggttggggacggagcctcggggaaggtggctgggctgggtgtgggcaccagggagaggagcccccacggccccaggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttgggcaggtttggcatggggcctgcagcactgggcttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccacctccacctccacctccacctccacctccaccaccacctccacctccaccaccacctcctccaccaccaccacctccaccaccaccaccaccaccaccacctccacctccaccacctccacctccaccaccaccacctccacctccaccaccaccacctccacctccaccaccacctccaccaccaccacctccacctccaccaccacctccaccaccaccaccaccaccaccaccaccaccaccaccacctccaccaccaccacctgcaccaccacctccacctccaccaccaccaccacctccacctccaccagcagcagcatcacttgttggggagaccctgtgcaactccatgcacagccctgtccctgccatagccccgacccctaagcacagccctgtccaactgccacacgtcccctgcctcccatgcatggtcctggggggtcaactgcacacgccagggtcctagggtcctagacccctgtcctccctgtttctgcctctgtttggggtggagtccaagtctccagaggcggaagcatctgtgttcgtgtgttaatgaacagcccctacagagttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtg

SEQ ID NO: 1964 - DNA, 38444 bp, Homo sapiens; identical to SEQ ID NO: 1963

SEQ ID NO: 1965 - DNA, 40889 bp, Homo sapiens
agtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcaggtagagcacaggccccgaggaaaggactgcgggtgggtggagcttcagccaggacggggtgtgcttccctctcccggcccattccagccaggcccctccgggccagaggcagcgtctgtcataaaaagggctggtgttccaggtggggtcagagagaggattgacaagtaaaaacgatcgtcctttgaagggggccggcccctccacacctgtgggtatttctcatcaggcgggacgagagactgagaaaatgaataagacacagagacaaagtatagagagaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccacccatgttagacttctgtgtggaagagctcacacagtggtctgagacagccagccggcaagactgcctctggctggtgcctggggccttggattttgggaaggctccctccatttcctgatgagagggtctccctgcacctaacctgctggtgcaaacagtaggggttttgctgaacaccggctttctcttcggggactttgttgcttgcccagcagcaggtgctccagtgaccggccctcataccatcttgggagggtgtcctggaagccgtgtctggcctcccgcgaccctgccccgtgtgtctttttcctgtgctgaccttgctgcggaaaattatggccctgagtgtgactccaggctgagtcctgtgggtccaacacgggatgccttggggcctcttctggagacgggatgtgagtgacaggagccggccggggcagcttgccctgtgactgcacgtggccacagcctgtgagggccgggggtgcttctccacccacgtggctgcccctcgggtatgtcaagggcttctggggctcatcacggggtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctgggacctggtggggacgctgggcctggtacctggtggggatgctgggcctgggacctggtggggaggcctctgactgcctcctggtgctgcttccgtctgtgttaggcctctgggtattggggcccccatctgtctcctcctccaggcctgtggactcagaccaggaagacacaggccagcccctgcctgtcccccttggcttgggctctcactgcccgacctggcgggaggttgcctagccgtgaaccttcgcaccctgtctgccaccggacaggctgtgagggggtgtctgcagcacctgcaccggcctgagcatcttcagagtgggctgcagctcctggaggggtctgagaggaagggaggcaggtattttgggcgaatgaggagacagctggagagctggcacccttcctggcctgcgtcctgtgaggactctggttggggacagcaagcttggggtcagcctggggcagagcctctgggacggccccgcccctcgtgccccttcccctcgcagctcctgtcctcgccccgccctcagctctccgccaggcaaggtttggcaagtgccgctgtgcggcagtgcctgctgattggctggtctgttgctatggtgctgcccaggggtgtgcttttcctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatttcttcacttttctttgttcctttttaaattatgaaactaaccaccattcagtacgaaaaagtttaagcagctctgaggaagatagagtaaaaaattgtctccctcttccctggccctcagccatccccggtggccaccgtggagtgtggacggagccctgcaggcctgtgtctgtgcggaagcacgcgcagttttgtctgcacagactgtcctgcagttggctgttttcactcagcgttgtgggtatagcttcccatgctggtgctggcagctcggccttgttcttttgaggacagcagatgtctcctatgtctacctcttacagcttcagagattcaagttataataaagctcttcttatattgagggggaaacctccctcccccttttttttgaaacagggtctcgctctgctacccaggctgcagtgcagtgtcacagtcttggctcactgcagcctcagcctcccaggctcaagcgattttcccacctcagcctcccaagtagccgggactgcaggcacacaccaccatgcctggttaatttttgtattttttgtacagacagggtctcactctgttgctcaggccagtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccaggatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgggtgctattccaggcatagcaagactggcttcactcacatggagctttgattctagtggtggggacaggtggacagcaaaagagtaagcacgtgagctgatgatactgaagggaaatagagcagagggaggaggcggagaccgagccaagcgggcccaagtgcgatgtcggcgggaggtggggaatgctggtgggtctgaggggagcctcagcaggtgcagcagagcaagggaagaggtgagtgggggcggctggggggccgactcctgggaagctgtagcagaaccccacagagagctggtgaggtttgccgtggttgtgggtgactcggtgctttgagccctggctgcccctgggaaccatctggagagcttctaacccaaccaggcccctccctgggacagttatatcacagctggtaagccgagtctaacactttcacggaaacgcagaagatctaaaacagcaagatgaccgtgaagaagaacagagctggaggactcacctcgctggtttcaagactcctctaaagctgcaggagtggaggtggagatggcccagctcaggcacaggcctgcaggccatggagaaggcagcaagctcaagctgacccacacgcatgtggtcattgttttttttttcagttggaatctcactctgtcacccaggttggagtgcagtggcaccatctcggctcactgcagcccccgcccctaggttctagcgattctcccacatcagcctcccgagtagctgggattacaggcgtgcgccaccatgcctggcccttggtgattgttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctgtggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggcgcccgccaccacgcctggctaattttttttttttttttgtatttttagtagagacggggtttcacagtgttcgccaggctggtctcgatctcctgacctcgtgatccgcctgcctcggcctccgaaagtgctgggcttgcaggcgtgagccaccatgcccggccaatgtgtgaaaatttaaaagtaccaaagctggaccccaccccagattgctcccatgacactctgtgggtgggacctgggagttgggttttgttttgttttgttttgtttttgagatgaagtctcactctgtcgcctaggctggagtgcagtgacacaatctcggctcacattaacctctgcctcccagatgaaagcgattctcctgcctcagccttctgagtagctgggattacaggcacacaccaccaccccctgctaatttttgtatttttagtagagacggggttttaccatgttggccaggctggtcttgaactcctgacctcgtgatccgcccgcctcggcctcccaaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccggcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtgtcaaaaaaaaaaatgttgactgggcgcgctagctcatgcctataatcccagcactttgggaggctgaggtgggcggatcacgaggtcaagagatcaagaccatcctggccaacatagtgaaacaccgtctctactaaaaatacaaaaaaattagctgggcgtggtggcgtgtgcctatagtcccagctactcaggaggctgaggcaggagaatcactcgaacccaggaggtagaggttgcaatgagccaagatcacaccactgtactccagcctggtgacagagcaagactccgtctcaaaaaaaataaaatcaaaaagaataattggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccagtatcaacttggcctctactgtgtaaaactggaaaactctactttgtgaagctgagttgggagcatcgcttgaggccaggagtttgagaccagcctgggcaacatggcggaacctcgcccctgccaaaaaattagccaggtgtggtggtgtgctcctgtggtccaagcttttccggaggccgaagtgggaggcgtgcttgagcctgggaggcagagcttccggtgccccagatgactccactgcactccagcctgggcggcagagtgaggccatctcaaaaaaaaaaaaaaggaaaactaaatatattcactgtaagggcattttgcatctttaaatgacccacaaatctggcatgcatcagctgctctgcctgtaggttccttcccagtgtttgtccagaggtgtatttccacacagcgctagtcacggcatacgtggaaaacgtggaaacccttcatggatgttgtcagttggtctatattttctttcttttttttttttttgagatggagtttcacttttgttgcccaggctggagtgcaatggcgcgatcttggctcactgcaacctccgcctcctgggttcaagcaattctcctgcctcagcctcccaagtagctgggatcacaggcgtgcaccaccacgcccagctaattttgtatttttagtagagatggtttctccgtgttggccaggctggtctcgaactcctgacctcacgtgatccacccgcttcggcctcccaaagtgctgggattacaggcgtgagccgccacgcccggcctttgtccatattttctacatggcttctgtaaacagctgactaggagtctgtgtgaatatcttcataggttctgctgtgacactacttgctcgtgagcatctccaggtgtaaacagcatcagcttcccccattttcctttaaaatcgcacatgtggacggacaccacggggaccctggaccctggggagccccgtcctcacccttctcaccaggatggctgcttggtagagagtgagtttgcaaagttggcatttgtttagtacagaagttatcaggtgttctggctttagaatccctttatatatatatatatatacatatatttaagtgacagggtctcactctgttgcccaggctggaatgtggtggtacaatcaaagttccctgtagcctcggcctcctgggctcatgggatcttcccgtctcagcgtcttaaagcgccgggaccacaggtgtgcaccactgccaccggctctcaagattgccacgcagggagttgcagtgggggaaggggttcctgggactttgaacgctccacctccctcctctccacagtcccccaaccccacctctctaacggggtggacggccgcctctttccatccttcgcttggcgcagggtggggagagtgacaggtctccttccctcatctcggcagctgccatttcatcgcttacataacgtgggagaaacatccacccacccccaggcctgtgtgaacatcaccacggggccttctccactcttcagttttgttagttacttgatgtgcagggctttttgttgtaactagtgggggacgtgtggtggggtgggcttctgccatctcattcaggaccagaacttcagttttcatccctatctgttcccccacccctttggagatggggtctcactctgtcacccaggctggagagcggtggtgccatcacggctcactgcagcctccacctcctgcagcctccacctcttgggctcaagtgatcctcctgcctcggcctcccaagctcctgggactacaggcgtgtgccactgtgcttggcagggtccattcttttcctcacactttatttattgaagagcccaggccgtttaccctgcagagtcggaatctgtacaggaggggcagccacacgagttccccggtttactctgaacttaggtggcttgagggccccagttagactgcggccaccgtttgccgggctccagatgggacgtcctttctatcagaaggctcacagtatctcctttcccgtttcttcccatgtgaacattgttgctgctgaacacctgaatatgttaatcactgggggcttgcaagatggcagtgtgctaattccatcatctagtcagttagcaggaataacttaggaccacgccctgcaccatatcagctatgtggtgatcccattcacacaggaaaggtgggacaaatgctgggggtgggccgggtgtgctgtctcacacctgtcatcccagcactttgggaggcccaggcaggcggatcacgaggtcagagattgagaccatcctggccaacacggtgaaaccccgtctctactaaaaatacaaaaaaattagccaggtgtggtggtgcatgcttgtaatcccagctacttgggaggctgaggcaggagaatcacttgaacccaggaggcggaggttgcagtgagccgagatcgcaccattgcactccagcctggcgacagagcgagactccgtctcaaaaatcaatcagtcaatcaagtgtcatcactgaatgtttgtgtgtgaacgtggggattggtcctgccccatgctccctcctgaatctcactcctgacctcagttgctgcaccttgaggtgttttcatgtgggctcttgtgtcctgaccccggcggttgtggcctctttgctgtctgggagtcaggatttttcacactcatgtcctgctccagacctggaatcagccaagtctccaagaagccctgctttcttttcctgcaagacggtatttcaagacccgccatgcggcagcgggttggtcatggttactgggttggtcgttgttactgggtgttttcgtggagatacagccatacgcacaggtgtgttcacaaatgttaattctaaaggtcaaacacccggccaggcataagggctcagcggtaatcccagcactttgggagaccaagactggtggatcacctgaggtcaggagtttaagaccagcctgagcaacagggtgaaaccccatctctactaaaaatgcgaaaattagccgggcatggtggcgcacacctatagtcccagctagtcgggagacagacacgagaattgcttgaacctgggacatggaggttgcagtgagcagagatggcgctgctgcacccctgcctgggtgacagagtgacaccctgtctcaaaaatgaatagataaataaagataaaacacctgctcctcttggtgtctccagtttggatttggcctgtgtagcctcttccttcgcctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcggcagctacatctttgaccagtgtcgtcccccctcaggcccgagcctgccttcttctcctcagttcccaaagctgcagtctggtccccccgccaggctcgagcctgccttcttctcctcggcagctacatctttgagctgtttgctgaagcccagatcacgtttcagaccaagggctgcatcctggactcgctggaccagatcatccagcacctggcaggacgtgagtgctggcacggggtctttggtgcgggcaaatgtggcgtagggggtgcagcaggcctccatcttggcagtcagggctcccctggccgtcacctggccgtcagcaggaacaggcccacagaacctcatcttctgatcggggcgtggaggcgttagtgccacttgccagctgccgtagagcctgtcccagttctgcagctggcggcttcgtcctacagcctcatcccattattctgcttttgagaaagagcagcccaaggccctagctggcttgtggggcctctggcttctccacaccaccccgagttctgcttctcagagttgtggggtccagaggctttgcccagaggcggtgtccccatgggctgctctggtttgagacgccgggcccagcggggtctctcctctgctgcgctcccgggtgctggggagggtggcttttgctgcttcaacccttaggcgaccatagagcctcttttcaagtcccactgacccccttggagactctgtccctgcctggcttctctcctggctgctgggaagagcaggcgaactgcccgccctgaatggatgctgcgctccaccctgggccccccattgggcaggagatggagcttggcagtcgggctgagcgggctcatgctggaagggccggggctggggtcggggcctcccctgcctgcagtgtgggtgtcagcgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggaccaggtggggtgggcacagggtggtggggcccaggctcagccctccctccactgtggccgtctctgtggccagtgacgccacagcctgtgtcttctctgtgcggtagctggggctggaaggacagcactgccttgtcctcccaactcctccccaaaggcacggtgggcatcccaggcccagacccctctgtctgtggctcctgcctgccaagggctgctgtgctgtcccgcatggagtgtggttggctcttcaagcaggaggccgtgcacctatcaggcggacctgcttccatgtccctgatgggtcactgcaaagcacctccagcacatggccaggcgaggtagccctgcagcccagggcctggagggcaggtgtgagctggcccgggcctgtccctccctggaatacagcttcccaggctcccacttatggagaagtctcctccacactatggaactgaatcctagaatgtggcttctgaggttcctacactcgaactgaatcctggaatgcggcttccaaggcttccagctatggagaagactccacactctggaaccgaatcctggaacgcggcctcccaggcccccagctatggagaagactccacactctggaaccgaatcctggaacgcggcctcccaggcccccagctatggagaagactccacactctggaaccggatcctggaacgcggcctcccagcctcccacttaaggagaagtctccacactctggaaccggatcctggaacgtggcctcccaggcccccacttaaggagaagactccacactctggaaccgaatcctgcacactccatcggtttggaatttcctttggctgctgctctaagtagccgctggtggatgactcagcttctgccagccctcgggtgcctggaggatgagggactgcacacagtgctcacccgcgttggctcctgagcccctgcaggtgtgggcggtgcccatagggctggtgctgggttgggcctgcagccctgagtcacaggtgaccctgggggcagagtggggccagtggccccaggaagaggatgtgggatgcacagctcagctggaggcgaactccaggcagggtcaggccgtgtgctcggaagtcagggcttagctggaggcaaactctgggcagtgctggcccgtgttggggaaccagttgcccctgggcccccgtgagactgctgggtcctcatccctctctgcctgaggccggagctgccctgggctgaggcacagggggatttgtggtggtgtttttttgagaaagggtctcgctttgtcaccccggctggagtgcaggggcttgatcacagctcactgcagcctcaacctcctgggcccaagtgatcctcttgcctcagccacccgaggagctgtgaacacaggtgtgcaccaccgcactcagctaatttttaaaatttttttgtagagatgaggtcttgccatgtttcccaggctggtctcaaactcctgggctcaggcagtctgcccgccttggcctcccaaagtgctgggattacaggcaagagcttccatgcctgcccagcagaaggcttttcgaaggaagctgtttcctgaggcagactcagccctgctcatggcagccaccagcgtgggggtgaacttgttctgttacttccatccccgtgggccaaatgctttggtaaaacacaaggccctgtgtttagctgtcttgacagtgaaaatggctgggaaggaaggaaggaacggaaggaaatttctctctccttctgtgcgtacccaggcacgtgcacatgcatgcagagtacgcacacacgcacgcacgcctgcacaaatccacgcatgttgccaagtctctgtgttccagccgtggtgtctgccccccggtgttctctagttcggcttctccgcatttctgtgaatgattccggcttcttggtgttcccagcagaactccctcaagtctgcggcggggctctgacggcggtggcttggctgacatggccacattgctgagcctgttgggggctttgcgttcctgttctggccgtttttggctcgttttccaggaacggtcgtcacgcgctcctctcctagtgcaggcatcattcctttcccattgatttgcagggttctctgtaagttctgaggatcccatatacatatactctctgtaagttctgaggatcccatatacatattctctctctaagttctgaggatcccatatacatattctctctctaagttctgaggatcccatgccgacatacatattctttccttgtctcatgctggtcattttttccattttcatgacaggtttggtgaacacatgtttccttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggccttacagtcctataaggtaggggccacctccaggaggcaggtggagggcagcccttgttccccggcagggctgggggccttacagtcctataaggtgggggccacctccaggaggcaggtggggctgggggtcttctggtcctaaaaggtaaggggctgcccccaggacatgggcggggcctccacactcctggtcctgtcccctccaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttactgagagacgtaggagatggcctgatggcaccgtgacctgcccagagtcacctggttggtggtggcagagccacagcccagccaggcctccctgctgggacacgctcgtttatgccgaggccgtcagcacagagcctccacagtgaggcacggctctgcctgctgcctccacgcagcgcctggccgggccaagcctcagggtcacatctgaagggggcccggctggccctgttgtccgaagcccctggtgcgctcagccccgaggccccacgtgccttcttggcttcctgtgctccgtggcgtcttcgagtcggtgctgccggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacagtgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaactttccttccagaccatcagtgcttactatgcaagggttgccgcccctgggtccaccggcgccaccttcctggcggtctgccggggcaaggtgagctctccagggccctctgccctgacctggttgcctgttccctggtgggtgcttatggctccccagcagactctgggccctgggggctgcccggtcccctccttgggtcccacgagagcgactgctggccctgctgggagcgtgtcctgctctgggcctgggcaggcaggatgggagtttcctggccacaagagttggaggtggcgtctgggagctgtggaccccaagtggggtcctgacccacagatggagcttcctcccacccctggttggggacggagcctcggggaaggtggctgggctgggtgtgggcaccagggagaggagcccccacggccccaggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttgggcaggtttggcatggggcctgcagcactgggcttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccacctccacctccacctccacctccacctccaccaccacctccacctccaccaccacctcctccaccaccaccacctccaccaccaccaccaccaccaccacctccacctccaccacctccacctccaccaccaccacctccacctccaccaccaccacctccacctccaccaccacctccaccaccaccacctccacctccaccaccacctccaccaccaccaccaccaccaccaccaccaccaccaccacctccaccaccaccacctgcaccaccacctccacctccaccaccaccaccacctccacctccaccagcagcagcatcacttgttggggagaccctgtgcaactccatgcacagccctgtccctgccatagccccgacccctaagcacagccctgtccaactgccacacgtcccctgcctcccatgcatggtcctggggggtcaactgcacacgccagggtcctagggtcctagacccctgtcctccctgtttctgcctctgtttggggtggagtccaagtctccagaggcggaagcatctgtgttcgtgtgttaatgaacagcccctacagagttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggtgagagctgggcgaggggaggggcccccaggagtggtggccggaggtgtggcaggggtcaggttgctggtcccagccttgcaccctgagctaggacaccagttcccctgaccctgttcttccctcctggctgcaggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaaatgatcggaccgctgcctccccaccccactgcaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgc

SEQ ID NO: 1966 - DNA, 16106 bp, Homo sapiens
ttggttaaaacacctttaatgatagagggaaagacactaatatctcccgtctgttcttgacattttactaggttaggaagctctggagcctacagcttgaggagaagccatcgttcaagtcagtcaatagcaaaaccctcactctctcctcctcagaactcctgttccaaatgatcctatgttaagagtaaatactacaactcattacaagacggagaggcagggaggacgccacctggagctgggactcttaagaaccagacaatgacaaagacacaagccccagcctacggataggcaaaatgggtaggggtcttgaaagaggaagataaggaaaatacaaggggccagggaataaaggagggagttatctaaaactagaagcatactagtgctaggaaatcccccatgatccctggtacacctctgcacactatgtcactattagcccaaaagaatattaacgagaatgtccacattcacaagaatttgaggccttttcccttacatcatgtccctttcttagtcacataggtaccagcaagccctatgttctagcaacattccttaactctctcatcattagttcatcaaccatgctgaccaaaaatgctccttaaagatacgaacttcacatttcccaaatatctcctgggagacctcttggcaagaaatcagcttgtttcccaactttgagaggtcatcatgaatgagaagctggagaggtcttggcacactgaccagccaaaacctttaccttaatgtgaccatcaggggatttactgggaaaattttcctatgcccttccttcatttctccctacttcctagggttgggtcaccaattactggagcatcttcagtaccggcaccttctggagcagggggaggaagaaggaatgtacagtttgctacttcttgtctatgatgggcttctcaggcactgccttgggtgcaggaggctgaaataggaggggggctgtcttctccttggcttccctggatcccattgttggaggcaccttcccagccacagttcctaggccaaacagcactggtggggccaggcttggagtggtagtggaggtggagctggaattccagggcttcatgggcaggccatttgacaggaatgccacatactggttctagaaagataggggacccatacccaccagctgagcagaaaggtcaccccagaggagtggcactgggccctccagagacagctgccagccctttttggctaggctgcaatgccaaatgtaggtgctcaggtgcacctaccaaagggaaagggagaggagagaggagggggaagaagggtcacaccagggaagctggagagggttccccttgagaaagctgcagagaatctatgttcctcaggtacaaagaatgaggagggaagaaaaattccttagggggccatccccttgtaagcacagtaatttccaagctcagggactacagaaaagccactagggacataacatgttaagaacttagagaaaaagacaaaatcagggctcataactctgggaggtccttttgtgaagctgtttctgctctgtgggacaaagagcagcaggtacagaaaaacaggctcatgggatcgtggggtcatcttttcggggaaagggggagagccctgtggaggtgatggaaggcgaacagccagggactagagaaagagcagcaatattctgagggccatggggggcaaagggctgtacctggtggtgtgccaggagcatatgcttcttgagggtagcccgctcaagaaagccctgcctgcagaaaacacaagtgaagagcggcccctccttggggtgggtcttctgatgctcctccagagctgcctgggagggaaaggcctggccacacacttcgcaggcctttctgctgctgctctctcctggctcctttctcattgcctcctgcaggctcagctcctctaccaaggtcacgctggtggcttccccttctggggtgagtgctgatgccggacttgagcttctctccggtttgcccccctcttccttgcctcctaaaacaccactgcttccctgctccattggctgaggctgatccaggctgtcaggtggtggtggtggtggcaaagaagactgttgagtagttttctcattactgtccatctccttcccagctgtggctgctgccgccactgtccccacctcctcctctgccccagatgcctcttctgaatcacctctcactgatattgccttctcacctccactctctgagcctctccctgccagggaatcttcatcagtcacatcttcctcttcttcctcatcctcctcttcctcctcctcagacaactcctcttccggtgatggctgctgggactgctgctgggggaaactccctgccccggagactgtagattgctcggagccattctcctgagcagctcctccaccttcagggagtgcagtaccaccgttggggatctggccccccaggtgcatccggacatgctgctgcagagtgacagcattggtgaacttcttctggcagatggggcaggaattctgtgcccgggcagctggactggccttgtggcccacgaaatgtgcacgcagattacccctggtggagaaggctctgccacacactttgcatttgaagggcctctcacctccatgttggccataatgaaggcgtagggcccgaggacagctaagcactcggagacagatgacacactggttaggtccagaagaggctgaggatgaaggtgcaggggcagaggtggtgggggctcctgaggcagctgaggtcaccgccacagctccttgccggtcaatcttttctaccagttgctgcagctttgatgtctcagagggtgaggcccccaagggctctagcacataggggaaggggaagctgccagtggacttgaagtggttggtaagcagtgcccagcttggtagtgaagtcaccaacttacttagttgcatgcgagttgccgtgctactttctgccactccactgatggctgagccctcactccctgggggggtgttttcatcagctttattcttgggttccactgctttcatgagcacaaacttattgaaagcagggagtcctggagccgtggctgtgcctgcactggtggagagcagagtcaggctctctgtggcactgagtgctgttgtggaggccaccagaggcttgcgctcaacccctccacctggagtggctgcctcctcctcggccttctctggtggcacggacataccataaggcaagccactgctggtaatgacatagtctaggtgctctggtactgggtgtgggttcatctgcacatgtgggtacttctcacgatgccggtggaaatgcactttgaggttgccacgggtggtaaaacggtttccacagacattgcacttatagggcctctcacccgtgtgggaacgaaggtggatctgcagggcactgtcactgccaaatactttggcacagaagcggcatttgtgccttccaccaggcttctccaagggacccatcacttctccgtagctcagctcaccacttccattctttggcttcaggagccctggggaggcagtggcctcaaggcctcgggctgccccaagacactgtgctgccagtagtcccgtggtgcttgggaatgccagatgaggcgaggcaatcagctgatctgtgctgcctggcaaggctggggaaggggcaggggtgggtttgtggcttcgcccaacccctccagcagagaaaggatgctgtgaccccagtgggtggtaaaggtggaagaaggcctgcttgggcgtttctgcccctgaagaggaagaggaggaggaggaggaagatgccagtgtcttgctggtttggacaggcttgatggggctgaagaggggtagtaggggcttggtggaagaggcagtccctgtcccaggtagctctgagggactggcaggggcacccaccgtctggcctaaggagccaagcaacagcacctgcctgcagatttgctcagtcatctgcatctgatggatctgccgctgctgcagcacccgtagctcttccaagatcagggggatattcaagtggccactgcctacccctgggggcggagggggtggtggaggaggagggggtgcaggggtcgattctggaggtaatggggttgctcccagcttgggactggccaagatcaggcccccgcctcccccagccgctgtacctgtggcagcgaccaggaaatgccctggagactcctctcctctcctctctgggccccaggtgggatccgtgggcacggaggacccagaatctggggggttgctatgctctgtgtccatgacctgaggattattgtgaccctcaggccggggttcagaggaggccgaagagttgttggggttctcctggcccccaattatcaccattacaggagggtcagtagaacatgcgttctggtgggcgaggaattcagttgggtcagtgaattgtgcgcagcacttggcacagacttgggggtgatcctcctcgctagcatcacctggggagaagacaaggagagagagcgtgggtggcgcagttgggttgggtataccgaggctctaattaacaaggaggccagtaaccgctagttgggggtggggagatgagctcaccatcagggccatgcagaagtctagagctcaggcctgatccgtgtggacaggagacaacccggcatggggcaggggggtggggagggaggaggggaggggggcaagagcatgctactcccctcctcagccaccctcccttccccaggccacaagcgagttcacggaataggtgtggggacaggggcctacgcagagaatcatgcattttctcccacccaccgaaagtcttcgccgcccctgcgcatccccctccgcccccacccctgcccagcccgaccgaccctaccgcacctccgagctctgccggctccccgcagggcaccccgagacgagagctcctctcggattcgtgcgccatggttgtgggggaagtggagggccaggtggggtgggagacaatggatattgggattgagggaggcgatggccgctgggtctgcggcagcctctgcacccagcggcccagactgcggagatggagatcggcagcggcgggggcagggagcagcggcggagggggaggggagcgaggaggcggggagaagctggagtgagaaagcggggagaggggagatctgggaggagctgatgaggaggggagtttatggggaggagctgctggggagggaggcgggagctagaggaggcgggagaagggagcgctagcgggggcgtgggggcgggagctcagagctcgggagagtttccggaggcgcagtgacaggtgctgtgaagcactgcgggggtccacctttcccggtccctggccagctccccccatctgcagatgcctttgcccaggcctaccctcctccccccgccctcccctcctaagctctaggggcacagtgggaaacgtagccctgctcagtggagcaaggcgataggcttctcttatttttctttggataaaggatccgctgagcttggaaaaagtggattccagagagggtcgtctgatctcctcagaggtctgagggccagaagaagagggggagatcagaacatccactcctcaccagcacacacaccccaaaatattcgaagttttgtctcgtctttctcacttccattcccaccctacccccatccctctccacaaaagaagtttctcagggtgggcggctgcaaggtagaatttcccaggaagtcatttcaggactctctgcggaacactaagccccttcactccccgcccctcctccccctgaataatagctgaatgcaggttactccgcagatcgcccagcctacacaacacctaattcatagagtccatgcttatttaataagccatctcctatttagtaccctcttcctcctctattctcctcttgcaacattcctcacaccgtcactattaaagacagtgggtttggggagacgctagcctgcagaggcctacggaggcccacccagctctaacctgggggggaggggagccctcttgaaacaatgcggtaggaactaccaggcagccctcagtgtctaaagccctttcagccccagcctgatttgaatgcttagaaatagctaacacctgctcaccatcacagaggcagcctcctattcagacaggataagtaagaataaaatgcctcctggaccaggtattctggcattctcttttttaccttgaaatgagtcttaaagtgcttcccacttcctaaaatactttctcttacatgcaggaagtgaccacaagtccttggttttgtggtttccctgggcatcagtaaacctaaattgttttaatcccagttctattcttgcctcactgataaaactgagacatggtggtcagtcacaccatgttataccaccgtttccctcttcataaagtggtaatattgtagctgcagtattttactcagaaaaatattgtggggacaaaaaattgaaaaattggacaatattaatgtgtaaaccaggtatggtggtgcacacttgtagccccagctacttgggaggctgaggcaggagaattgctttagtccaggagtttgaggctgcagtgagctgtgatcacacctgtgaataaccactgccctccagcttcggcaacatagtgaggccccattactttaaaaaaaaaaaaaagccgggcgcggtggctcactgtaatcccagcactttgggaggtgggcagatcacgaggtcagaagttccagaccagcatggccaacatgttgaaaccccgtctctactaaaaatacaaaaattagctgggcatgatggtacacctttaatcccagctactggggcagctgagccaggagaatggcttgaacccaggaggtggaggttgcagggggctgagatcgtggcattgcactccagcctgggcaacaagagtgaaactgcgtctcaaaaaaaaaaaaaagtctaaaaaaattaatatgtacatgtgagatttttaaagtttggggagtcctgaatttaatcaatgagataatttacattgtcagtagcaaaataatcgaagtaaccttaaatacacatatactaaaattagatctgttttccatgttgtttgttaatcttattaatttctgaggtaagatattggctaatatcagcagcatatttcaaaggtaggaagtcttttattgcagtgggtgggggagctgaaacaacctatttaaaatattagtaacatccactttacttctcaacataaattttgcctgtgtttttaaacttaaaacagtttactgaattatgttttgaaacttcagataataaggctcttagcattgtgagtcataattctgaaatggacgggttctgtgcttccaggcctggacttacaaatgagggaggggggttctatttcagtttatggcaagtcacagttttgtgcaatgtggtttatttttacagataaggaaactgaagcttggagaggttaagtgacttttccaagttcacacagtaattcagtgaagcaagcattcagaattttgactcctgtccaatgctttctcaagcacatcaactttgtatggcttccctaatgctagagaaagggccctgtgtggcttctacctgccatttgctccctggccttagtcagggagagggaatcagatggaggctttctactgagcatttgttaattagcattgaacatttgatatccagttgctgttttgtcaagtcttctgacaagaaaagaaatccttttcttttcatcttctcctgggaaacactgtcccctttcttgctctttaatgaaatgtgctttctgatgcgtaatttgatctaagctcttctttaaggtaaatttagtccctggtgaaaggtgactggatcaacagccacctgtaagaggaaccctccatttctcagtactttgcactcactgcacatcctgaaaaggggggcaggattcttacacaaacatgaatgaagtcacaaatgcaggaataaactaaactggtaatggtgtccctagatagcagataaggtgaggtaagctatctccggtcaaatgcaaagtccggggtgggactaagacctggacaagcttgtttaaacttatagagagctgaaatgacaaagaaaagggaaaccaggtggcttcccttctaaatctagtgtcccatcagattgcttctttaggcttcagagagaactgttcgggagaacaaagagaaaaataggtgagttgtatgtagcagggtgatacatttgaacagcggttttcaaattttgctgcccattaggattaccagaagagagttttaaaatttttatgtttaggtgcagtggtctgttccttgtagtcccagctactctggaggctgaggcgggaggatcacttgagctcaagggtttgagactccatctcaaaatctcaaaaaaaagaagaaaaaaaaaagaaaagaaagtttaagcacagtgggtacctcatgcctataatcctagcacttttggaggccaaggcaggaggattgcttgaggccaggaatttgagaccagcctgcataacatagtgagacccccatctctgcaaaagcaaccaaccaaccaaacttaaaaaaaatccctgtgtccaggccacatcccaggctaattaattcataatccctgaggataggatccaggcattagtttgataaagctcctcaggtgattccaatgagaatacaaagatggtgacacaatgatgagacccacatggaggactgccctttccatcataccttccaccctgctcctcacagatcttacctgagctaaacttggccacaattgggacacagacaaaatgaactctcaatgctaaatcttcccatcaggtcccctccctacagtgcccacaaccacacattaacttccttgtatcctttcccagtgaaaaatctgcttccatgaatagaatttgatataatttacaccttactgtaagtttaagtgattgcatttctttcccaggtatgggtatcttgaagcatatttttttcttttttaattgatatttgagccatatttctttttttttctttctttttttttttttttttttttttgagacggagttttgctctcattgcccaggctggagtgcaatggcatgatctcggctcaccgcaacctccacctcccaggttcaagcgattctcctgcctcagccttcccaagtagctgggattacaggcatgtgccaccaagcccggctaattttgtatttttagtagagatggggtttctccatgtgggtcaggctggtctcaaactcccgacctcaggtgatctgccaacctcggcctcccaaagtgttgggattacaggcgtgagccatcgcgcccggccaccatatttctaattgtaaggtgaaaggctttgttctacagagttcaagcatcatccacccattaaggctggagtgaagtggcacaatcatagctcactgcagactctacctcccaggcttaggtgatcctcccacctcagcttcctgaatagctgggactacaggcatgcacaatcatgcccagctaattaaaatatttttttctgtagagatgaggtttcactatgttgcccaggctgtctggaatacctgggctcaagggatcctcctgccttgtccccacaaagtgctgagagtacagatgtaagccactgcctctggcccacttacttattattgacactgaacaatgctaattggtagcttccataattatgaattgattctgtaactattgctactgactacttcttagggaaatatctcatcttctcctccttactcctctttcctaaatgtagacacataataatcctttgcaacccagacctactaatgtaactatggcctatgtaacacagtagactaacaggcacaatgattggtacacctggtgctaagtgagaaaaagatatttgtttccagaacaggaatatcttagatcaaacataagaatgttcttttaatgaaaatttctttgacttcaaaggactcaacacttaacatggaattcataccattttggagctgggacttcagagatctgacactctcattgtcattgtgcacagtgattcagacctgagttaaagtcccagctctagaacattctaatatttgtgatcttgggaaaatttcttaatctctcccagagtttgttttcttatttttttttgggacagagtttcactcttgttgcccaggctggagtgcaatggcacgatcttagctcaccgcaacctccgcctcccaggttcaagcgattctcctgcctcaccctccctagtagctgggattacaggcatgtgccaccacgcccggctaattttgtatttttttagtagagacggggtttcttcatattgctcaggctggtctcaaactcccagcctcaggtgatctgcccacctcggcctcccaaagtgctggattacaggcatgagccaccgcgcctggccagccttttttttttttttgagacggagtctcgctctgtcgcccaggctggagtgcaatggtcgcccaggctggagtgcaatggtgtgatctcggctcactgcaatctccgcctcctgggttcaaacgattttcctgcctcagcctcccaagtagctgggattacaggtgtgcgccatcacacccagctaatttttgtatttttagtagagatgaggtttcaccttgttggccaggctggtcttgaactcctgacctcaagtgatttgcccacctcagcctcccaaagtgctgagattacaggcatgagctgctgtgcccggctgatttctcttctttaaaatgagggtactgccatacaaaggaaggaaattctgatacatgctacaacatgaatgaactttgtaaacattatgctttcagacaaatttgactttaattgagaaaaaaagagaaaacatactaagtgcaataaagcagacacaaaaggacaaatattgtatgattccattagtatgaggtacccaaacattatatgagtccattaatatgaaatttggcaaggtcacacatacagaaagcagagtagaggctaacagggctaagggaatgggagaatggggatttattgtttaacggttacagtttctgtttgatgatgaaaaagatattgaaacagcagtaatggttacataacatagtgaatgtacttaatgccactgaattgtacacttaaaaatggttaaaatggtaaattttattacacatattttacaataaaaaaattttagccaggtgtggtggcatgcacctgtaatcccagctgttcaggaggctgaggcaggagaatctcttgaaccctggaggtggaggtttcagtgagccgagacgtgccactgcactccagcctgggcaacagagtaggacttggtctcaaaaaaagaaaaaaattttttttgtaataataagggagttggggctgggcgtggtggctcacgcctgtaatcccagcactttgggaggccaaagtgggcggatcatgaagtcaggagatcgagaccatcctggctaacacagtgaaaccctgtctctactgaaaatataaaaaattagccaggtgtggtggcgggcgcctgtagtcccagctacttgggaggctgaggcaggagaatggtgtgaacccgggaggcggagctcgcagtgagccaagatcgcgccactgcaccccagcctgggcgacagagcgagactccgtctcaaaataataaaaataaataaataaataaataaaataataataataacggagttgggaggaaaaagaggaaatgcaaaaagggcctagcacagtacctgaatgctccacaaatattagccatgggtgttagttattatttgaatgtcaaaagctgaatgaagccctggggtaagaaaggtcacatgtgcccaaggtcacatagcttcaaggtccacactagattgaaaaccaagttttctgttttcttatctagtactctgtaacaccaggactgagatactctctattccaaaatgtgttttttctgatctgggaatacctaggttgagtggcccagggatcaataacctgagagatgaggctctttacttccaaatgtaaacagagcccccaaaactctacctttgccttctttcctctcttgctgttcttgctatctgccaacttccatctaaagtactcccctctctccctctagatctgtttggctgctgtcctggtttcttcttctcactaaatatctgggtttctgattgtttcctttatttcccagatgtactggtttgcatttttcccccagtcacatcctttgtgttctctaatccagatttctagactctgtaggggagagagaaggtttttttttttcctctctagagtttttaagtgaatagagtatttcctgcccatcacttatatgcaataactgttctgttaggttttgatgctctggttagggaagctgagcaaaaacggctggaaaacagatttttcagactgtttcttggtgatgtcttaggtcactgcagaattttggcttttaaaatatgtaacaaaggctcagcatttgcatgttgtatatggcacatattgcttacaagaaggcaaaagactcctggaaacattactggcaccctagactactgactaaatgtcttctgatactcatgatgatatccataatttcacaggtacaccaaaggatacatgtgcccctaaataagagcccttcctccctaactgtggagcatgctctggggtagaaggaagtcagatgcctgaagatcacataagtgaatagaaaccctgtctataaaaaattagggaaaaggagagctctcattctgttttgcagaatggatgctgccccattcatgattaagaaaatttattaatttaaaagaaaaccagaaaatgtgaaatttatatattataagcttataagatccaggaggaattttagatacgatcaaatagagccacctcattttgcagatgaggcccaatgacatccagatcataagtagcctaggatctttcactccaggggaattctgatgagaaaatccttaggctttcttacggtagatcttaacagagggtgctactgcttccttgctccttacatttgttcctgcctttcatagctcaaaggcaaattttcatcaaaaatttgttgatgccattgggtttaaacctttactgtttctatggggatggctttgtaacagcattaccatgcccccaggtggaagctatatcttaaagggcttgaaaatccattcaagacagccgctaaagatagcttttgactccctcacagaagatttttcctcagctatgatatggggaatgggtgagcagatgggagaagtaggaagaagaggagagaatgcttcttgggggtttggaggggtgttcagcatagttccacaatcaaaccagcaggagagcagaactgtgaggcaactctggggaggagttgaggctctaggggaagtctcctgtagagcacaagcaggaaacatccggcctatagcagcattaagaagggctaatgtgtctcaggagggaaggatgccatcaccatagaacctctaaatatgggcacagtaggatcccagaaaagcagtgtttcggggaggatgcgttctgcccaaaacatgtctgttaaggttattttgtagcacatggagcgctgatttgacctcaagtttttgttttttaacaggtggaaaggcaagtttaatctacaattttagtcgccaccaatacactctcttagagcttttcatgacacgtctcataaagaaatgctgatggccgggagcggtggctcacgcctgtaatcccagcactttgggaggccaaggcgggcagattacgagatcaggagatccagagcatcctggctaacacggtgaaaccccgtctctactaaaaatacaaaaaattagcccggcgtggtggcaggcgcctatagttccagctactcgggaggctgaggcaggagaatggcgtgaacctgggaggtggagcgggcagtgagccaagattgcaccactgcactccaacctgggcgacagagcgagactctctctcaaaaaaaaaaaaagaaaaaaagaaaaagaaaagaaaagaaaaaaaaagaaatgctgacgtttgccaagaggttcctgagttttggtcatactacagcacttgcaggcagtgtcactgcattcacatataatgataataacgatattcacacatattaagcacttatttatgctaggtatttttccaagggatttacacatattaactcatttagattttcacaacaacctaatgaggtagctagtatacacatctttatttcacagatgaggaaactgaagcatagagaggcaaaataaaccagccaaggtcacatagctaaccaagtggtggagctgggatttgtctaaaagtctggtttcagaacccttgtgcttaatcctatactatactgttgggtgtatcaactgtatgctaaacagttgcctgtctggagccaggacttccagactttcagtctgcacatatggagccataccactgacaagtatgtccaaaacttctttgatcctaagaattacctggacaattgcaaaatatatagattcccacaccctggctcagatgtactcacaatcaggcaagtttttaaaacccaggtttagtgggtttagtgagcactaccagccagccctgagcattaggaaattgaagtttttgtcctgattttgcttctgtctctcagactctgagcaatttcactcttcaattccctgcttgctctactgtctgcctgtcacttaacggaatgttacaagaatacatacaatttttccccctcataagggacacctgttgcttcaaaaacacggtatcctcataaaatgatatgcatgtagtaacaggtgtattttcttgcacttcttttgttttgttttgttttttgctttgctttccttgaagcacaaacctaagcccctcatccagacctagccttcagctgtcctccaggtgacacgcatacacaccccaaaccaggctgcattctgaccgaccttagctctctccctctgggagctctgatcggctctcagttcagcccaacaatgagaaacttttttctcgtctccctcaggggagccttcacgtttatccaattcattctcttgcaacccaactctccagaaagaaaaggggggaaaatcccaccccgaagagacggtcttcaggtctgaggacgttacttagcaacggcacaaagaccagtgagcaaagggagacctgaggagaaaactcttgggtggggagacagagccagtttgaaaactccatttcatccagagaaaaacaaggaaaacacaaacagaatcaatcccaagtaacaagcggggcttctccccagcgcaggtcatctcttactccctgcatctcaactccttcaaacccccagtgaccaagtccgcccccgcctggtttcgcccatggcccgagtgccctccccttgccctggcctgacccacacaggcttggacttaggggcccccacccctccccaggcacccaccgttctcagacgcgctgggaccttcgcagtccgagattaactgttggggtttccgctgctttcgccgagacattcccgggtagagagttgggagagggaggggcaacgctcacttggtcttaaccggggtgacctggtctcgtctcccccttgggtccgaagccaattgatgcctctcccccagcgcaaatcactgtgaagcagagatgttcttctttcccagagacacagactctctctctctctctgattctctgttcttgactctctctctttctctctcaatctttgcaagtctttaaaggggagacgccccctttttttcttcagcttcttccctacgcttctgcagctc

SEQ ID NO: 1967 - DNA, 60020 bp, Homo sapiens
actacaggcacacgccgccacgcctggctagtgtttgctcttaaatacacaaaatgcactgaaccagcaaaaacaaagtcccaggtctgaggagctctgaggatgatgcctgtgatggcctctggccagctctccaggatactgagagagcaggtcaggggaggccttctccaggctgggcagtgggaaggccctctggaccgggggagtgagtattcaggggacaaaggcactacccgggtctggagccgccacggagccagggcacagcctagtttgggggattcctctgtcactggggtaggatctcccaacaagaggcggctttatgttccactcacgaagaggccagagctctcagatcttccccaaaacctaatcaggcctctcaccagcgtgttggaggccactcctggccatcatctccaactctttaccccaacctggcaccttgtagggggctagaagggtgaggggaggtgtctttcacttatgcttaggtcactcttagaggactatcctcaaacttgaggtgacagggaactcttcacgggggcaggatttgatgttttgtttttagccatgtttgtcaatgacaatgtcaatttctagttccaatttgtacccttgtctcatttctacattaaaaacaaaaaacaatcatctgtcataaaagttcagagtaagctgggtgtggtggcacatgactttagtcccagctacttggggggctgaggcaggagggtcgcttgagcccaggaaagttcgagtccaagctgggcaacagagcaaaaccttgtctcttaaaaaagaaaaaaaatagagttcagaatagataaaagagttgttattctaagaaaatagactactgaaggagaaaggctttaataatattaaaaataggcaaggtaatgcttttcatagtatagtaagatttgcctaataccatcttatttctttgattaaaagttacttagcttcagcatgcgtgtacattcaaaatacaaaattaaagcatgagttgtcattaatttgcagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggcctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctccacccaaaataagggagagatccaaagggaggcgatacaatgacgtgaaaccatagaggtaagaagcaaggcctcctaatacttgactctatgctaaactgttctgaacttgtgggtagatcttctttggttacaagatgatgcacgatcttggagagcctctgttgtaccaggaatacaatgctggtgggaggattcgtgctcctcatctgcttatttgctctcagatccattcttcactcttcctctccctactctgtctcacaggagctactccggtaaattacatttctcagctcccatgcctgttggtttccagttagatttggtcagtgggaggctctggtgggagactggaggtgagaagagggcagagaagtcaggttttttctctccctacctcctctggcacgagcggcagtggcagtgactattctgtggttctagcttttgcaggtggccccagctcctggactcccacctgctcccttggtctctcctatcctagaggtggtagcagcttcctgctgttgaatcactgtcctctatgctcatttagctctgccaaaacttttgtatctcacccccatgttaaattttttctgttgaactacactggatctgacttgatagaactattaaaaatagtttttaaaaaatgtgttattatttttttttgagatggaattttgctctgtcacccatgctggagtgcagtggcacaattttagctcactgcaacctccacctccagggttcaagcgattctcccgcctcagcctcccaagtagctgggattataggtgtgcatcaccatggctaatttttgtatttttagtagagatggggtttcactatgttggccaggatggtctcgaactcctgacctcagtaaaggcaatcatttaggccaggcgtggtggttcatgcctgtaatcccaacactttgggaggccaaagcaggtggatcacttgaggtcgggagttcaagaccagcctgggcaacatggtgagaccccgtctttactaaaaatacaaaaattagccgggcatggtggcacgtgcctgtagtcccagctactcaggaggcggaggcaggagaatcacttcaacccgggaggtggaggttgcagtgagctgaaactgtgccactgcactccagcctgggcaacagagcaagactctgtctcaaaaaaaagtcatcctattgtcatgatacttgtacttaaaggcctatctcaaaatcaacagtatttatttgtctttaaactcatctctatttctacccagcttgctttctttctttctttttttgagacagcatcttgctctatcaaccaggctggagtgtagtggtgtgatcatagctcattgcagcctcagactcctaggctcaagcaatcctcccacctcaacctcccaaagtgctaggattacagatatgagccaccatgcctagcatatagccaactttttaatttctactcattctactttcagttctagtgaattttataaatgtaaacaaatacgtcactttcctgcttaaaacccttcagtgtcaatgctccctactgctcttggctgacaggactttgataaagccccagacacctccacactctatgctccttcctgaaatgcatcatgttctttctcatcttccgacctaaccctgtggtgtctatgcctcaacccctcccctaccaccacctcctgctgccagcccttaacccagacaactcctcactcaaccttcaggtctcagtttataagcccttctttaaataagcttttcctgaccaaccaagaccagctaaatcctccttgtttttcctcttctaagactgtgtactcaccctatacccaaagtacttaccatgctcctataattattaacttatggagaaaaattaataataattattattatccccaactagattattatccccaacctgaatgggatccatgggttattaggaactgtctatcttaggtactgttccaggtacctaacacagggcatggcaaaatactcactccgtgagtgaatgtaccaaatttatagtagttatcacgacacagccaaactttaatagcctctcttgactctctatttccagactctccaagttccagtctatctgcagctagagttttcagtgatttagtttcagtgatttagtttcacagtacctaggacagacatacagttggccctctgcatccatgggcagattcaaccaactgtagatagaaaatatgaagggggaaaaatggatggctgtgtctatactaagcatgtacagaatttcttcttgtcatgattccctaaacaatacagtattaacaactatttacatagatttacattgtagtaggttttataagtaatctagagatatttaaagtataaaggaggatatgtataggtcatatgcaaacactataccattttatataagggacttgagcatctgtggatttttcttttcttttcttttctttttgagacagagtctcgctctgtcacccaggctggagtgcagtcgccggctaattttttgtatttttagtagagacggggtttcacagtattagccaggatagtcttgatctcctgacctcgtgatccgcccacctcggcctcccaaaagtgctgggattacaggcatgagccaccgcgcccagcctatccatggatttttctatctgtggggtctgtgggggtcctggaactagttccccacagacaccaagggacaattctactcttattcccacgggtgtcactctagttggagatgacacacattcaggtagatcatacagtgcatggtaattcttgaatatgctcaatgattccctccccactgtacagagaaaaaaatctcttagccaattatccaaggttctcaataatctagtccactcttcccatttaacctctccacacttaacagtaagaactttctggctgggcatggtggctcacacctgtaatcccagcactttggggggccgaggtgggcggatcacgaggtcaggagatagagaccatcctggccaacataatgaaaccccatctctactaaaatacaaaaatttagccaggcattgtggcacatgcctgtaatcccagctactcaggaggctgaggcaggggaatcgcttgaacctgggaggcagaggttgcagtgagccaagatcgtgccactgcactctaacctgggtgacaaagcaagactccatctcaaaaaaatgaatgaattaattaattaaaaaaaaaaagaattttctaccctgacaggtctcctcatggtcccctaaacagtctcagctcattccagcttcatgcctttgtgctcctcccactgccaaatataccctgcattctccctgctactcatccaaacacaaccctgccttctagatctagcagatcctgccccttcaccaggcttctcccagagatctcccaactctctgaatcctcagagatcttacctggatcatgccttgtggcacttgataaagcaccgacatcctgagctacgctttcatgtctcaccctatcctttgttccctttagcacctgacacacagggaggtgtgagggagagttctagactaggcagtaaagcactgttgccctgcatgccaatcatattcattcattcattcattcaataaatgccaactggccacattctctgtgcagacacctaccatgtgtaggtcagtaagagacaattttaacaaccttctctacagggttggcaactgtggcttggctcctcttccctctactcacattctagataatttaaatagctaactaatatactgaagtaacgaggtttagaaacatgaagtctattatcaattttatgttaaacaagttaactactcagctttggtaacctctgaaagatggagacactatgaataaccttccagggccactggtgaacaacattagaaagcattatttacatgttcacatttttattattaggacaataatgctaaacagtatccattcccaactcctgtaggaagaaatcactggctgacacagattcagacattttaaaaggaaagaaagtgaaagaccttattttcaaaaccataaccaaatgactataacttaaatgggaacttttcagcagatagacttacttttggtttttacttaaaaataaaaaattgtgcaaagtttgtgagtaacaggccacctacctgcggcttggtgaaatttctgtctgcacaccactgaacaaaatattgtcttgcggcatacaaactctttctgtccaccttcttacaatatactcgaatcagctgctctgcaaatttctctggcagaagttgtgaaacctttttaaaatgaagagatttcactatcaccttgaagtcacacattggagatatcagctggtccctaggctcctaactattcctttttttttgagacaagatctccctgtcacccaggctggagtgcagtggcacaatcacagctcactgaagccttgacctcccaggcacaagtgatcctcccacctcagcctcctaagtagttggaactacaggcatgagctaccatgcctaagttttttattttttgtagagatggggtctcgctttgttggccaggctgatcttaagctcttcgtctcaagtgatcgtcctgcttcagcctcccaaaacactgggattacaggtatgagctactgtgccaggcccactttaattgtaaagatatgccttaaaacctaatttgcatataaaatgctaatttactataaagatttgctacatgccactatagtatatttgttttgcctaagtagttacctggtttttagtaatcctgattgctctgttgggggcagtcttacaatagaagctaacatgatcaattggattcttttcttgcattccataatccatgttgataacctaaataaaagcaattcacaagtaatcatatagcaagcaggagaactgaactcagggctgtaggagcataacaagaaatggaacagaggccgggcgcagtagctcatgcctataatcccagcactttgggaggccaaggtgggtgaatcacgaggtcaggagttcgagaccagcctggccaacatagtgaaaccccacctctactaaaagtacaaaaattagctgggcgtggtggcatgcgcctgtaaccccagttactcgggagactgaggcaggagaattgtttgaacctgggagatggaggttgcagtgagccgagatcgcaccactgcactccagcctggcgacagagtgagactctgactcaaaaaaaaaaaaaaaaaaaaagaaagaaagaaatggaacagagccttctggggatttggaaataagaatgttgatgtgactcatggtggaataaaaataactggttcgtgaccactcttagggatttggtattgaaatctgggaagaatgggaaatgcacttgtgtgtttgatctaagtgtggtgtaaactcaatccctgctatgtgacagacacagatagacactagaggtacaacaaggacactttaaaataaaatcccaggccggacacagtggctcacttgagaccaggagttcgagaccaccctggtcaacatggtgaaaccctgtctctaccaaaaatactaaaaaaaaaaaaaaaaaaaaattagccagacgtggtgttgtgcacctgtggttcaagctactcgggaggctgaggcacaagaattggttgaacctggcaggcggaggttgcagtgagttgagattgcgccactgcactccagcctaggcaacagagcaagactctgcctccaaaaataaataagtaaagaaaatcctagcccccacaaaccaggcagccctagattgaaattcaacaaataattataaaagtattcaaccacagttgaaaagcaaagggtgctttgaaatgttctaacaggttacctgatgtagcctagggtgcccggagaatgaccggaaacattttcctgggaaagtgactttactaagtgagcaagaaacaaacaggcttaggtgggaagaaaaagaattgcaggcagaggaaacagctcagaggcagagaggactgaaactgtctcctggatttagcaactctgaagtcaccggtgattctggagagagtacagtgatggcaacagaaaaaaaggttcaggagaaaatgagaaacaaaaatgtaagaggcgcaatggctcacgcctgtaatcccagcactttgggaggccgaagccagcggatcacgaggtcaggagatcaagaccagcctgtccaatatggtgaaaccccatctcaactaaaaatacaaaaattagccagatgtggtggcaggcgcctgtagtcccggctactcaggaggctgaggcaggagaatcgcttgaacccaggagctggaggttgcagtgagccgagatcgtgccaccgtactccaacctgggtgacacagtgagactccgtctcaaaaaaaaaaaaaaaatgtaagagaaggcaactcttagaactttggctgttcagaggaggcaagatgttaaagaaaagaaaattacagctagataggaggagtaagttctagggttctatagtactgtaggatgactacgactatagttaacagtaatttccttttttttgacacagagccttgctctgttgcccaggctggactgcagtggcacaatctcggcacactgcaacctctgcctcccaggttcaagtgattctcctgcctcagcctcctaagtagctgggattacaggtatgcaccaccacacccagctaatttttgtatttttagtagagacggggtttcaccatgttgaccaggctggtctcaaacttctggcctcaagtgatccacctgcctcagcctcccaaagtgctgggattacaggcatgagccaccggggccggcctagttaacagtaatctattacatagtttttttgtttttttttgatatggagtttctgtgtcgccaggctggaatgcagtggctcgctctcggctcactgcaacctctgcctcctgggttcaagcgattttcctgcctcagcctcccaagtagctaggatgacaggtgtgtgccatcatgcctggctcactttttttttttttaattttagtagagacagggtttcaccatgttggccaggatggtctcgatctcctgaccttgtgatctgcccgccttggcctcccaaagtgctgggattacaggcatgagccaccgtgcccggcctattacatagttttaaatagcttgaaggagaatattgaatgttcccaacacagagaaatgataaatgtttgagatgatgggtatgctaactaccctgatctgacatttatatacactatgtaccccatgaaaatagacagttatcatttatcaatttaaaaaatacataaaataaaaacataaaggaaaaaaaagacagcaagaaagaagtatctggagaggaatctggtgccttagaaaggtaagggaagatgagtctgaccctgaaaaagaggagaggggaagagcagtgtggtgttcatgattttcttgagacaggctcttgctctgttgcctaggctggagtgcagtggtgcgatctcagctcactgcaacctccacctcctgggctcaagcgatcttcccacctcagcctcccgagtagctgggactacaggcatgcaccaccacacctggataatttttgtgtttttggtacggatggggttttgctgcagcaaggcatgatcatgccactgcacttcagcctggggcacagagagagaccctgtctcaagataaacaaaagtttaaactaacattggctgggtgcagtggctcatgcctataatcccagcacttcaggaggctaaggcagcaagattgcttgaggccaggagtttgagaccagcctgggcagcatggtgagaccctatctatacaaaaaacttaaaaattagctgggcatggtggcacatgtctgtagtcctagctactcaggaggctgaggtgggaggatcacttgagcccaggagtttgaggttataatgagctgtgattacatcactgcactccagcctgggcaacagagtgagaccttgtctctaaaaaataaataaataattaacactaaatacaataaaaaatgaagttattcagttacagcaaccacatgttaagtgctcaacagctgcatgcagctagtgactatggaaagggacatcactgaccaagaatatctctgtcactgcagaaagttctatgggacaacacttctctagaacacaagtagaattaccctaagcctttgacaagaacaaagctgtttccccactataagaatgggaatactgaatacagtgacagatggaggaaggcttgtttctttggtgagaaaggtctaaggagttgctacctaatggcctatagtttatcttggaaataggagccaaaggttgggttactcatgaggatgaatacagctggaggtgggaagcatggttggagttctgagaggagggaggacagtttgaaatgatgatgatgattattagtagtagtattttttgagatgagggtcttgctctgttgcccaggctggagagcagtggcatgatcttggctcactgcaacctccgcctcccaggttcaagtgattctcctgcctcagcctccttgagtagctgagattatcagcacccaccaccatccctggctaatttttgtatttttagtagagatggggttttgccatgttggccaggctggtcccgaactcctgacctcaggtgatcgtccgcctcggcctcccaaagtgctgggattgcaggcgtgagccactgtgcctggactgaaatgattattagagactgggagaatcacactaagcctgccagaaggcccagcttagtttcgtgaccggaaatttatagatatgcctgtatagtgatggtatccaggagcatttatgtgtccaggtatgggtgtggagatgtttagatttgattcatctaggttgtttggccttctgctaggtagatgcaaagaaggaaaagagagttgagggtaactgcagaaaatgagtgaattactgtatcacgttatctaagatacttttttttttttgagatggagtctcactctgtcgcccaggctggaatgcagtggtgtgatctcggctcactgcaacctctgccttctgggttcaagcaattctcctgcctcagcttcccaagtaactgggattataggcgcgcaccaccacacctggctgattttttgtatttttagtagagatggggtttcgccgtgttgggcaggatggtctcaacctcctgacttcaagtgattcactcgccttggcctcccaaagtactgggattataggcgtgagccacctcactcggcctacacgtggagagaaatgaagatagaaggccactgacaagctcgaagaaagtgaggacacaataaactagagggcctgatgagctaggaaaacatggatgaggaagaaaggggtttgtggacagagaaaagtatgttaaactagtgattttacagggagggcagttttgaatgttgataaggtccagggtgtaatctgctgagactattggcctgaggtgcagtgctgtctcgctctgttgcccaggctggagtgcagtggcgtgatctcggctcactgcaacctccgcctcccaggttcaagcgattctcctgccacagcctcctgagtagctgggactacaggcacacaccaccatacccagctaatttttgtatttttagtagtgatgggggtttcaccatgttggccaggatggtctcaatctcctgactttgtgatcgacccgcctcggcttcccaaagtgctaggattacaggcatgagccaccgtgcccagcaattttttttttctttttcttttttttttttggagacagtcttactctgctgcccaggctggagtgcagtggcatggtctcggctcactgcaacctctgcctcctgggttcaagcaatcctcctgcctcagcctcccgagtagctgggactacaggcgcaaaccaccaagcccggctaatttttttgtatttttactagaaatggggttttgccttgttggccaggctggttttgaactcctgactcaggtgatccacccacctctgcctcccaaagttctgggattacaggcgtgagccaccgtgcctggccccacaactttttcctctgtgcttgtatgcaggcaataaaaaaaattaaaatgtattacttgtgtaattaaaaatttttaattaatatagacaatgtaatcacatgaccacaattatattaaaaataatggcaaaacatcatgaacaaaatgtttttgtggttaataatattggttctctttgtgagggcacatcatctttctgtatttttctaatttgctaaaatgaacatgtactacttttataatggtgggtgctttatctttaaaacgtattcactcagtttattactgggctaattacttacatccactataaaatcttcagccttcagtttcacgtctagcaatactttgggtttagcactggcaacctcttttggaagagattcatagtcctcctggaaaacacaagactccccatgttagaatccatttttcatcaagtctttgagccacaaacaggttctctttatgaaaatggcacctaactaagaaaaacgattagagatatccttaacaaatatagctcctaccaatgtcactcgttaaacaaagagagcatttttgtaaaaaattgtaaaaagtggccaggcgcagtggctcacgtctataatcccagcactttgggaggcccaggtgggcggatcatgaggtcgggagttcgagaccagcctgaccgacatggtgaaaccccgtctctactaaaaatacaaaaattagctgggcgtggtggcgggtgcctgtaatcccaactactcgggaggcttaggctggagaattgcttgaatccgggaggtggaggttgcagtgagctgagatcgcgccactgcactctaacctgggtgacagagcgagactctgtctaaaaacaaacaaacaaacaaacaaaattcacattttgaaaaaaaaaaagtgacattaacctattagtacaacaagaggaagtaaagtataacccaagaaattattgaggtaggatgtggttataagtatgacttgtgttacggctttctggcaaacagaaaactcttcaacaagtaggaggtgaaaatagatatttgagctaaagaagacaggtatgtgccatctgggagactgatatcctgtgaaggaaccaagtcattacaacaggtcaccacagcctcaatgaagctcatgcaggcactttcttttgaggttcctttcccttatattcattttctcatgtctgaatctagccaaaattggagacccactctcacttcctggatgagatcaaagatttggagttaagttagacctggcttttgaatcctggctaaatatgctttcatgagcaagttatttaatctcagtgaagcctcagtttctctatctgtaaaacaggcctaagacccctgcactactgtgaagattaaatgagaataaacgtaaagcacttagtacagagtcatagtatcacgataggttagtggtctcctcttggaggacagagataacctttcactaatggaaagatgcctgataactcacccttttaatctttatttgtcctgttggctgcgtctcacccacatacttgaatagattacggtattcaatttgttttaaaatctctcgtgcgtctttcaatttgggatcagtagagtataaaatctccagaaaaatgttatctgccaatttaatgacatttcagttatattaaaataaaaacacagagttaaagaattatatagtgctattctattgaaatgatcttaacaggcagttcgcaaatgtaggtacattattattttagcaatgtgagaaaaatttttaaaagatttaagtgaaaaaaccttttaaaactgttccagtcggccagtcatagtggctcatgcctgcaatcccagcactctgagaggccgaggcgggcggatcacttgaggtaaggagttcaagaccagcctgtccaacatggtgaaatcctgtctctactaacaatacaaaaaaattagctgggtgtagtggcgggcgcctgtaatcccagctactcaggaggctgaggcaggagaattgcttgaccccggaaagtggaggttacggtgagccaagattgtgccattgcactcaagcctgggcaacaagagcgagagactgtctcaaaaaaaaaaaaaagttcctgtcaatgtcttggatttacttccaggtaatccagagagtggggaaggatagagagaaataagactgcattggagttgatgactgctgagctgggtgatgggcacataaaggtgtatggatttattgttgacatgttttattttgtctttaagaaagaatggtggctaggcgctgtggctcacacctgtgatcccagcaatttgggaggccaaggcaggtggatcacctgaggtcaggagcttgagaccagcctggccaacatggcaaaaccctgcctctaccaaaaatacaaaaattagccgggcatggcggtgcatgcctgtggtcccaactactcaggaggttgaggcaggagaatcgcttgaaccctggaggtggaggttgcagtgagccgagatggcgccactgcactcccacctgggtgacagagtgacactatctaaaaaataaaaataataaaaagagaacggtcctgaagtatttacaagcaaaattatgtctaggatctgcttctaaattgtccagtgtttgacaagagtgggtagatgaagcaaaactgccatgtgttgataactgttgaagctaagtgacaggtacatggctttgtaaatttctataataataaaacaatgattttttaatgtcccattcgatgatgagagtagaagaaatgtttttcctttctttcattttctcccaatttttattttgaaaaatttcaaaataaaatatccttcacttaaattcaacaattgttaatgtttttctgcatgcgctttctccatatatatatatctgtgcaatttttttttttttgagacagagtcttgctttgtcacccaagttggagtgcggtggcgtgatcttggctcactgcaacctctacctcctaggttcaagtgattctcgtgcctcagcctcctgagtagctggaactacaggtacatgccaccacacccagctaatttttgtattttcagtagagattgggtttccccatgttggccaggctggtctcgaactcctggcctcaagtgatccacccgcctcagcctcccaaagtgctgggattccaggtatgagccactgcacctggcctttttttttttttttaaggagacaaggtcaggttctgtggcctaggctgaagtgcagtggcgcgatcatagttcactgcagcatcaaagtcctgtgctcaagcaatcctcctgcctcagcccttgagcagctgtgactacagacgtacaccaccatgcctggctaaatttttttttgtttgtttttgagacagggtctcgctctgttgtcaggctggagtgaagtggcacgtgatcatggctcactgcatcctcgacctcctggactcaggcaatcctcacgcctcagcctcctgagtaactgggactataggcacatgccaccatgcccagctaaaccaaaagctagtttaaatgtaaatataatttgaaaaaattaatcttcctgccttagtctcttgaacagctgggactaaaggcacatgccgccacacctggataaagatgactttttttttttttttttttttagacagactcaccctgttacccaggctggagtgcaatggtgcgatctcagctcactgcaacctccgcctcctgggtgcaaatgattctcctgcctcagcctccagagtagctgggattacaggcgccaggctggtctcgaactcctgacctcgtatctgcccacttcggcctcccaaagtgctgggattacaggcgtaagccaccatgcctggctgactttttaaaatatggcatcacttgcattattatgaatgaaaattaaaagtaaatatcttcagcttgttcaattttttttttaacttttattttacttatttatttattttatttttgagaaggagtcttgctctgtcatccaggctggaatacagtgatgccatctcagctaattgcagcctccgcctcctgggttcaattgattctcgtgcctcagtctccgagtagctgggactacaggcacccgccagcacgcccagctaatactttgtatttttagtagagacagggtttcaccatgttggtcaggctggtcttgaactcctgaactcaagtgatccacctgcctcagcctcccaaggtgttgggattataggcgtgagccaccctgcctagccttacatgtatatttttaaagaacaatgtatatagttcttgtaatttaatttttaaattttttctctatcattattattattatttgatacagggtctcgctctgttacccaggctggacttcagtggtgcaatcttggctcactgcaaccccggcctcctgggctccagtgatccccccaacctcagcatcctgagtagctgggactacaggcacgcaccaccagggctaatttttaaattttttagaaacagggtttcaccatgttgcccaggctggtctcaaactcctgggctcaagcgatccaactgccttggtttcccagagtgctgggattataggcacgagccaccttgtctggcctattatttatcttttgattgaatttactgaaaggtgtaatgtgaagtctgtcaagttgaataataaaaatttgggcttgtattttacatgccttttccccccatttcatttttctagtaattcatttttatcatactttacagaaatatcaatctgcaaggggttggtaattttaaaaactggttcttcaaacacagtttaggaggagctagtttaggtttcattctgtcagtgtgcagcaaatagaatccagctgtggtagaacggcagcactctcggcaggaagctacggtagagtgattaggctgtgtcttaggtcacttggcttctgttgtttttctccattttcagagcctccagcctttccacggattctgtaagctatgtgattgctttccaattttatttttatttatttatttatttttatttattcatttttgagacagaatcttgctctgttgcctaggctggagcgcagtggtgcgatctctgctcaccgcaacctctgcctcctgggttcaagcgattctcctgcctcagcctcctgagtagctgagattacaggtgcgtgccaccacgcctggctcatttttgtatttttagtagagacggggttttacaattttggacaggatggtctcgaactcctgacctcaggtaatctgcctgccttggcctcccaaagtgctgggattacaggcgtaagccaccgtgcccggcccaattttatttttagttaaacagtttcataatttgtaactaagaactctgactggtgtacactttttgttctacttcttttgctttatctcagtcaatactttcccacattaaagaaccagctgtggctgggcgcggtggctcacacctgtaatgccagcgctttgggaggccgaggcagatggatcatctgagatcaggagttccagaccagcctggctgacatggtgaaaccccgtctctagtaaaaatacaaaaaaattagctgggcatggtggtgggcgcctgtaatcccagctactcaggaggctgaggcaggagaatcgcttgaactcaggaggcggaggttgcagtgagccgagatcgtgccattgcattacagcctgggctacaagagcaaaactctgtccacccccctccaaaaaaaaaaaaaaaaaaaaaaaagaaccacctttaccctttacctctctttcctcctttccacactaagctgcagattttgtttctgcagaagtgtggacagatgttcctggcatcttgtgtttttataatgaaaataatgttaaatggccaagtcagttttttggtgttcaatattagtccaggtatgagttaaataatgacaagtctgggcaacataatgggaccctgtctctacaaaaattaaaaaaattactcaggtgtggccgggcggtgtctcacgcctgtaatcccagcactttcggaggctgaggcaggcggatcatgaggtcaggagatcgagaccatcctggctaacaaggtgaaaccccatctctactaaaaatacaaaaattagccaggtgtggtggcgggcgcctgtagtcccagctactcgggaggctgaggcaggagaatggtgtgaacccgggaggcagagcttgtagtgagccgagattgtgccactgcactccagcctgggcgacagagcaagactccgtatcaaaaaaaaaaaaaaaaattcccaggtgtggtggcacatgcctatagtcccaagtagccaaatcagctacttggctgaggctgaggcaagaggatcacttgagctccggaggttgaggctgcaataagctgtgatggcaccactgcactccagcctggatgacagaataaaatcttgtctgaaaataaataaataaaaaaaaattaaatttaaaagttaaataatgggccgggcgtagtggctcacgtctgtaatcctagcactctgggagatggaggcgggtggatcacatgaggtcaggagttcgagaagaccctggccaatatggtaaaaccctgtctctactaaaaatacaaaaattagctgggcatggtggggcatgcctataatctcagctacccaggagactgaggcaggagaattgctgaaacccaagaggtggaggttgcagtgagccaagattgtgccagtgcactccagcctaggtgacagagcgagactccatctccaaaaaaaaaaaaaaagttaaataatgtatattgagtacttacgtatcaagtctatactaggtgctatgcctcatttaaacatcacaacaaaactatatgctaggtatcattaccctcattttatagatgaaagattcagataggtcaaatccctttatcaaagtcactttattggtacaagacagaaataaaactcaaattcaaaaggagataattacttgggaagctaaaatcgttccatcggctgtgtacagtgggtcacacctgtaatcctagcactttgggagtcaaggcaggaagatcgcttgagcccaggaatttgagagaagcctgggcaatatagtgagaccctttctttatttttttaaaattaaataattatctttaaaaatgaaaaataaaagaaagaaaaataactcattggcaattcagggacttcttacagtttatctgagatggaccatctatgttacctgttacttcttacctgtcagcttagtataggcttccatgtcgtcaattgctgtagaaatgcgatacttttttcctccagcacctgtaatctctatgtagtcatctgctttgaggaaagcatctgtaatcctaaaaatcattttgcaaaaatttatgtttatgagaaattttgaatatttgccttatgtcttacttaaggaaatctttctactttagggaaacaaaataatgaggcacagtgttctaaagacaactgcttctccaccgtactaaatttgtgcttggtaagctgtgagctgccatgcttactgtgttccaggcactgtcgcagggctttgcattcaccatcttatttattcctcccaacaataaggtaggtgtattcagccctcattttatagatgcagaaatgaagtaaattttgatttaaccaagttaggaagaaacagtgccaggctttgaaactagatatctctgaattacaaaacaacaacaataacaacaacaaaaactcttaccgaagaattaacatacaaataggagaaggtattccaagtaatctgctcatgacaaaggataggtaaaaaataggaatgaagatatacttcctcaacacaaatgtgaaaacgaacatgaaaagttaatcaatttaaggctattttagagacatggaagaagtaacttgactcacacccagtgtttgataactccttatggatctttgagtcacggagagacctggctgtacagttttctgctatggttctgactgggtcaggaagaggtaaaattcctgttggttttaccatttggtactaattttgataaatatttgaaaggatacaaatagacattaatcttaatccttaaagttaacttttgtcattaatctcagaatttaaatattcatgtcctacctcccattctcctgatgagaatggtgtgtaagtgactacctgtgccgaggtcctgagtgatctcagcactgccgcttcacgtctggcctaagccagctcttcttcccttcatctgcccctttatccacttccctccatctgcccctttatccacttccctccttttcctccaactaaattaactttatgctagattttttttctttaaggaaaccattttcaatttaatcacttaatattcacttgaactcatctagaaatgtctagttgagcctagtatgatactctagccaagtatcaaggaaaattttatagggaaatgacaatcaagtttcttacattgtatcaataatgttgccaactttgtgttgataagctctacggtgtaaagagttgcgagtgtggaacatgtcatacagatttccaacttcctgcaggaaaacatgaagtaaatattaataggatcagattatgttaacgttattagagacaagtatataggacaaggaaggaaaagggatagtggcagacaagagggctatgcaccggggcttcttcattaacacctttgaccccactaaaaaatgaggaggcagattagtaaagccatttattggcttgcaactttcattttttttttttttttttttttttttaaaagatgaggtcttgctatgttgctcaggctggtcttaagtgatcttcctacctcagccttgctgggataacatgcatcagccactgtacccagctaactttcattctttgttttttttttttttttttttttttttgagatggagtctcgatctgttgcccaggctggagtacaagtccttcattgcaagaactttcattctttttcttttctttcttcctttttttttttttttgagatggagtctcgctctgttgcccaggctggagtgcagtggcgccatctcggctcactgcaagctttgcctcctgggttcatgccattctcccgcctcagtctcccgagtggctgggactacaggcgcctgccaccaagcccggctaatttttttgtatttttagtagagatggagtttcactgtgttagccaggatggtctcaatctcctgacctcatgatctgcccgcctcggcctcccatagtgctgggattacaggcgtgagccactgtgcccggccaagaactttcattcttaataaactaggccaggtgcgatggctcatgcctgtaaccccagcactttgggaggccgaggtgggcagatcacctgaggtcaggagttcaagaccagcctggccaacatggtgaaaccctgtctctacaaaaatacaaaaattagccgggcatgatggcgggtgcctgtaatcccagctactagggaggctgaggtgggagaatcacttgaacccaggaggcggaggttgcagtgagcggagatcacgccattgcactccagtctgggtgacagagcaagactccaactcaaagaaaaaaaaaaaaaaccctaaaatctatcacatgctcaaactctgtgacagtttccgttttaggcatcttaaattaaatatatatatattttaatcctcccaataactctaggaaataggtattactattcttatgttcttcattcttgacttttttttttttttttagacagtctcgctctgtcacccaggttggaatgcagtggcacacaatcttggctcactgcaacctccacctcccaggttcaaccgattctcgtacctcatcctcctgagtagctgggattacaggtgtatgctaccacgcctggctaatttttgtattttcagtagagacagggtttcactatgttggccaggatggtctcaaactcggtagcccaagagatttgcccacctcagccttgcgaagtagtgggattacagatatgtaccaccacgcctagcccttcttgactttctatagtatagtactatactactttttgattacatgactgccatctaacagggacctagtgatttcagctgtttaactacagttgacctttaacaacacatgtttgaactgtgagagttcacttatacagatttccttgccccgctgccacccctgagacagtaagaccaatccctcctgttcctgagcctacttaatgtgaagacgatgaggatgaagacctttatgatgatctacttccacttaatgaatagtaaatatactttctctgccttatgaatttctttctttctttttttttttgaggtggagccttgctctgccgcccaggctggagtgcagtggcgcaatctcggcttaccacagcctccgcctcccgggttcaagttatttttctgcctcagcctcccaagtagctgggattacaggcactcgccactgcgcccagctaatttttgtattttgagtagagacggagtttcaccatgttgcccaggttggccaggctggtctcgaacttctaacctcaggtgatctgcccaccttggcctcccaaagtgctgggaatacaggtgtgagccaccacgcctggccttgccttatgattttcttaataacattttcttttctctagcttactttattgtaagaatacagtagatggggcgtggcggctcacacatgtaataccagcactttgggaggccaaggaggacaagttgcttgaggtcagaagttcgagaccagcctggggaacatagcgaaaccctgtctctacaaaaaaaaaaatagaaaaattagcccggtatagtggcatgcgcctgtggtcccagctattcgggaagctgaagtgggagatttgcttgagctgggaaggtggaggttgcagtgatctgagatcgcaccactacactccaatctgggtgacagagtaagatcctgtatccaaaaagaaaaaaaagaatatggtatatgatacacgtaacattcaaaataggctggatgcagtggctcacacctataatcatagcactttaggagactgaggtggatgggttgcttgagcccaggagtttgagaccagcctgggcaacacagtgaaactccacctctgtaaaataaatttcagaattagccaagcataggcctgtagtcccagctactcgggaggcagaggaggaaggatcagttgagcccaggaagtcaaggctacaatgcactatgatagtgccactgtactccagcctgagtaacacagcaagaccctgtctggaaagaaaacaaaaaacatacaaaatgtgtgtaactgaccattaaggttatcaataaggcttctggtcaacagaaggctatttagttaagtttttgggaagtcaaaagttatatgcaggccaggtacagtggcttacacctataatgccagcactttgggaggctgaagcgggtggatcacttgaggtgaggagttcgagaccagcctggccaacatggtgaaaccctgtttccactaaaaagacaaaaattagctgggcgtggtagcatgcatctgtaaacctagctagtcacaaggctgaggcagaaaaatcacttgaagccaggaggcagagcttgcagtgagccgagatcatgccactgtaccccagcctaggcaacagtgggagactccatctccaaaaaaaaaaaaaggtaaagaaaagttttatacagattttcaactaggagaggggacagcacccctaaacaccattttgttcaggtgtcaactgtataaaatttttcaacactaatacagtgattaaaaatgagactctgggccaggcaccttggctcatgcctgtaatcccagcactttgggaggccgaggcgggcagatcacgaggtcaagagattgagaccatcctggctaacacggtgaaaccctgtctctactaaaaatacaaaaaaaattagccgggcatagtggcgagtgcctgtagtcccagctactagggaggctgaggcaggagaatggcgtgaacccgggaggcggagcttgcagtgagccgagatcgtgccactgcactccagcctgggtgactgagcgagactccgtctcaaaaaaaaaaagagagagactctggaaccaaactttttgggttgaaattccaactctaccacttgttaattatatgccttctctgtgccttaatttgcttgcctgttgaatggaataatagtatctatctcacagggttatacggaatgagttgatccgtccaaagcacttaaaatgatgcctcatacaagccaggcatgatagtgtgcacctgtagtcccagctacttgggaggctgaggagggaggatcacttgagctcaggagttcaagactagcctgggcaacacagtgagatcctatttcaaaaaaaaaaaatgcaaccaaccaaacaaaaaaaccccaaaaccagtgtctaactcaaaacttaataaatgtccatgttaattttattattatttaataatgcagtagaagggaagagactaaagatatttacaaatcctaggaattaagtaaagagactgacgatttaccaattattccaaattgttaaatggttatttccaaatttcagaccaggaacaacattcttcttattgcctcctctggcacagcttaccttatctctagcacaaatacgcaactcattgtctacttcacagacacgggcaaacttaataaagcgcttgtaatcaaaattattttggattccaagatgatggcagtccctagaaggattccaaaacagagagatgaaatttttcaacaaggaagctgtaccttaaatagtaatactaaatttatataaatattttagccaacttttcagaagtgttcagtgcatacctggcaaaataatcccatttgtccacatcaatgccatttcttttattagatactatctcataaaggaagcttttgttttcaggacgccctttatatggccactggaaggcaagaaaacccactggaagttttaggataggcaccaaatctatttataaacaaagcaaagcaattttattaatctgtaaaatataaacagatacctgactgggaatatgagataaactagaaggttctattctttctttcttccacttcatttcaaaactagtagaaagggaaaagaaatgctaaggtatatgataccctattgttaccacattttcttgtgccactgaaaagatctgaactctattacatttcccaaaaccaacaacttttgtgttttcttggtttataagtttttgaaaaatataaaatctaggccaggcatggtggctcacgcctgtaatctcatcactttgggaggccgaggagggcggatcacgaggtctggagtttgaaaccagcttggccaagatggtgaaaccctgtctctactaaaaacacaaaattagttgggcatggtagcaagtgcctgtactcccagctactcaggaggctgaggcaggagaatcgcctgaactcaggaggcggaggttgcagtgacctgaggttgtgccactgccctctagcctgggcaacagagcaagacaccgtctcaaaaataaataaataaataatataaaatctaataataaactaacaatgcttgaattcatgcattaaaacagtactatctttcaaagtagctacatacctagtctaaataatatgcattgttgaatgtattctttgagctccacttttttggaaataggatatttgctacaaaactcatctgtttatcttatactgtaagtacacttgtatatatttgaggaaacagccctaaaaatctcagggggaaattatttcccaactttatttttaattaaaaaaatacaaaagatcaaaaaggaaacaaaacagattttccattgaactggttcaacttttttgtagatcttcctataaatatttcaaatatgatttttttttaaatttgtagacaggatctagctctgttgcccaggctggagtgcagttgcacaatcacagatcactgcagcctgcctcagcctcccaagcatctgagactacaggcatgagacagggtttcagtattacccaggctgatctcaaactcctgggctcaagtgatcctcccatcatggcctcccaaagtgctgggattacaggcatgagtcactgagcctggccaaatatgttcattttaatggttaaataaaacatacacatttacattccaaacaaagttactttaggcttctatataaaatactgcaggccaggtatggtggctcacgcctgcaatcccagtattttgggaggccaaagtgggagaatcacttgagcccaggagttcgaaaccagcttaggcaacatagtgagaccacatctccaaaaaaaaaaattttttttaatgaataaaatactgcatatatattcactaaaaaagaatttatggccgggcgcggtggcggctcacgcttgtaatcccaccactttgggaggctgaggcgggtggatcacctgaggtcaggagtttgagaccagcctgggcaacatggtgaaaccccgtctctactaaaaatacaaagatttgccgggcgtggtggcacacacctgtaatcccagctactcaggaggctgaagcagaagaattgcttgagcctgggagacagaggttgcactgcgctgagatcatgccactgtactccagcctggccaacacagtaagactctatctcaaaaaaaaaaaaaaaaaaaaaaagaaagaaagaaagaaaagaaaagaatttatgccaagcacagtggctcacacctgtaatcccagcactttcagaggcagagctgggcagatcacttgagctcaggatttcaagactaacctgggcaacgtgacaaaaccccatctctacaaaaaatacaaaaattagctgggcatggtagtgcacgtttgtggtcccagctactcaggaggctgaggtaggaggatcgcttgagcctgggaggtggaagttgcagtgagctgagattgtgccactgcactccagcctgtgtgacagagtaagaccctgtctctaaaaagaatttctgtatatatatttttgggaagtaacttctaactaattcagttgagaggtagaaaaaaatataagccttttattttttgcattaaacagtagaaacatagaactcatattttatcatttagcctctaaaatagccaaatgtataactcagaaggaatcatgaaaaggctagatgaaaagcaccagtcagttaaaattaagctgtacataaacttaccaatgaatcttcgacaggtgattcaagtggtcctacaatttgttcctttataaagcaaatatcttcttcagggatgagaccatattgttccatgacaggcttaattccattagaattaataaggtgctcaaacatcataactgagccttgttcatgctaggaaaagtaagcacaatatgatgtgttaaagattctagcccattgggagccctgactaacaaaattatcctcaattccaagtaattctgagataaaggtctattgcatattaattctctagtttctaaccacaatcttaggaacatttttaaaaacctgtcagatttttcattttactagtagtctacaaaccttttacaaaacttatttcataaacatatttaatgcatttaatgatataatcatttacagttcctaaatgaatattataagatcatgtagacagaattacattttaataaatatcatcataaaattgaattttattttttcatcagcctttgaacacgtgcagttataagctctgttaggcactaccatctagtggtgaaaaggggtaactgcaaacttgccagtaaaaacaaagatctcccttgaaatctccaattggcctgtttgctcatctctctctgctcactcattcacaatcaatgtaaaggatcaaatgaactcctgaagacatctgccctttcctagatcctaccaaaaactaactcaagatgaaaaacaaaacctgaattatcctataactatatttttttaaaaaaagagacagggaattgctctgttgccctggctagagtccagtgatgtgatcatggggtcactgtagtcttgaactcctgggctcaagtgatcctcccacttcagcctcccgagtagctgaaaccacaggtgcacaccaccctacccagctaatttttagatttttttgtagaggcagggtcttgatttgttgaccaggttggtcttgaactcctaggctcaaataatcctcctgtctcagcctcccaaagtggcaggattacaagcaacttgccctataactattctttccccgcccccgcagaaacaattcttgctccagaaactattcttaaaaacagaatcagggctgtcaggcctgggtgcggtggctcacacctgtaatcccagcgttttgggaggccgaggtgggcggatcacttgaggtcaacagtacaagtttggccaacatggcaaaacctcctgtctactaaaaaatacaaaaattagccaggcatggtagggtgcacctataatcccagctacttgggggactgaggcaggacaatcacttgaacccaggaggtggaggttgcagtgagccgagatcgccctgcactccagcctgggtgggcaacaaagtgacactctgtttcaaaagaaaaaaaaaaaaacccacaaaaacagaatcaggctgggtgcagtggctcacatttgtaatcctagcatttttttgagaggcaaaggtgggaggattgcttgagcccaggagttcgagagcagcctgggcaacaaagcaagaccctgtctctacaaaaagataaaaagattggctgggtatagtgacatgcgcctgtggtcccagctacttgggagaccaaggtgggaggattgcttgagcccaggtggttgaggctgcagttagctatgttcatgcctgtactccagcctgggcaacagagcaagaccttgtctccaaaaaacaacaacaacaacaaacaaattggccgggcacagtagctcacgcctgtaatcccagcactttaggaggcggaggcaggcagatcacgaggtcaggagatcaagatcatactggccaacatggtgacaccccatctctactaaaaatataaaaattagctgggtgtggtggcatgcacctgtagtcccagctactcaggaggctgaagcaggagaaacgcttgaactcgggaggcggaggttgcagtgagccgagatcacgccactgcactacaggctgggcgacacagcgagactctgtctcaaaaaaaaaaaaaaaaaaaacgaattgaatcaagatatacgtaattacaaagaggaaaaatagtaactttataatggagagatttgacagacaatgccttaatcaagtaagcagaattaatatcattggtattggctcaactaggatttatgtgcctcctgagatgatacactatgaaggatgcatcactgatttttttggagacagagtctagctctgtcacctcctgggctcccgggctcaagcaattctccttcctcagcctcccaagtaggcacgtgccaccacacccagctaattttttgtggttgttttttttttttttccctcttgttgcccaggctggagtgaaatggcgtgatcttggctcactgcaacctccgcctcccaggttcaggtgattctcctgcctcagcctcccgagtagctgggattacaggtgcccaccaccatgcccagataatttttatatttttagtagagacagggtttcgccatattggccaggctggtctccaacttctgacctcaggtaatccacccaccttggcctcccaaagtgctgggattacagatgtgagccactgcgtccgatctggacacatcacttttgtggcattctaccaaaaatgcatagcttgaatccatgaggaaacatcacactgaaactcaaattgaggaacattccacaaaatagctcagttgctctttaaaaaaatgacaaagtcactaacgataaagactgaagaattgctccagatcaaaagaaactagaaaaatggcaactaaatgcaatgtgtaattctggaccagggaaaaaaagtttttttcccctttttctatatggacaattggtaaaatttgaaagtctgaattagataagagtactgcatcaacattaatttactgattttgataattatactatggttatataagaaaatgttgtttttaggaaatacccactgaagtatttagaaataaagtatttcaacaatttacattctttgagagacagggctcttgctctatcacccaggctggagctcagtggcatattcatagctcagtgtatccctgaactcctggattcaagtaatcctcccgttctcagtagctaggaccacaggtgtgcaccacaatgaccagctgatgttttcataattttgtagagacagtttcactatgttgcccaggctggtgttgaactcctgggctcaaagctatcctcctgccttagcctcccaaactgttgggattacaggtgtaagccactgtgtccagtctaaaaactaactttctttttttgagacaagttctcactctgttacctacgttggagtgcagtagcacgatcacagctcattgcagcctcgacctcccaggctcaagcaatcctgccaccccaccatgcctggctaatttttaaatttttttgtagagacggggtttcaccatgttgtccaggctggtcttgaactcctgggctcaagcgatctgcccaccttggcctcccaaaatgttgatattacaaccatgagccactgtgcctggtcaaaacttactttctaatgattcagaaaaaaaatatctatatataaagagagagtattttatttattttttgacacagtgtctcactctgtcacccaggctggagtgcagtggcgtgatttcagctcactgcaagctccgcctcctgggttcacgccattctcctgcctcagcctcctgagtagctgggactacaggtgcctgccaccacacccagccaatttttttgtatttttagtagagacgggatttcaccgttagccaggatggtctcaatcttctgaccttgtgatccgcccaccttggcctcccaaagtgctcagattacaggcgcgagccaccacgcctggccaagagagagtattttaaaaaataaaaatgaggtggatcacttgaccctgggaggcagaggttgcagtgagcttagatgacatcactgagctcctgcccgggtgacagggcaagaccctctctcaaaaacaataaaataaaaataaataaataaataaataaagtaagggattttcaaaatagtagttttaaatatatcaatgccaactgtgaatatactagcaaacagaaaaaattaagtttcataaagctagcacagaccataataacaactaaaattataaggaacttaggagtaagtataacaaagatgtatgactttcatggcaagcctaggcaacatagtaagactccatctctacaaataaatacccaggtgtgacggtgcaggcctgtggccccagctacttgggaggctgagatggaaggatcgcttgagtctggaggtcaagaccagcctgggcaacatagtaagactctgttctccacagaaaggaaaaaataaaaacataaatcttattataaagtatgtcaacctaaaaggaaggagctgagaaatatttaatatagagagtttatttgggccaaggttgaggacacatttacaaattgccttggggaatgcttggggagaacaaaagaggctcaagtttttaaacaaaaaaggactggccaggtgtggtggcttaggcctgtaatctcagcactttaggaggccaagcggggcagatagcttgagctcgggagttgagaccagtctgggtaacaaagtgaggcccactccctctacaaaaaatataaaaaattagctgggcatggtagtgtgtgcctgtagtcccagctactctggaggatgaagtgggagaattgcttgagccttggaagtcgaggttgcagtaagccatgtttgcaccactgcactccaccctgggtgacaaagcaagatcctgttgaggggaggggaggggaaaggagggaagggggaaggggaaagaaaaggaagggaaagaagggaaggaagggaaagaaaggaaggaaaggaaggaaggaagggaaaaagagaaagaatgagaaagaaagaaagtgagaaagagaaaaagagagacagagacagaagggagagaaaagaaaaaaaaagaaaagagcataaatcaggaggaggaggtgatcacaaagaggaggtgataacaaaagttgttagtcaggaatgttcactggcttacagaaataacattagttagtgattggctacatattatgaagtacaggatatatggcattttatggttacctggcatcccacataacagctggcttcaagagataataattatttagctcaagggggcgtgacatgattgctgttctatttcaatgcctctctgggcctgataatgtaaaggggctcatatttctcagataaaaatttcttttcttctttttttttcttccccaagtaacaagtgtggaaacagaacagaatgcagaatgattcatcatatatgggaagttaataaatgttggggttggtattacagtcagtggggataggatgaactattaaaaaattagatttctcggccgggcacggtggctcacgtctgtaatcccagcgctttgggaggccgatgtgggtggatcatgagatcaggagttcgagaccagcctaaccaacatggtgaaagccatctctactaaaaatacaaaagtcagccaggtgtggtagcacatgcctgtaatcccagctattcaggaggctgaggcaggagactcgcttgaacccaggaggtggaggttgcagtgagccaagatcgcaccactgcactccagcctgggcaacagagtgagactccatctcaaaaaaaaaaaaaaagaaaaaaaaagatttctcccatatacttacacaaaaataaattgtacacgagctaaggatttaaatgtgaaaggcaaaatgcttaaaggaatagatttggtaatgattgagaagatcctattagatcaactgcagaagaaaacaactataagctctggacaactccctgaaggtcctggagagagaccaaaaccaagtggatgttagacctcaatacttagaagggagaggtgctgggtgacattccggttttatggttttttgcctaagggcaggccccaggacagaaaaactggtgagaaactacccattttactggcttgcagaaccagagtacttcatcaaaattgaaaacgtctgtttttcaaaaggcaccatgaaaaaatgaattggccaagccagacactggggaaaaatattcacaatacatatacctaaccatatatatacataaagaattcctacaactcagtaatcaaagagcaagcaatcaaactttttaaacgagtaaaatgttgagagttctttgcagaagaagatatatcaataacaaagtacaaagtacaggaaatagtattcaacatacattagaaaatcaaaccatgaaataccatttgacactcattagaagggctaatttgaaaggtcaaatgttgatgaggctgtaaaacaactggaactccagtatgttgctgatgggagtgtaaaatggtacaaccgcattggaaaactctggtagtttcttatagaattaaatacatatctaccatatgacccagcaattctagctcctcggtatttacctaagtgaaatgaaaatgtatttctttattttatctatttttatttttataaaataatgtatttctgctgaatgtatttcttgttttaaaaatgtaattaactttccacactacaacaacatagaaaatgtatttctaccaaaatcttgtacgataatatgcacgacaaccttatttataacaaccaaaacctgaaaacaatccaaattccaacaaaacaagaaagggtaaacaaattgtgacttatttgcataatgccacactacgtaggcgataaaaaaaaggatcaactactgaggcacataacatgaacaaatctcaaaaccattatgttgagtaaataaagcaaggcataaaataggacctcctatatgattctgcttaatcaagtctaagaacaacaaaattcatttatgtttgtaaaaatcagaaggtgatggtggggtgagggggagtgagaattgactaggaaaaagcacatgggaatttttcaggaagatgaaaatgttctatatcctgactgggtaatagtcatatggatgtatacgcctgtcaaaactcactgaacttaagatctggacaacttattgtatgtgaactatacctcaaaaaaagagagagagaaaaaaaaagtggttgacatgtaagaagttttcaatatatattaatatcctttttctattcccgttccagaaatacagtgtagtaaaaaccaacctaattttacttctcaaaaattgattccaaaatatgggacagccacctgcaaatgcctaattttaaaatgattcatttaatatatatgacttggctggtaagttagttcgtggtcataccaaatgtgtcaaaactggagttggccttttattatacagtagtacaatggagcagaaggagtattaaactggcaactggttttgtattgctgattccagtatttaacggctttgtgatttttgatgcatcaatacacatccaagagtttcaagttcctttatttgtaaaaagggagataacgataacttccttacagactactgtgagaaccaaacaaaagcatatatatatatatgtgaatgaaagcaccctggacactgtaatggggaagtattttataacacagtagtggaaccaaacagataaattaactaaataacctgcttaaatagtctttctttttattgactattgactgtatgaatacataccgtccatttcacctccgggcgagcaagtggaataaatcgtccatcaaacatgtgagaaaatggcccatgaccttaaaaacaaaagcagccttagaacaagaaaaacatctgtaaaccaacaaaaactttttccttttttttttttttttttttgagacggagtttcgctcttgttgcccaggctggagtgtagtggtacaatcttggctcaacacaatctccgccccctgggttcaagcgattctcctgcctcaggctaccgagtagctgggattacaggcgtgtgcaaccacatccagctaattttgtatttttagtagagatggagtttctctacgttggtcaggctggtctcgaactcccgacctcaggtgatccgcccgtctcagcctcccaaagtgctgggattacaggcgtgagccaccacactcagccaaactgaattctttaatctttttagtttaacttgaatagcaaaagaaattaataatctaaaaatacaatcacaaaaagggacaaaccctttcttcctatttctaaaacaggagaacaggaagcagaaacatggaaaagtaagctctccatcgagcagtctccagtcaccaggttttacataaatctgataaaagggcagtttttgttgttttttgaagagacagagtcttgctatgttgttcaggctggagtgcagtggctattcacaagcatgatcattatgcactgcagccttggactcctgacctcaagtcatcctcctgcctcagccacctgaatagctgggactacaagcatgcaccaccacacagggcttgataaatggacaattctgtgtaactaaaaagaatgttaatgccaaaaactttttgaaatcttcagattgaaaatatctggattaaaatagcagtttcaagaaaatccactagggccaggtgtggtggctcatgcctgtaatcccagcactttgggaggctgaggtgggtggatcactttgagtcaggagttcgagaccagcccggccaacatggtaaaaaccctgtctctactaaaaatacaaaaaattagccgggcttggtggcgggcacctgtagtcccagctactcgggaggctgagacaggagaatggcgtgaacctgggaagcggagcttgcagtgagccaagatcacaccactacaccccagcctgggtgacagagcaagactccatctcaaaagaaaaaaaaaggggctgggcgcggtggctcatgcctgtaatcccagcactttgggaggccgaggcgggtagatcacgaggtcaggagttcaagacaagcctggctaagatggtgaaaccctgtttctactaaaaatacaaaaattaggcgggtgtggtggcaggcgcctgtaatactacctactcaggaggctgaggcaggagaatcgcttgaacccgggaggcggaggttgcagtgagccgagattgcgccactgcactccagcctgggcaacagagcgagattctgtctcgggaaaaaaaaaaaagaaaatccactggggtgcaggaagaaaaaattagaatttctcttataactctcaagcttaaaaaaatctatctttggccgggtgtggtggctcatgcctgtaatctcagcactttgggaggctgaggcgggtggatcacctgaggtcaggagtttgagaccagcctgaccaatatggtgaaacctcatctctactaaaactataataattagctgggcatggtggcatgtgcctgtagtcccagctacttgggaggctgaggcaggagaatggcttgaacctgggaggtggaggttgtggtgagccaagatcgtaccattgcactccagcctgggcaacagagcgagactccatctgaaaaaaaaaaaaaaagaagtgagccacttaactggagagggaagtctacctagactagccttggccctgctttgcaagtcacaggctacacataaaggctcgctaatgcagtgctcaggctcctggggactggcaaaggtttcccaatgattctccctcaaaataccaagaatccatcaaatttatcatctaggggctggtattggttctttgtaagtctccgggggacataaaaagagtgcctacttgctttaagtatctggctatccaaacagtggcatgcacctcccttcccctgccctgagggtacacacaaactctcagagtccctgaataagtaggaataaactataaggatagaggtaaaaacccccatgatttaaaaggaacagtcccggcccaacgtggtgacttatgcctgtattcccaacactttgggaggccaagggaggtgaatcacttgaggtcaggagttcgagaccagtttcaacaacatgatgaaactgcatctctactaaaaatagaaaaaaattagccaggcgctactcgggaggctgaggcagaagaatcacttgaacccaggaggcggaggttgcagtgagccaagatagtgccaactgcactccaatctgtgtgacagagcaagactccatctcaaaaataaaaaaataaatgggacagtcccctttctctttgtcacaggaaaaggattatattcttttgcttggattaaagtggcctaagacctcacatggatcagaaaagacaaggagttctctaaatgtgttaatccacttgggcagattagagattataaatatgaaaaaaaatggatttcaccaaataaccgaaggaaaaatggtgattttatttgataagaaggacaaggccaggcgcggtggcttacacctgtaatcccagctctcagggaggagaggcgggaggatagcttgagcctaggagttcgagacctgcctgggcaatatagcgagatcctgttctccacaaaaaggaagaaaaaaaaagaccaaaaaaaaaaaaaaaaataagcataagaaggataaaagaaaaataaaattcacatatcatcctaaaagcagtagtaagaaaaactcactagcaaaaagccctttcatataacctgtagtaaacatgatggccgggcacggtggctcatgcctgtaatcccagcactttgggaggctgaggctggtggatcacctgaggtcaggagttcgagaccagcctggccaacatggtgaaaccccgtctctgctaaaaatacaaaaattagctggatatggtggtgcatgcctgtaatcccagctactcgggaggctgaggcacgagaattgcttgaaaccaggaagcggaggttgcagtgaaccgataatgagccactcactccagcgtgggcaacagagcaaaactctgtctcaaaaaaaaaacaacaacaaaaaaaccactttagcaaagatgtttaacatgagaaattcactgaaagttgccaagaaaataaaatagcaatgttttctacttatgaatcattctaggaagaagcaacagtacatttatactaacatcaactgaagaattaaaatacaatttccatattctcttggttgatctgattttttaacgtcaaagagaggtaacatatgttatgattttacataacaactttgtctctttgtacagcttaccgagatcatgacaaagtccagcaatctgaacacagagaacatctcgttcacttatctgcagctctggttgtttttcacccagtgcgtgaactagacatcctgctagataccccaccctgcagagcaaaaacacaaaaagtcacttttctgtttgcaagaggagtgatagttctggtcctcaagaacttcagtatgtttccttaaacattctaacatacctttagggcaactttactgaacagtatatttcagaactaggcaggaacacacacaaacggaatcccaaaagcaggacctctggctcaatatcaccaatcattagaggaatgcacatcaaaaccacagtgagataccacttcacaccccttaggatagctactattaaaaaaagaaaaccagaaaataacaagtgttggacatgatgtgaagaagttggaagcctgtgcactgttagtggggatgtattatggtgtagctgccatggaaaacagtatgggtgctccacaaaaattaaaaacggaattaccacagtgatttagcaatttcacttctgggtatacacccacaataacgaaagtaggtcttgaaaagattggctgggctcaggggctcacgcctgtaatcccagcactttgggaggctgaggcgggcagatcacttgaggtcaggggttcgagaccagcctggccaacatgttgaagccccatctctactaaaaaatacaaaaattagctcagcatggtggcaggtacctgtaatcccagctatttgggaggctgaggcaggagaattgcttgaacccaagaggtacaggttgcagtgagccgagatcttgccattgcactccagcctgggcaacagagcaagattccgtccccaccaccctccccccaaaaaaagaaagagaatatatttgtacagacatgttcatagcagcactactcaaaatagccaagaggtaaaagcaacaggtatccatcaacaaatgaatgtataaacaaaatgtggtagatacatatgataaaatattattcaaccttaaaaaggaaataaaaaataatttaaaaataaaaaataaaaaataaaaaaggaaagaaatactgacacatgctacaacatagatgaactttgaggaaattatgctaagtgaaataagccagtgacaaaaagacaaatattatatgatttcactaagatgaggtacctagagtagccaaattcataaacaaaaaaaagagggccgggtgcggtggcttatgcctgtaatcccagcactttgggaggctgaggtgggcagatcacctgaggtcgggagttcaagaacagcctggccaatgtggtgaaactccatctctactaaaaatacaaaattagctgggcgtggtggcaggtgccagctacttggaaggctgtaatcccagctacttggaaggctgaggcagctacttggaaggctgcttggaaggctgtaatcccagctacttggaaggctgaggcaggagaatcacttgaaccgaggaggcggaggttgtggtgagccgagattgcgccattgcactccagcctgggcaacaagagcgaaactccgtctccaaaaaaaaaaaaaaaaaaaaagtagaatggtagttactagggggttgcggggggttgcggggggagacatgaagagttgtttaatacgtatacagtttcgtgtttttttttttttttttttgagatggagtctcgctgtgttgcccaggctggagtgcactggcctgatctcagctcactgcaacctcaggagtagctgggattacaggtacactccaccatgcccggctggttttgtatttttagtagagacggggtttcgccatgttgcccaggctgatcttgaactcctgacctcaggtgatccactggcctcagcctcccaaagtgctgggattccaggtgtgagccactgcacccggcaagtttggttttgtaagatgataagagttttggcaagtttggttttgtaagatgataagagttttggcaagtttggttttgtaagatgataagagttttggcaatcgattggttgcacaatgtgaatgcatttaaccctactaaactgtacacttaaaaaacacttaagactatgtattttctattctgtgtattttaccacagtttttttttaaagtaggaatatctggctttgtaatgtttacaacataattggagatgaagtacttaaatgcacttccagcacttccatctgagccattcctaaattcttttcccctgaactctgagctacatgaggacagaggcgattgttatctttttgtggtttggtagggcttagtaaggttcgataaatatttgttgatgaatgaacatttgagtatagacacatgttgtgcctaactaaaaatgcttctacacaaacagaaaaccaaagtaatatactgtgagtacttcatgaaaatctcaaagactgtctattcttccctgtccacttcctcctggctctacactgcataatggaaatgcagaccaacgtctcagcttagttgtatgtaacagaggcatcgccttctctaagattatgaatgcttttttaacttacgcatttcctgacaggtaagaaaatgatctggtttgaaagagcaactctgtaccagagtaaatagagaatacagaaaaattaaataatcaaatatacataattagttgtatcagcaaccgacccattagcttttatttatttatttatttattttgagactgattctcactctgtcacccaggctggagtgcaatggtgctatctcagttcactgcaaccttggcctcccgggttcaagctattctcctgcctcagcctcccaagtagctgcagcgtgcgccaccacgccttgctaatttttgtatttttactagagacggggtttcaccatgttgctcaggctggtctcgaactcatgatctcaagtgatccgcctgccccggcctcccaaagtgctgagattggccgggcacggtggctcatgcctgtaatctcagcattttgagaggccgaggcgggcggatcacgaggtcaagaaatcaagaccaccctggccaacgtggtgaaaccctgtctctactaaaaaatacaaaaattagccaggcgtggtggtgggcacctgtaatcccagctacttgggagactgaggcaggagaatcacttgaaccctggaggcagaggttgcagtgagctgagatcgtgccattgcactccagcctgggcgacggagtgagactccatctcaaaaaaaaaaaaagtgctgggattacaggtgtgagccaccacacccagcccctgttagcttttaattaatatttaaaaacaaatccaactgacctgtctatagatactttcattatttttccaggaaagatctgaggtggttaagaatacataaaataaataaattgcaacaaggtaaataaaaagcctcaattttggggctgggcacagtggctcatacctgtaatcccagtactttgggaggccgaggcaggtggctcacaaggtcaggagatcaagaccagcctggccaagatggtgaaaccccgtctctactaaaattactaaaattagccgggtgtggtggtgggcgcctgtaatcccagctgctcaggaggctgaggtacagaactgcttgaacctgggaggtcgaagttgcagtgagccaagattacgccactgcactccagcctagtgaaagagactctgtctcaaaaaaaaaaaaaaaaaaaaaaaaaaagcctcaattttctcatcaataaaataaggacattatcatcattttgtaaaactatttattctctaaaagattaagacaactatttcttttttttcctgttttctttttctttctttttttttttttttttgagatggggttttgctcttgttgcctaggctggagtgcgatggtgcaatctcagctcactgcaaccaccaacctcctgggttcaagtgatcctcctgcctcagcctcctgagtagctaggattacaggtgcgcacaatcatgtctggctaattttgtatttgtagtaaagatggggtttcacaatgttggccaggctggtcttgaactcctgacctcatgtgatccacccacctctgcctcccaaagtgctgggattataggtgtgagccaccatgcctggcctaagataactatttcatgagacagagaaaatacttaaaaactgcaagttccccaccccattcccttcttaccctagactatgctcaaatcgattgtgtgaagctcctggaaaaacatagtaaccacctcccagctgtttgatgtatcgaagacgttgaaattgaggtgtatcaatgattcggacgaggagagggtggagctcaatgtggccatggataggatcattaattacctagaaaattatgtttaattaatacaaataacgacatgtaagtccaactgaaatttgtgtgcagccattcctaattatagtgcaaagtcaaagctatttgatttttcaagtaaaaatactaacggaaatgacaagatgttaacatcattaccttatttaggtatcactaccagacagatcaagtatattggatttgagtatattttacttcttcctaatggatgtgaataacagaaaaataaggattttgattttttattatgtatatgacttagtctttaataagtttgtcttgtattcaagttaaacatgcatattcatttcgatttaaacacattcatccacatcatgtaacccatatcactataggtattatgtctaatttttttttttttttttgagacagagtctcactgtgttacccaggctggagtgcagtggcacgatctcagctcactgcaacctctgcctcccaagttcaagctattctcctgcctcagcctcctgagtagctgggactacaggggtgtgccactatgcccagctaatttttgtattttgagtagagatggggtttcactatgttggccaggctggccgcgaactcctgacctcaagtgatccgcccacctcggcctcccaaagtgttgggattacaggcgtgagccaccgtgcccggcctaaatttttttttttctaaatgtatctatacagcactcatcattaaaacagaaaagaaagaagggaggcagggaaagaaagaaagatggaaattcctctaccatatagataagaaatcatgcaggtccgagtgcaggtgctcacatctgtaatcccagcactttgggaggccaagagtttgagactagtctaggcaacatagtgagaccccatctttaaaaacaaaaatgcagtggcgcacatctgtagtcccgggtactctagaggctgaggtaggaagatcccttgagccccaggggatcaaggctgcagtaacctactattgtgccacaacacttcagcctgggcgacagagagaaactctgtctcaaaaaaagaagaaaaaaagcaagaaaataattttgtacagctgaacaatgtgtttatgtgtgtgtgttctttttgttttgtttttcttagagatagggtctcgctttctcaccaggctgcagtgcgttggctattcacaggcacaatcatagcttactgtagcctcaaactcctaggctccagggatcctcctgcctcagcctcccaaatagctgggactacaggcatgtaccaccattcctagctaatttatttttattctttgtggagacaaagtcttgctatattgcccaggctgacctcgtgtccgcccgcctcagcctcccgaagtgctggaattacaggcatgagccaccgcgcctggctaaaatctacttttaaaccatttaaggacctaaaagccttcactgtaaatttttcaggttgtaataactgtcttttttgtttgtttgttttttgagacagagtctagctctatcacataagctggagtacaatcagggctcattgtaacctctgcctcccaagttcaagcgatcctcccacctcagcctcccaagtagctggaactataccacgcctggctaatttttctttttttggtagagatggggtttctggcagggcatggtggctcatgcttgtaatgccagcactttgggaggccaaggcgggtggatcacctgagatcaggagttcacgaccagcctgaccaacatgatgaaatcccgtctctactaaaaatacaaaaattagctgggcgtggtggtgggcgtctgttatcccagctactcaggaggctgaggcaggagaatcgcttgaacccaggaggcaaaggttgcagtgagctgagattgtgccactgcactccagcttgggcaacagagtgagactctatctcaaaaaaaaaaaaaaaaaagattcattgatacatttgaaaaattagtcctcattatgtcaaacactgcactccctcttcaccattacacaatctcagcttcagaggccaactgaactaaatttagcataaagaacactgtgtcaagaacaaaccatggtgaccttgggttcggcaatggtttcttaaatatgacactaaaagtacaagacacaaatgaacaaaaaaaatataaattggattacataaaaacttaaaacttttgtgatccaaagaacaccatcaaaaaagtaaaaagacaacccacagactgggaaaaaatatttgtgtatcatatctcccataaggatttacatccagaacatataaagagctcttacaactcaaatcaaattgtgtgtgattgaacaacactgtgaactttctaaaaagcactgtcttgcatactaaaaatgagtgaatcatacaacttgtgaattatatctcaataaagcatttatgttttaagtatcaagttaggtaggtatgaaattagggtagaaatccttgaggtctgcaactgagtagcaaactaggtcaattcttgttgaactgcattgctgatgaagttaaattcatttaaggtattgatttcattactaagccgtgattcagtagtttgaaaatctatttccaacaactgtcatttataatttataaatgaggttaaacaatgttggtttgtttttttttttttttgagacagggtctcactctgttgcccaggctggagtgcagcggcgtgatcatggctcactgaagcctccacctccccaggttcaggtgattttcctatatcagcttcccaagtagctgggactacaggtgtgcactaccacacccagctaatttttctattgttttctattgtttgtagatggagtttcaccatgttgcccaggctggtctttgaacttaagggctcaagtgatccacctacctcagtctcccaaagtgctgggattacgggtgtgagccaccatacccagccaacaatgttctttttacagaaaaatagaaagaataaaagtgggcaattgaaaccactgactgccttaaatattacctcaaaaatatattattggctgggcacggtggctcatgcctgtaatcccaaaactttggaaggccgaggcaggcagatcacgaggtcaggagttcgaggccagcctggccaacatggtgaaaccccgtctctactaaaaatacaaaaattagccgggtgtggtggcatgcactggtaatcccagctactcaggaggctgaggcaggagaattgcttgaacccgggaggcggaggttgcagtgagctgagatcacgccactgcactccagcctgggcaaccgagtgaaactccctctcaaaacaacaaaacagggacaggcacggtggcacgtgcctgtaatcccagcactttgagaggctgaggcgggtggattatgaggtcaggagatcgagaccatcctagctaacgcggtgaaaccccatctctactaaaaatacaaaaaattagctgggcatggtggcatgcgcctgtagtcccagctactcaggaagctgatttaggctgaggcaggagaatcacttgaacctgggatttggaagttgcagtgagccgagattgcaccactgcactccagcctgggagacagagcaagactccatctcaaaaacaaaacaaaacaaaacaacaacaaaacattattatatagttgaaccaaaaatgttcattaaattttttcagatgtgattttcaatagaaaataagcctagaacgggctggtggctcacgcctgtaatcccagcactttgggaggccaaggtgggcagatcatgaggtcaggagttcaagaccagcctggccaacctggtgaaaccttgcctctactaaaaataccaaaaaaaaaaaaaaaaaaaaaaaaaaaaattaactgggcgtggtggcaggtgcctgtaatcccagctactcaggaggctgaggcaggagaactgcttgaatctgggaggcagaggttgcagtgagctgataccatgccactgcactccagcctgggcaacagagcgagactccctctcaaaaaaaaaaaaaaaaaaaaaaaaaagaaaagaaaagaaaaagaaaataaccgggtaggccagacgtgttggctcatgcctgtaatcccaacactttgggaggccaaggcagacggatcacatgaggtcaggagttcgagaccagcctgaccaatatggcggaaccctgtctttactaaaaaaaatacaaaaactagctgggcatggtggtgtgcacctgtagtcccagctacctgggaggctgagacaaaagaatcacttgaaactgggaggcagaggttgcagtaagccagattgtgccactgcactccagcctagacaacagagcaagactccatctcaaaaaaagaaagaaagaaaagaagtctataacttgcaaaagcaaaattaaaatatgtattcttatagagagggatctgaaataactcaaatactatacattacatctattttttaaaaaaagtgaaaaatgcaaatgatgatcgggcaaaaaagtacaaaaaaagaagatatcctacatcttctcccaggtctgaaactaagttttcttaacctaggaatgtcaaaagagtaaataaggtctatttcctgtcactaacaaaacaagaaacatttcatcaagtatggttttagaatcactctgaagagcttgtgaaaaatgcacattctggctgggcgcagtggctcatgcctgtagtcccagcactttggcaggacgaggtgggtggatcacttgaggtcaggagtttgacaccagcctggccaacatgatgaaaccccaactctactaaaaatgcaaaaacattagccgggtgtggtggtgtatgcctgtaatcccagctacttgggaggctgaggcaggagaatcacttgatcctgagaggcagaggttgcagtgagacaagatagtgccactgagccccaacctgggtgacagagagagattacatctcaaaaagaggaaaaaaaaaaaaaaaaggccaggctctgtctcaaaaaaataaagtttaaaaatatgtaaaacaatactatacattgtttatggatatacataaatatgcaataagagtaaaaaccattcatgacaatgataaacatcaaattcaggaagatgcttattacttctagggagaaaaggatagaaacataataaatagaaacagggccaggcgtgggggctcacatctgtaatcttagcactttgggaggccaaggcaggtcaatctcttgagcccaggagtttgagaccagcctgagcaacacaggaagaccccgtctttataaaaaatacaaaaattagccaggtgtggtggcatgcacccatagtccaagctactggggtggctgagatggaaggatcacttgagccagggagacggaggttggagtgagctgagattgcaccactgtactccagcctagatgacagagcaagaccacatttcattaaaaaaaaaagaatgtacaaaggaggtcttcaatagtttctaatattttgctctaaaaataacagacttgaagcaaattaggcaaaatattaatatttgacaagttgggtagtggtctacttatgcttttctgtatgcttaaacatattttagttcttcttctgatttaaatactctgtgctcattttagaaagtgcagaaagtttagaaaagatccactactcacaattctatcactgagaagcagatttcctcctattctcttcaaaatgaattttacataattgagttatatcactttatattcaaaaaacataacaaactcagatcctcttaccttcattgtatcaacgtggatttgaaccaatcgctggatataactaagcagcttcttcctctcccccaaggaactaaaattacaataggataagcaagtctatcattatttgcttaataataatccctgcagtatatagtagacataataaactttatattatctacactaacagaagttagattggaaggaacaatcaataattcaaacatacccctcctagaaactctctccttcctttgctgttaagatagggaactctcctgctgaatcaatataggcctcccacagccttctgtccttgaccctcctctctcttggtaaatttaagacttgaaaaactccacatctccatgtctactcaatgctcaaactgtacttccttttaaccaaactgaagtcaacatctaccctcataatcctggattgatttatgagcaccaggtatgactcaagcatgaatgaaatacatatgaaggctttaactttatttatattcattttccattgtcagtactccctcacaatgctccagtttcaagaaaatacataatgggaattaaatttgagcagctcgaagtcctgtgattcattatcctgcttcatttacaattactagttgggcccagcatatcatcctccctcctggctgggtgtcaacagagagtgcaggcaaagggttttactgatctactagataaccagattgaaaaaaaagtatctttctacaagtcatacatagactgggagtcagaggcactacattggcctctatggtacacactgaacccatggtaataagaacacttaagaataatatcttgggatacacagaagcattattacagctgataaattaaagcagcaaatttcgtgttttcctattcccctatcctcctcatcagtttgacataacaagcacagtgtaaagccaggctttcagaagtacttataggtggacttagtttaaggggagtcacatagttgagcaaaaccggagtcatagcataaaatatcaaacctaaactaaccccgtgaccacttaatattttcctaaactgacatttggtattcatcgcttaaaaccccaaaatcggccgggcgcagtggctcacacctgtaatcccagcactttgggaggccgaggtgggtggatcacctgaggttgggagctcgagacaagcctgactaacatggagaaaccccgtctcttctaaaaatacaaaattagccaggcgtggtggtggcgcatgcctgtaatcccagctactcgggaggctgaggcaggagaattgcttgaacccgggaggcggagattgcggtgagccgagatggcgccattgcactccagcctgggcaacaagagcaaaactccaactcaaaaacaaaacaaaacaaaaccaaaatcactgattagagtatataaaaccacccaaaaccagggggttgttttgtttagcaaaggacatggcattaaataaagatttaaagaagtcatgggccaggatatctagattatgaaagaattttattcctgtgttccaacatttctgaaatttaatgcttcttacaattgacatgtatatttaacgtgacaatgtttctatctaacttctttttttttttgaaatggagtcttactctgttgcccaggctggagtgcagtgacgtgatctcggctcactgcaagctccacctcccgggttcacgccattctcccgcctcagcctcccgagtagctgggactacagccgcccgccaccatgcccagctaatttcttttttgtttttgtatttttagtagagacagggtttcaccatgttagccaggatggtctcgatctcctgacctcgtgatccgcccgcctcggcctcccaaagtgctgggattaaaggcctgagccaccacgcctggcctgtttcttacttgttaaaaaaacctttataaatcaatggttgttcataaaattgagggcctactaggagtgcttgtctaagctggattctccctagaaagcagggtccaggataagagcttgcaagtaattaatcttggggtgaactctgggcacagggattggggggtctagggagggtaaaataggaaattaggtaaaaacagtacaaaggtccattaacaagttgattgcattggtactactgtgagcaactggatggagtggtgggtagggctaatcccactggcaacctgtaaggcagcactgtctagtagaactttctgcgatgatggaaatgttctatatctgctctgtccaacacagtagccgttagccatagtgactactaagtacttgaaatatggctagtgtaactgaggaattttttacttaatttacttctaattaatttaaacgtgaagctagttgttattatacagaacaatacagctctaaggagtcctacagaatttgagttatgaggtggggcacagagacgtgcaatatagtgttccttctggaacactgcaatatagtgttcctttgtctgttttgttcactcatgtgccccaaattcatggaagaattcctagtacatagtgagctttccaaaaatattcactgaatgaatcaatagcacttgggtccacaaacatgcacatggctcccttgaaaagaaagactgtattagaacaaattccattcaggtcaaatagtaagcaactattatgtacaagaaacaagtagtaaaggggactttgagaggactgagagggctgaaatgtggttatgaaagagtcatgccggggacagtggctcacgcctgtaatcccagcactttgggaggctgaggcaggcagatcatgaggtcgggagttcaagaccaccctggccaacatagtgaaaccctgtctctactaaaaatacaaaaattagccgggcatggtggcacacacctgtagtcccagctactcaggaggctgaggtggtagaatcacttgaatctgggaggtggaggttgcagtgagccgagatcacgccactgccctccagcctgagtgacagagcaagactccatctcaaaaaaaaaaaaaaaaaaaagaactttgggaggcctgaggcgggcagatcacaaggtcaggagattgagaccatcctggctaacacgatgaaaccccgtctctactaaaaatacaaaaaattaaccgggcatggtggcacatgccagtagtcccagctacttaggaggctgaggcaggagaatcacttgaacaccactgaacttgaactccagcctgggcaacagagtgagacttcgtctcaaaaaaaaaaaaaaaaagaaagggctaagatgaggtccctggagattctgatccaaaggatatttactggaagtcagttaaatgttctacagtgatcttgtttcacaatgtacttctgttatcaattactaagcaacagcacaggaagtaattcagtataatcctttgttttgattctttggttactgttaccacaaacaacatgtaactaaaatttcagaagagaaggccatatttccccactgttgccaattttctaacagaaacaaaatcttcattttaagaagtatttaaggccggtcgcagtggctcgcgcctataatcccagcactttgggaggacgaggtgggtggatcacctgaggtcgggagttcgagaccagcctgactaacatggagaaaccccgtctctactaaaaatacaaaattagctgggcatggtggcgcatgcctgtaatcccagctactcgggaggctgaggcaggagaatcacttgaacctgggaggtgaaggttgaggtaagacgagatcgtgccattgcactccagcctgggcaacaaaagcaaaactccgcttcaaaaaaaagaagtatttaagcaccagatcctctactgagatcattaaaggagccccactctaatctagaccctagaacctacagccatacacagagatggatctatgtaactatgtatgtatgtatgtatatatgtatctatctacctacctacctatctgagacagggtcttattctgctgcccaagctggagtgcaggagcttatcatagatcactgcaaccttgaactcctgggctcaagggatcttcctgcttcagcctcctgagtgtaggtgggactacaggtgcatgcacagtacccggctaattttttaattttctgtatcactatctataaaatttactaagcgttaatcatatgcttcaacactttatgtacatcatctcattattgttatccattttacaggtacagaaactgaagggttaaatgacttctcccaaattatacaactaaaaagtgcctgttttgcatagtgtctttaaatctaataccagggcatattccaatctttaggaaaacctagaaatatgctcaagataggggtgtagccttgattttcttactaacatttttttccctattggttcttatgtatttcccagtgtgtataattcaattattctgaacttgagagtaaaaagttggtcactacaaacttgatgaagatttgtctgcaacattatttaaaataggaataaggccacacacggtggcttatgcctgtaatctcagcactttgggaggccaaggtgggcagaccttggcccaccttaggtcagaactccagaccaccttaggtcaggagttcgagaccagcctggccaacatggtgaaaccctgtctctactaaaaatacaaaacttagctgggcatggtggtgcatgcctgtaatcccagctactcaggaagctgaggcaggagaatggcttgaacccagggggttcagtgagccgggatcgcaccattgcactccagtctgggtgacagagtgagactctgtctcaataaataaataaataaataaaattaaaaataaactaaaataggaataaacagtaatagcaaacataggatttgtacagcgaaaacaaacagcaggtggccagtcgcggtggctcacacctgtaatctcagcactttgggaggccgaggcaagcggatcacttgaggccaagagttcaagaccagtctggccaacatggtgaaaccccatctctactaaaagtacaaaaatcagtggggcagccgggcgcggtaattccagcactctgggaggctgaggcgggcagatcacgaggtcaggagattgacaccatcctggctaacatggtgaaaccctgtgtctaccaaaaaatacaaaaaagtagccaggcgtggtggcaggcgcctgtagtcccagctactcgggaggctgaggcaggagaatggcatgaacccgggaggcggagcttgcagtgagccaagatcacgccactgcactccagcctgggagacagagcgagactctgtctcaaaaaaaaaaaaaaccgaaaaaaaattagtggggcatggtggtgggcacctgtaatcctagctactcaggaggctgaggcaggagaataacttgaagccgggaggcagaggttgcagtgagccgagatactccagcctgggtgaacaagagactatctcaaaaaacaaatgaacaaacaaaaccagcaggcaagggattctgctgttttaaagcacttcatagatttaaaatgaggacagtttatatcagagattttgggctttgtccctgaaagatggataaagtgtgtttggttataacgtgaatttatttcttcattcttaccttactccaagattttcaaaacgagactcatcaagacaaggcagtaatgcgcctgtgatttcattttctatggaagaaaaaagacaaattcaatgtatacaacatatgcttttcattttctttcaatttggatacaccaacatttacccagatccacataagtgagtacccactgcaggcaatggattgtgccaagtaccacttttttgatctgctacttgtaaagacttaattttaattaaataactaaaccaagaagcattttttgataaatcacgtgaaaatttcaaaattatttgtgtaaattagttccaagaaaaaccagttgcaaaaaggaaagtgaaacccgactacctgttggggttttgccaggtcagcagctttgagttggggagggaaggaaacctaagtctattgttcttagaattaacaaggtttgagttggggagggaaggaaacctaagtctattgttcttagaattaacaagttaaaaccgtgaattcaagagtgcttaaagtgttgatttttctcaaacctcctgggaaagcactcaatactctgatttggaagaggtgtgtgtgtgtgtgtgtgtgtgtgtgtgtgtgtgtgtgtcctgggaaagcactcaatactctgatttggaagaggtgtgtgtgatttggaagaggtgtgtgtgtgtgtgtgtgtgtgtgtgtgtgtgtgtcctgggaaagcactcaatactctgatttggaagaggtgtgtgtgtgtgtgagtgtgtgtgtgtgtgtgtgtgtcctgggaaagcactcaatactctgatttggaagaggggtgtgtgtgtgtgtgtgtgtgtgtgtgtgtgtgtgtgtgttgttgggttttttcctttctctttctatacaattaattctaatctttcctgacctcaaattccagaactctggactattttcttttattttctttgagacagggttttgcttgttgcccaggttggagtgcagtggtgcgatcacatctcactgcagccttgacctcctgggctcaagcgatcctcctgcctcagcctcctgagtagctgggaccacaggcatgtgccactgcacctagctaatttttatttttattttttgtaaagttgaggtctcctgatgttgcccaggctggtcttgaattcttgggctcaagtgatcttcccacactggcctcccaaagtgctgggattataggtatgagccactgggccaggcctccagtggtttttgatgagaatacttgttaaggtatagatcacatgagttctagagtccaaagacctaaccttaaaaaatctagctcttttttgtagtggtgtgatctctgaaaagttactttacatctttggacctcgcatacatcatcggtaaaatgtgttgagtgtagtaacttatttcagacttcttgtgaggctgtattccataatgagaaaagggacactgtaccttgtgcttggcttatcaaattaaaaaaaaaatggacttagataaagagagactttttttttcttttccgagatggagtctcactcggtcgcccaggctggagtgcagtggcgggatcttggctcactgcaacctccgcctcccaggttcaagtgattctcctgcctcagcttcccaagtagctgggactacaggcacataccaccatgcccggctaatttttgtatttttagtagagacggtgtttcaccatgttggccaggctgggcttgaattcctgacctcaggtgatctacctgcttcggccttccaaagtgctgggattacaggcgtgagccaccgtgcccggccaagagaaactttattagaaagaaagactattgctggtcgggcgtggtggctcacacctgtaatcccagcactttgggaggccaaggcgtgtgaatcatcaggtcaagagattaagaccatcctggccaacatggtgaaaccccatctctactaaaaatacaaaaattagccaggtgtggtggtgggcacctgtagtcacagctactcaggaggctgaggcaggagaattgcttgaacccgggaggcagaggttacagtgagccgagatcacaccactgcatttcagcctggcgacagagcgagactctgtctcaaaaaaaaaaaaaaaagaaaagaaaaaaagaaaagaaaagaagaaagactatttctacagggagaaagctccaatatcagatatctgcaagaggctcaggaatcaaacacataggccggccgggcgcggtggctcacgcctgtaatcccagcactttgggaggcagaggcggatgcatcacctgaggacaggagttggagaccagcctggccaacatggtgaaaccctgtctttactaaaaacacaaaattagccaggcgtggtggcgtgcacctgtaatcccagcaactagggaggctgaggcaggagaaccacttgaacccgagaggcagaggttgcagtgagctgagattgtgccggtgcacttcagcctgcgtgacagagcgagactccatctcagaaaaaaaataaaataataaaataaattttaaaaaataatcaaacagaggcccaagaaccaaacagaggttgggcatggtggctcacacttgtaatcccagcactttaggaggccgaggtgggtggatggtcactcgaagccaagagtttgagaccagcctggccaacatggcaaaaccctgtctctaattaaaaaaaaaaaaaaaatgaggccgggcgcggtggctcacgcctgtaatcccagcactttgggaggctgaggcaggcggatcacgagttcaggagatggagaccatcctggccaacatggtgaaaccccatctctactaaaaatacaaaaaaattagctgggcgtggtggcacatgcctgtaatcccagctactcgggaggctgaggcaggagaatagcttgaaccaggcagttagaggttgcactgggccgagatggcgccactgcactccagcctggcgacagagcgagactctgtctcaaaaaaaaaaaaaaaaaaaaaaaagaatccaacagaaaaagggtcttcttttatatgataaaggacgggcaagcagaaataagcagaatctttggataggaacctggacgagcaagggaaaatgagcagtgtagcccaacaggacagcatcctactgtggtcagccggttctcaaaagaaactgaccagagggaggcatattccactgctttagtgcctgcctggtcagatctgggggtaagcaagagttgaggggcccataagggaagagagaagtccgaataaagtttggtcaagacaaagcagaagctaagacatgagcaattgggaacagttggtcagtttttaccaaatgaaagcacatagtgtctttgatagcaataggttgtaggtttaaggaacacacatcattctggagggtaacgagttaatctacaaaccactgaaacagagagccaaccacattttgagacagaaaatatggaactacttcactccacttgttgctagtcaaagaaaataaagtaataatccatcccagcagtggagggaaacgaaagggcaaaagggggaagaaaaaaaaaaaaggagaaatgcaatttcccatacccattcaagctatctttgggtcctgaaccactaatgttcctcctaccccagtttccaacctagccaaacagggccccacctaacaaatgcaaaaatttactaaatttgcaaatcccaaccaccaaagaatcaccttcctattggacacctagaggatataaggcaggagtcaaatctcacacccaccacaaaaagttgagtagaattcacaaggatggatgcttggatacgaatcagtaaaatatgattaaaactcaacctaaacacttctccaggggatgtggccaaactgtggcatgctggggattcagtggtcaactgaacaaccccaaggttcagattttggaggggaacctgcttttaaagagcaaaacatgttccttaccatgttctgcaagtgcagtcaacacacgcctatcgggcgctgctgggatgccaaggaaggtgatgggaattcagagattaaccaagccagttccttccccttcaggaaaagcctcaattcagggaggaaaccgaaacctaaaagccccagaacatcctctgatgtggcaagtgttcaaggagctgcggttagcgcggaggggtcccgcgagcctggatgacagcaagccgcccaccaaggtctggggaaaaatctccttctaactaaaaaaaagggacccgagtctcgcttgtcccgcgccggggtggcaagttagtgaagaaacccacgagagtgagatcccaatctacgactgcccctcccaggtcctcaatcccgggagcctgctcccatcctacgaatcgcctatcccaggcgaccccatgtcttcttcctccgcctcggggagtcagtcccgggagccccatgccgcaggccctcctgggaacccccgccgcagggctccctcccccgcctcgggtcttcctttcctcggcgcccccagcgcaggtccgccctcccgggtgcctcccgccgcagggctcgctcctcggcctcggtcctctcgtggggccccctccctcagggcgcctggcccgcgccccaggtcgccgcccttcgcccctcagcccctccggagccgctacctcggatgttcttcagcagcaccggctcttcaaagccaccgcgcctgaggaaggagcacacctgctccggaccccatgtcttgtagtcgggatggagttccaggcccggggaccagtctgcctctgcggaaggggtgtttgagggggttctcgggctgtcatcgcaacggggacgcttggagggctgctcggaatcggctcgctgcatggctacacctggcgtccggcacagcagtcaagaacctcggcgccggacccgcgcgcaggcgcactgacagcagggccctggcggggagtccaaggagtattggcagcctattggcctcctgcgcaggctcactgacagttgagcccttcgggcagggcagcctagcggctcttgccttgggctccctgcgcaggcgcaat

SEQ ID NO: 1968 - DNA, 7899 bp, Homo sapiens
aataaacataagagtggttttattgattacatacaattttagctatattaatatatattataaactttaagaattagaaataagtgacttttattttttaaccaagaataatctaagttatggcagcatgttcaatgaaaggtaagtccggcacaatttttctatatctgtttctcagataatcaggaacatcatccaagctttacattacgataccataatgaccctcagaacacaagttccattaagtagaaatgaagcatcatatgttttcttttttaggaaagacccccccttttgttgtatagacatacccctaataatcttactctactgtacaaataacttttcacccacaagagctgcctcaagtaactttcattttggaaagctatcaaggcatgagacagagtagcaaaatgccactctggactttgcatcttggagtttcaattttgctttaggatttagaccccagtttataattaaaaccaaatcattcccacattattatacttatgtaggaaagccttgctgtgtccactgttaacacaaagatagaaaatgtcaaatagtttaagcaagtatttggcagaccacagacatgaaacagtgccgtcggaaacggaaacactttagtgttttagaggtgaagagattgatgggtgtcattcaaatttctcatctccttcttctacatctttcagattgagtacttccaaagaacctttgcctttagtttccttttttattagctcatcaatttctcggaagcagcccgggtcaatcagacatacctgaaacatttaacgtagcagattaccacatgaggatgagcaagacacagaataaactcagctttaacttcctttgaggcaagcacaatgctgtccagatctctaataataccacagttctatggtgcaatagataagacaatgggtagggcggcacactgggttccagtttagcctctgccctcaagtgtccatgtagccccctgtgacaaggcattaatccctatgtttaaacacttattctgattcttcagctgtaaatggaagggacaaactagaaaactctgattcttctcatactaaaatttagcattacattttatagctcagtaaagtcacctccacgtatgaaggagaaaaagcaatgtgaagacttatgtagacaccatgtgtatgttaatttatttttttttgagatagagtgcagtggtgtgatcttggctcactgcagcctccgcctcccaggttcaagtgattctcctgcctcagcctcccaagaaactgggattacaggaacccaccaccacacctggcttattttttgtatttttagtagagatagggtttcaccatgttatctgctcaccttggcctcccaaagtgctgggattacaggcacgagccactgtgcctggcccatgtgtacagttttgcaaagattttagaacttcaagtagtgtcagatgagttagttcacatctacagtggatactcacatactcaacacttctctacagctcatttacttttaaaaagaagctgcagacagggcgcggtggctcaagcctgtaatcccagcactttgggaggccgaggcgggtggatcacctgaggtcgggagttcgagaccagcctgaccaacatggagagaccccgtctctactaaaaatacaaaattagctgggcgaggtggcacatgcctgtaatcccagctactcgggaggctgaggcaggagaatcgcttgaacccgggaggcagaggttgcagtgagctgagatcacgccattgcactctagcttgggcaataagagtgaaaccctgtctcaaaaataaataaataaataaataaataaataagctgcaaagccttgaaaacatgaatttgtagacagctcaatttacactgtgtttgaagctgtggggtgaggtcataaggacataatggtttcgctgcttctttaaaatgttctgtgtttagtgtcaccaggttcacacactaatatcctctggaaacaccctcacagacataccccaaacaatgctttatcaggcttctagggattcctttccagtcaagttgacacctaaaattacatccacaattccaccccttatcaacttggcacccagactcatctctttaaaccatttttaattttcaaatgaagacaataacaaggtcctagcttttcctcacatgatgcaattaaccagacgcgactatcctgcatacaactcaaagagtgctaatccttttgccagaattcagctttcagaatttcatcattcagaattcaatcttttttttttttttttgagatggagtttcgctcttgttgcccaggctggagtgcaatggtgcaatcttggctcaccgcaacctctgccttccaggttcaagtgattctcctgcctcagcctcccgagtagctgggattacaggcatgtgccaccacgccagactattttgtatttttagtagagacagggtttctccatgttggtcagactggtctcgaactcccgacctcaggtgatccacctgccttggcctcccaaagtgctgggattacaggcatgagccaccgcgcccagccaggattcaatcttttggaactgtgattttcaagatattagaagttcaggctttggactttagagattttgatttttttatgatttcaacattgggattgtggcatttgggattgtcttttaggattatgatcagcactggagtaaagcatgcaattgagctatctctgaaaactcaatgtaaatttccatagtgtgctttgtactaatttttgcaaaatttttaaggtaattggaattatcaatcttccactaaaatagcaatttttaagtggcttattttaaatagttgctaaatttgctaaaatcatgtatctaaaacactacgcataatatatgacaaaaataaatgctgggaaaaaaataaaaggatttgtggtaaacaaggctgaccaacctttagtcttaagaaaatatctggctgggcgcggtggctcacgcctgtaatccctgcactttgggaggctgaggcaggtggatcatgaggtcaggagatcaagaccgtcctggctaacacggtgaaactccgtctctactaaaaaatacgaaaaattagccaggcttggtggcgggtgcctgtagtcccagctacacaggaggctgaggcaggagaatggcgtgtacccgggaggcggagcttgcagtgagctgagatagcaccactgcactccagcctgggcaacagagcgagactccatctcaaaaaaaaaaaagaaaagaaaatatctgacgtttacaacatctaaatgtttgctacaaatttattactagagaatacaatatttaggtaacatgaagcaaagaaaatatttgactcttacgatttctaactgttggccataatcttcactttctatgaccttgatcagtggcttgagcttttctttcagcttcttgccttcattgactggaaggatgaaccgaagcctcatgtgagcacgttctatcttcattttctcttttaactgctttatcacttccaaagcctaccaagacaaaatcgagaatgcaatttcttctactatattatttcataaggttttcaaaaacaaagtagtttccatgtagttggattaggtaatggtttcttaggtataacattaagaacataagtgaccgttaaaaaaaaaatagaaaaattggacttatcaagaagaaaagcttttgtgtttcaaaaaactatgaagaaagtgaaggccaggtgtggtggctcacgcctgtaattccagcactttgggaggccgaggcgggtgcatcacaaggtcaggaattcgagaccagcctggccaacatggtgaaaccccgtctccactaaaaatacaaaaaaagaaaaattagccgggtgtggtagtgcacgcctgtaatcccagctactcaagaggctgaggcaggagaattgcttgaatccgggaggcagagtttgcaaaaagagggcggggggggtgggcaaagaacctgaacagagatttctcaaaagaagacagacgaggcaccaataagcacatggaaatatgctcaaatcatcattaaggaaatgcaaatcaaaaccacgacaagataccaccaggatggccatcatcaaaaaggcagacaatgacaagtattactgaggatgtggagaaactgaactcttaaacactgatggtggtaaagtaaaatggtgcagctgttttagaaataggtttggtagtcaccaggtatacagaaatgaaaacatatgtctacacagaaacatacaagaaattttatagcagcattgctcatcatagctcaaaagtgaaagcaacccaatgtctatcaactgatagatgaatgaacaaaatgtgtttctttccgtacagtgggctattattccggcataaaaaagaaatgacatgctgatgcaggttacaacatgtatgaaccatgaaaaggccacatattgtatgattccatttatatgaaatgtccagaattgagaagtccataacgagaggagattagtggttgggaggggcctgtggggggaaaatgggggatggctactaatggatactgactttctttttgtggtgatgaaaatgttctcgaaccaggtagcagggaaggttccaaaactttgttaatataccacttaaagtgtacatactttatgagtgtgaaatttatggtatgtgaattatatataaattaaaaaattcaaaaagaagtgttaaaatgaccctttaaaaactcaagttttgtctttaaaagtttgatttggataggaagaagaaagtcctatatacatatttgtgtttacttgaaaaaaaaaaattacctatctttacaaccccgtccttttcctccatctcttccccaaacctctacccacttgcttccatgcagacccatttttttaaatttaattttttatattaaaaaatttagaggtagggtacggtagctgatgcctgtaatcccagcactttgggaggccaaggcggacggatcacctagggtcaggagttcaagaccagcctggccaacatggtgaaacctcaactctactaaaaatacaaaattagctgagtgtggtggcacgtgcctataatcccagctactcaggaggctgaggcaggagacttgcttgaacgcgggaggtggagattgtagtgagccgagatcatactactgcactccagcctgggcaatagagtaagactctgtctcaaaaaaaaaaaaaaaaaatttagagatggggcgtccctatgtttcccaggctgtttccaggcctcaagcaatcctcccatcttggctcccaaagtgctaggattacaggcatgaaccattgtgcctggccccagacccattattttaatgatttcttcagagaaaactgatttccatggctatattttgatgacatgagaaaccactcacctgctgttttgtactcttgttggttttcaccgaatagtggatgtccttcatggctctctcaataaggatcacggtgtatggtctctttgtttcaggattcacacatttgtctgccacaatagttgcaatgtccctaaacatctgctccagttgtgtgtgtctttctttatctgatacttgaacttctcctttagtcaaaatctaaaaaaatgccaacacatttaagaaatcactatctttctctatcacacactatttattaactaaccataaaaaatgagtaactggatggagagaaaattaaatttcatcctctccagctatcaatatgtaagtaatggtttgagctttgcccaaaagatgcaagaatcttttggctgggctcagtggctcacatctgtaatcccagcactttgggtggctaaggcgggcatatcacccaaggtcaggagtttgagaccaacctggccaacatggtgaaaccccatctctactaaaaatccaaaaattagccaggcagggtggtgggcacctgtaatcccagctaccctggaagctgaggcaagagaatcgcttgaatccaggaggcagaggttgcagtgagctgagtgcagtgaagtgcactgcactccagcctgggcaacagagcaagactctgtccccccacccaaaaaaaaaaggatctgaaagatgaaatacttgaaaacaaattcagttttcaggtataccacattctataaatggggcaatttatagaaaaatgaggtaatttagtagaaaatctgatttcaggaggttttggcaaaaaaaaaaaaaaaaaaaccacaaaaaacaaacaaaaccaccaagttctttattattagaagtgacactgtgcagttcacattattgcttggttagtctttcctccagaaaaacagcctttaatgtttaatatatctacaaatacgttataaatggttattagggttagctatgctgcagctgttacccacctgcttacagatttcagtttggtcatctgttccaaacgcactgatgagatcttcctttttggcaacctgacctttagaaacatttacaaacactgagtgggtctgcagaacttcatcgaggtctttttcccttgtgagggcaggagagaaagtcctatgtgaatatacttgaaacttggacatgcatttacatttaaatacgagatggcaacaacatgaacggcaagacacaacaaatccccctgatgacctttagtgtagagggcagttttctttttcttaccccccaacccccgcccctagatggaatttcactgtttttgcccaggctggagtgcaatggcgcgatctcgggtcactgtaacctcagcctcccgggttcaagtgattctcccgcctcagcctcctgagtaactgggattacaggcatgcgccaccacacccggctaactttgtatttttagtagagatggggtttcatgttggccaggctggcctcgaactcctggcctcaagtgaactgcccgcatcggcctgagggaacattttcaaaactcagaaccgtatttgccttaccatttgctcactggagaaaaatgtcatgggaggacgtaagaaacacaagggtggggtggggtgcagacagctgctgccacggaatgccagtccctagatggcagcagtgaagacactacgcactttaaactgctagggctactgagatctatgacaccagatgtacccacaactatgacagtattcgtaagactaggttctcagccatcattattctaggaaaaggaccacaattacgagatttcttggctgcagcttttatgacaccaacaaaacaaaaccccaaaccaacaacccaatccgaaccaaccaaataaagaagaaacccttggcttaggcgccaagctcggacagcgacgtctcatgctcacagcaggaatgttccatttcctccccggccaacaccccagcctggcccattcactcgacttgggcagagacaggccgcctcggaggtgacggctcaggcccaggcccaggcccgagggagggggctactcacacgccgctccgccagccgacgaccttgtttttgtagcaggcgatttcgaagcgcttcccggcacgcttcatccgtaccacggccacattggttaggcggatctggttggtgggggtgaagatcgacatcgcggctgttcaaagacccagaagccggcgaaccagggctgacccgcgccgtccagcctgaaggccaccagcgcctcgcggtaacgaccgatcggcgcgcggcactgacccaaccaccagtgcgcggcgccgcgactcactagcttcaggcagccgtcacagtgtgtctggcaggcttacttac

SEQ ID NO: 1969 - DNA, 26879 bp, Homo sapiens
attactaagcatccccgtctgagtgcaagggtgtgtgttggcagtacagccccaatcttgcaaaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtgagtatgatacggtggacatgggcctgctgagggtgtgggcggtgggcaacagcagctggggccagggtggaggccgaggcaggcaggggcgccggcgttagcagctcgccgacgcctcctccgtggcccaccctcaagtccagcccagggccgtggtggaacacactttcgcctcaatccctcgctggggatttcattccctgggcctcctgctctccagaaggccctcaccagagccttttggggcagctgcagagaatgccatttcgggtggtgaaatgtggtccacagtttaccttcgctccgggaaagacccaggctccccacttccattttgacccctatcgggtggcgccctgcgagccttactctagctctctttaaacgacttttgaagtgtcatcccaaaggaagagcatgacattcagagagaggaggcacattaagaaacagagtcaattactttaagaatgcaatgccagttaggtcgagatgctgagagaggagggggatgtgtgtcagtaaaatcacctctctggatctgctgatgtagcatcctttagaaaagtagtggggggtggggaggggcaggggatttcagaaataggacccttcttgataaacgttaggactcacaatagtcttaaagggaatggagggaaaacacccttgttatgattcagctttgccatttgcctaggcatgtctcattctaaggcttcattttgaatcaaattcatctgcgtctttgctccagggctccggagtcaggcagatctgagactttgtcctgtgctcgtcagatgttaggtttgtgacttgggcaaattaacctctcagttccccagttttcttatccattgaataggtatcatattactgcctacctcataggattgtaagattaagtgccataatgcagtaaaaaaattagcactggggcctgacacctagtaaatgttcaataaatgtaagctattggtattattattataccaaagatatattattattttatcttctcttttcagttgatttcttttaggaatcatgggggcatttctaaggaaggacctagctcaggcattattgtcagcaggataaaaaaaaaaatccatgaaaacagcagccctgcattgtaggttctagacagaaaccaaatgaggttaaatgcttggtagtaagttcagcatctgataataccccacaagagtttgaaataccttatgggtcagtgaagaaagattatcctgatgctggtgctagaagatttttcactgtatattgttttttaaaaacggtcaagccttgtttgtggcagctctcaggtcatgctaaatacatttttcacaaaggcttcaagggaaatacgtggaagctattgaatgtcttgggcttgaatctttatgttttgcttatataattattgttcccgtgtggaacctagggaagggcaatgaaaaccagctaggattcttaggctcttttctcattgaaagaaggtggagtgagtgggtgggtgaaaggcgctgctttagggaagctgacaaaggagataacatgctccttaacccaaaggtgaaaaagaatgtacaaaacaagtctgggcaggggagggacaacagggtatagtgagaggcaagatatacctaaggcttcagcctcacggggctcctggccgtttctcaagctcctcaaaaatgcccccacttaggatttctgcgcttattgttccttctgcccaaaataccttcagttcacatgtttgttcaactgtctcctccctcagagaggacttgcttgaccacctatctagaacaagtgccctctccctgtccctgatacactcactccatctctttatttttcttcaaagagctttaaactatctgataatttgcttgtttacctacttattgctgggctgtcctgcaaaaatataatctccatgagggcggagatactgtctccatcaccagaaacacaggaacacataataggcactcagcagatatttttgaattaacaaactgtcaaggcaaattctgttctttactgcaataaacggaatggccattgagaggttagggtatggactctgggaaagtcactcaaattctctgggactcagtttccatatttataaaacaggaatagtaatgtgtatcctaccttctgcaaaagattgccttaagtaccttatgcaagagagaagggcagctttagacttttgcctatgtaggccggaaccacatgaggaattaacttaggcaggtgagaaattatcaagcatttaagttttcgcccaaagtgaatcttgcataaatgcagtttttatgactcttagttctccatgaaaacctccttgtgaagtagcggaaaatactagacaaattgggagttcccttacggtgtctttcaaatggtacactggggcctcaaagtcttatgtgactgttagggtgatagccagaatgtgctgcagagggaagatatgaggatacattgccttttatcagtttctcaatgtttttgagttgagtgtcccttttgataaatgtaaaaatttcattccctctttttggtgctacactgtaattataaaatcagattttatttagaaataaaccacgtactcattttaaaccagaacacttatgatatgcagtcgaaataacaatataagtggtatcatatacacatggacaacaaggtatagctgacaaacatgcattgattgtagggtttactcagaatggtttctcattctatcttttgtttactcctattaaccaagaagatttaattgagctatagtttttatatttttattgtagagataatacatttcatatgccttcaaactgtactttaaactgtactttcaaacgatgcttgcccttttccccagttctgaacctcctaatcatggctttcagatatggccttttcttctgttctgatttagaaaatcgaaaattgaactgcttcataaagcactaaaggagttttccatttataggattgctcaccttcattttaagtaataagtatttctttcaattactttctctaaataaatatagatttttgtataagtctattaaaaatagttccttatacctattcattatagaaaatttgaaacatatagataatagaaattagagaaaaatcatctatagttttataacctaaagatgactattgctaaaaattaggtgaattttcttctatattttaataagatgaattgctttttgagcacgtgtgctcttacaattgtattcttacgagtgacgtatttgactactaaaaagtttgatttttgtatgcgtcaaaaaaagtaagggcaaacaccaaatgttatatatttatatatatataaatatctaatatatataatatataaatatataatataaaatatataatatataaatatatattatataatattatataatatataatatataaatatatattatatataatattatataatatataatatataaatatatattatatataatattatataatatataatatataaatatatattatatataatattatataatatataatatataaatatatattatatactatatataatatataaatatatattatatactatatataatatataaatatatattatatactatatataatatataaatatatattatatactatatataatatataaatatatattatatactatatataatatataatatatactatattatatatagtatattatatactatattatatagtataatatagaatatattatatattgtatataagataatatattatatattgtatataagatataatatattatatattgtatataagatataatatattatatattgtatataagataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatataatatattatatattgtatataagatatattatatattgtatataagatataatatattatatattgtatataagatataatatattatatatatattataaatatgtatatttttatatattattataaatatatatattttatatatattattataaatatatatttttatatatattattataaatatatatttatatatatttatatataaatttacatgtgttaaaaatatgattgtgttcttgtattcttacaattgtatacgtttcccatttcccacttaatatgaaaaaaatacactcatatgtaatgttcttagagacaactttaagatgttatttttaatggctgcatggtagtccagctagctagtaagtataccatattttgcttagccagtcacctacttttagacatttgactcattccatatttttgttattataaattccatcaggatgtatatttcagtacattaaagtttccttgcatttatgattatttccttagaatgaatttccagtgtggaatttctaggtcagaaaacataaacagcttaggattcttgatatatacatgatcatgagatattttccctaaatggttattccaatttacatgctcacctgtaatgcatcagtgtccatttcaccacaccctcactagaagtgggtattgtagttaagaaaattttcccttgacatttggcctgttattctttattttatatttacactctatctctttattttccacattttatattcctttggttagtgactgtcattttatatggttgttaagctgttgtatttcctcccatgatttggctttttgtgtatttttctcatttaaccagttgaatcatactttttttaaacacactctatgtgtatatatatatatgtgcactaatccttgatctattgcaaggtatcctttcgaagtttggtgtttgcccttacttttttgacacatacaaaaatcaaacttttttaacacattgtaaatttatatatatactaatccttgatctgttgcaaggtatgttttctaagtttggtgtttgcccttactttttttgacacatacaaaaatcaaactttttagtagtcaaatacgtcactcgttttctttgtgtttgatttcttccttggctagaaagtcctttccccttgagatatgtcataaaacttcactgcagtttttgttttaaattacggttttgttagtttacatttacctctttaattccatttggagttgtattttgatgtggataaaagatctaatttgattttgtttccagatagctagcaattgtcctaatataatttataaatacaacttccattcttcattgatttgctagccgactttaccatatattaaattcttatatataacagttactgtttctggactatctatttgtctcaattgatccatttattcttgcactgatagcactatagtatgataatgttttaatatattttaaaaattatttgctattcttatctgttggttcttcaaaatgaaatctagaatcattttattaagttaaaaaaaattcattggaccaaatgttttagctctcacatgccagtgagaacacatgatatttgtctttctgtgcctggcttatttcacttcacataatgacttccagttctatttacatttctgcaaataacaggatttcattctttttaatggccagatagtattcaattgtatatgcatagcacattttctttatccattcatctgttgctggactcttctatatcttggctactgtaaatagtactgtgataaatgtatgggcgcaagtatccctttgatatattgatttcctttccttttgatagataccctgtagtgggattcctcaatcatatggagatagagagtaaaatgatagttaccagaggttgggaagggtggaaggcgatgaagagaggttggctaatgggtacaaacagacagttagatagaagaaataggttctagtgttcagtcgcacagtacggtgactatagttaacaatatcttatgtattttgaaatagctagaagagagtacttgaaatgttcttacatatagaaatgataaatgtttgaggtgataaatatcctaaatattcaaatcccctgatttgattattacaatgcatacatgtgttgaaacatcacactgtaccccatgaatatgtacaattattatgtatcaaaaatttttttgaaaacaccattggggttacattaaatttattaataaactaagaatgaattgtcatctttaaataatttagtcttcccttcccataacataagtctctccatttataatttttttgtttatatccatcaatcaagttttatagttttctttttgtatgtcttatacattttttgttatttcgagttattgtgtgtatgaatgtgtatgctgatttttaaaaatcataaatgggatctgtttccactatattttctgtttcataggaaagctactgattttatgttctgttcttgtatttatccagtgtactgaatgctcttattaatgcagatagttttttttttaagtttattccctttgttttttttagatacatcaagtttcttttcactgaggtacatatgttctctcacatttcttcccttctcaccctcaatgtagacagccattgggaaagttctgactgcccagtgggattgatggtgataagacgagaactaatttaaaatatttaaaataattagctcaaaaaatagtttatttccatagttggcatccttctggacatatctgcctttgtttgctacttatctgatggaagatttggaagaagaaatgctgttataattctttagcttcaaggacacataatgaagtcatttgacatgtatgtctttagataaatgcataattatctttttgtcctttaagttttaaagggacaactgggaataaagtgcctgtcaaacaactgaactggagaaatgggggaggagcagtgatgaaataaaattccagtttatcagttgcaataaaggggaacagtgtggcaaagaacttgaaattataacttaacttcatttagtgagaaattacaacttgcatttagtttttgaattcaattggatatgtgccttggtgccacatttatcttcatgataacttaggccaccaacattattttcaatttcctgaatacaatccagtggtaaagtgagcctgaaagccagcctaggattgtttgccacatataaaccaccgaatggataattcacggcaaataagccaagtactgactctggttgacaatgtaaaattaaagttgcaagattagcctgaagatgtcatttagcttaagcaaagggggagtctgggttgatctctttcgggctctccccacctggcctcttcccttcagctccctccactgccctccttctctcagtggacagttctagctccatgtccaagcagattccctccctttttgagaattgtgcttttggaattgtcttaaagaccaatttgttaatacattccctctagtataagagaggggcagcacagaatggtggttaagagcccagatcttccagccagatctctgggtgtgcatcccagctctgacccttaactagctattttcccttgggcaggttactttaactttctgtgtctcaggtttcttacctgtaaaacggcagatggtgataatgagagtacttacctcacagggttgttatgatgattatgacatgagttaatatttgtaaagttaacatgtaatatgtgttttttaatatgaataaaagctctataaataattgtaatacaaagttagaacatcataagtatacgtaaataaaacttgatatggaagttcaggggaagaagtggttatatttattttcatgactcatcaaaatatcacatagttttaccatcacacttgaagttgaatgactttcaactgtttcaaaaattaaaattctctctgaaagaataaagtttgggccattgtaagtttggaaagctcttgaatcagagtatagtctcaaaaataatggctttgtgtaggatactattcctctggatataaaagttctgaaacgtttgttaaaaatcattatagttgtgtcttgaattttgtatgtagcattagttcgtatagacgtagagggcataggtactggcttgctttatttgaaatgtcatgaagaagtcagatgtagctaaatgttttcttttgtgtagtacttgacgtggtataaaaaaggaattgatgtggatttgtcagttctaaaccaggatctgtccccaacactgacccactgagaaaataagaaataagtcaggttggttgcttcttgcttcttgtccatttctaacctggacacttttttacagttagggacaacttttgatgaaataaagacaaatttcaatatcagcagagactagattaacacatgctttatagtaattaaaataaattaaaggcaatgataaaactccaccgttctttaacaattattcatgttctgatttttttggtgatacattttaaactctaggattatcaaaaagtccaaaaaagctttaatgagggaaggaagttaaaagtacactacattgctggtttgtctgtattaagggagggagtcagaggaaatataatcctgaaggggatgtaacaatttaaaaaaatgaattacatttttatgagttgtgatttgcttaggctaggtttgtaaggctccaaattgtaattctgcttgtttttcttaaaaaattagtcacttaaataactacatgaaaaaataacatgcaagaatgcatttacgttagtttaaatttacttctagtttatatacacacagggacagacagttttgaatagttgtaatcagagtggcatccccttgtgcccactttttacacatactgtcattttatttttttatttttattttttgttttgtgtgtgttttttttaatactttaagttctagggtacatgtgcacaacgtgcaggtttgttacatatgtatacatgtgccatgttggtgtgctgcacccattaactcatcatttacattaggtatatctcctaatgctatccctccccccaccccaggacaggccccagtgtgtgatgttccccttcctgtgtccaagtgttctaattgttcaattcccacctatgagtgagaacatgcagtgtttggttttctgtccttgcgatagtttgctgagaatgatcgtttccagcttcatccatgtccctacaaaggacatgaactcatccttttttatggctgcatagtattccatggtgtatatgtgccacattttcttaatccagtctatcattgatggacatttgggttggttccaagtctttgctattacacatgctatcattttatgtcaacatagtccacatacttaaagttttctggaaaacctaagactctaacatttttgaattttggcataagattttatttgtttatttatttatttatattttttgagacggagtctctctctgtcgcccagcctggagtgcagtggtgtgatctcagctcactgcaacccctgccttccaggctcaagcgattctcctgcctcagcctcctgtgtggctgggattacaggtgcgtgccaccacacccagcagttttttgtttgtttgttttgtatttttagtagagacagggtttcaccatgttggccaggctggtctcgaactcctgaccttgtgatccacccacttcagcctcccagagtgctgggattacaggcgtgagccatcgtgcccagccagcattaacattgtaaaccttcacctttgacatagaaagtgtaattttgaaccattgtttctgctataattcctttatttttccctaatttatatatttatttctaaactggcaaaattgtatatatgtattgtgtatgacatgatgctttgaaatatgtatacatgtgtaatagctaaattgggataattagcatatgcattacctcacatacttacattttgtgatgagaacacttaaaatctactctcttagcaactttcaagaatacaatacattgtttttaactatagttgccacgttgtacaatagatctcttgaactttttcctcctaacctaaatcttttatcctttgacccaaatttcccaatccccaccctgcacgcccctacgagcccctggtagccacccaccattctactcttggcttgtattagttcaactttttaagatcccatgtataactgaaactacgcggtatttgtttctctgcgcatagcttatttcactttacaaactgtcctccatattcatccatgttgttgcaaatgacaagatttcctttgtgtttaaggctgaatagtattccattgtgtatatacaacatattttctttatccattcatctgttgatagacatgtaggttgattgcattatgtcttggctattgtgaataatgctgcaatatacatgaaagtgcagatttctccttgacatgatgatttcatttccttttgatatatacccagcagtgggattgctggatcatatggtggttctatctttaattttttgaagaactttcataccgttttttataatggctgtactaatttatattcccaccaacagtgtgcaagggttcccttctctctgcatcctctcttgttgtcttgtttttgataataaccatcctaacaggtgtgaaatgatatctcattgtggtttcatttgcatttttctgatgattagtgaggttgagcattttttcacatacctgttggtcatttgtatattttcttttgagaaatgtctattctggtcctttgcccatttttattttattttattttttttgcaatggtgtctcggtctgtcgcccaggctggagtgcagtggcgcgatcttggctcgctgcaaactccacctcccaggttcatgccattctcctgcctcagactcccgagtagctgcctttgcccatttttaaatgggattatttgttttctttctattgagtaatttgagtctcttatatattttggatattaactccttatcatatgtatggtttgcaaatatattctcccattctgtaggttgtctcttcactctgttgtttcctttgctgttcagaagctttttagtttgttgtaatcccatttatctatttctgcttttgatgtctgtgcttttggggttatacccaaaaacaattcccttattttgagcaattattccttatttaggggtgcttaggttagttccatttttttcactattaaaatagggctagtatgaaaatctttgtcaaattgcgttttcctcttgacttgtttccttggagtgtatgaagataagcaaggttatgcagtcaaaaatatgtatggttttataggtctcgttatataacttgccagtttgaatagcgattttccatggacagggacagagtatgttttgtttgaaaaggcatattcaatattttagtttaattttatgttacaaaattactggtttataatagaagctatagaaaataaaactaagaaatattattggggaagaaaggaaaaaatggttcagaaacactgtcctgtgaagactgaaatgattgacaaaccttcagcttatactaaaataaaattgcattcttaaagcatagactgaatgactacggaggaggtggcacagaactgccctgggcaggtggaagaagccaggttgacaacagggaagttgccatcaatattcccaatgagatgtgggcattcgctttacattttaatcagtccttctgtaactttaatgttcatacaaatcacctgggcatcttactaaaatccagattctgatttaacaggtctgggtggggcctggaagtctacatttctaacaagctcccaggtgatgttgatgctgttgtcctgggaatgcaatttgagttgcactgttttagatctcttccttgtatgacatattatagtaagagttgactacaggggatccttggtcagttacttcagtaacttgaaagtgaaagatataaactgctggcctatttgaggggtgaaacaattttgctcattcagaaattggaggggttgtggggagaaggaaattgttaatattagatgagttaatcatgagaagttttatgtaccattcacaccaggttgttcagagactgaaggaggtacgaagttttgaagtggtactcaggttcctgctacttaactgaaagtgagataagatcagattcgttaggaaacaattctcaaaacagactcatttactttgactaaatgcgtctgaatgatagtagggagatagagtcattgtattttttagagacccactgttttagaaagtggaaaacttgttgcttaccattctgcttatcttgttgctgagattttaaataatgaatctccacatcacccttatgatactgaattattgccattaatcatttctcatagggaaaatggaactaagaacctatgctgtttcactgcttccatctccattttgctatgtggctttaagaaaatcacttaaaggcttatgttgagttcccatggtgaaaaatggaaatcaaagctcttgccttgttccccatagagtacttgctgaagttagtgggctttgaggtagatttcaagtgtttaaaaagacaaaagactttaacattgtaatattgtatatttattcagcatattatatataggcatatatcaagctattttatatatgatctaaatattctggcaatccttcgtaaaaaataaaacatcatataatccacatcagtagttaaattgaccttttgttcagtgtcacgaatcaagtaaatctgaatagtgtgtttcagatttgttttggccctttaggtaatcagttctgatgcatattgatgaaagatatagtaatttttttttttagatggagtctcactcttgtcgcccaggctggagtgcaatggtgcgatctcagcgcaccgtaacctctacctcctaggttcaagtgattctcctgctccagcctcccgagtagctgggattacaggtgcccaccaccacgctaggctaatttttgtatttttagtagaaatggggtttcaccatgttggccaggctagtctcgaactcctgacctcaggtgatctgcccacctcagccacccaaagtgctgggattacaggcgtgagcctaatttaattcacatatttaaatacttttatttccaaaggaggttaatggtaaatgtgatcatcaagtcaagcatgacactctgcttgtaaacacattgattttaaccagagttcagtgcatgtcctggctaggtgtggtggctcacacctgtaatcctactactttgggaggcctaggtgggaggatagcttgaggccaggagttcaagaccgtcgtggtcaacagagcaagaccctgtctctgcaaaaactaaaaaaaaaaaaaaaaaaaaaaaaaaattagctaggcacagcagtgtgcaactgtagtggcagctactcaggaggctaaggcaggagggcaaggctgcagtaagctatgatcaccctactgtactccagcctgggtgacagagcaagacaccattaaaaaaaaaaaaaaaaaaaaaaaagcatgtgtcctaaccaaaagatctctattgacccaaacttgtgcccaagaatagcaatcagaaaatttatgaaatgaatgatttagattcacattcaattgattcacaattgattttgattcacattcaaaaactgaaacaattcattataaagtttaccttactgttttatgaggtaaaattttattaggcaaattaagtaggattactatatatactaaaatataacaaataatctatatccagtacagtgtggggatcaggaactggggatctagaatcaaatgggcctgattcaaatcccatttttgcttcttaatctctagactgattttggttacttaacatctcaaagtctcagtttccccatctataaaataaatattacaacataaacctaataggatttttgtggggtccaaaggagataatgcatgtgctagaaacttaactttttatcctcctaaattcacacgtttaaacccttacctccaatatgcttgtatttggagataggacctctaggaggtaattaatgataaatgagatcataaggatggggctgtaatctgataaatttggtgaccttatgagaagaggaagaatgcatgtacaaagaagaggtcatatgagcacacagcaagaaggcggctgtctacaagccaagagaagaggcttcagaatgaaacataccttaccagcaccttgatcttggacttcccagtctccagaattgtgagaaataaatttctgttgtttaagccaccctgtctatggtatcttgttatggcagcctgaacagaccaatacagattttggtactgagaggaggagtattgctgtaacaaatacctaaaaatgtggaagtggccttagaactaggtaatgagtagaggctggaggagttttaaggtgtatgctagaaaaaagcatagacggctgtgaacagaatgttggtagaactatggatgttgcaggttattctgatgaggtctcagatggaaatcagcaacatgttactgcaaaatgggagaaaggtgttccttgttataaatggtaaagaacttgactgaactgtgttctagtattttgtggaaggtggaatttgttgagtaaaaaaattgactttttatctgaggagatttctgagcaaaaagttgaaggagtggctcagtccctcctgactgcttatggtaaaatacaaaaggagagagatgaattgaagaaggaattgttaagcaaaagggaactggaacttaaacatttggaaaattctgagcctttatgtattgcaataaatgaggaagcttgttctggagacaacactaagggtgtggctggactatctgtcactacttaagattacttatgatgttaaccagccatctgagcagaagtcaggaatagagtttggaaaaaagcagcagaaatattaccagtttggaccaaagagaacaggacagtatggtatagttatttggctgcaaacatggtttatctttcaagaaaagggaagaacgaccctgagggtgattcagagataaccagggctgccattcctactataggcccaaagtgcacaggcctggagggtaaggctgcctctaccttggtttcaaaaagtgagactgacatccaacagagccacataggtggggccatcaccctagccaaaggatgtggccaccttacagagctgtgggggtgatgctgcttttccagtgaacctgaagggcagaatattgaatcgaagaggattattcttgagccttaagagctaatggagtttgccttgctaggttttggacttgcttgggacctgtgacccctttatttcttccaatttctcccttttggaatgggaatgtctatcctcttcctgtagcaccattatattttggaagcacatagcttgtctggtttcatagtttcacagctgaaaataaattttgcctcaagatgaataatactgctagtctcacccacatctaattttatttagatgagactttggactttagattttaagttgatgctagaatgagttaatttcttttgaggccgttgggatggtataagtgtgagaaggacatgagttttgggggtcgagagtggaatgatatagactgaattgtgttcccccataatatgtttaagctctaacttccaacatgactgtaattggagatagggggtaattaaggttaaatgagttaaatcataagggtggggctctaatctgataggataatcataagtgtggggctccaatctgataggattgggggccttattacaacagaaaaggctgtctgagtacacagcaagaggtcagctactcacaaggcaagagaagagggctcaaaatgaaacttatgttgctggcacctcgatcttggactttccagcctccagaactgtgagaaagtaaatttcttttatttatgccattcaaggtatggtattttgttatggcagccaagcagactaatacagcaagtaaaactcttggcatgtagtagaaatcaattagacaaatatacaatatagatataaactgagtaatgggaaggaatgtttaccccatttaaaaggataagctgcttttaggaaaataaagttacaactaaggcactttggagatagtcctagtttacagaattttagagttgctcttccacaaaagtataatttaaaacaagcagcacttgtttttaattcatatattttttactattacttcatttataatatattatagggtaatatagtaatacagtcatgtgcaatatagcaacattttccttaacgacgaacagcatatacaatggtggtcccataagattataatggagctgaaaaattcctaccacctactgatgttgtagccattgtaatgccacagcacaatgaattacttatgtatttgtgatgacactggtataaacaaaccgactgtgctgtcagctgtataatagtatagcacaggccaggtgtgatggctcgcacctataatcccagcactgtgggaggctgaggtgggtggatcacctgaggtcaggagttcaagaccagcctgaccaatatggtgaaattctgtctctactaaaaatacaaaaattagccagccatggtggcatgcacctgtagcctcagctactcgggaggctgaaacagaattgcttgaacccgggaggcggaggttgcagtgagctgagattgcaccactgcactccagcctgggcaacagagcgagactctatctcaaaaaaaaaaaaaaaaaaaaaaaaaagaaagaaaaagaaaaagaaaaaaatgtatagcacagacaattacatacagtacacaatacttgataatgataacaaattactgtgttactggtttatgtatttactgtactatacattttatcattattttaaaatctactcctacttatataaaaaaaagttagctgtaaaacagcctcgggcaggtccctcaggaggtattccagaaggcattctggaatatgaatatcataggagatgacagctccgtgtgtgtgactgcacctgaagatcctgcagtgggataagatgtggaggtggaagacagtgatactgatgatcctgaccctctctgtaggcctaggctaatgtgcgtatttgtgttttagtttttaacaaaaaagtttaaatagcaaagaatacataaaataaaaattttgaaacagagaaaagcttatggaataaggatataaagaaaaacagttttgtacagctgtacaatgtgtttgtgttttaagcgaagtgttataaaagagtcaaaaagtttaaaaaaatttacaagtttataaagtaaaagagttgaagctaagattaatttattattgaagcgatacagttttttttttttgagacaatctcgctccgtcacccaggctggagtgcagtggcgtgatctcgtctcactgcaacctccgcctcctgagttcaagcgattctcctgcctcagtgcctcagcctcccaagtagctgggactacaggtgcgtgccaccatgcctggctaagtttttgtatttttagtagagatggggtttcgttgtgttaaccaggatggtctcgatctcctgacctcgtgatctgggaaatataaatattttaaaataaatttagtgtagcctaagtttacagtgttcataacattctagtagtgtaatgtcctaggccttcacattcactcaccactcactcattgactcacccagagcaatttccagtcctgcaagctccattcatggtaagtactctcaacaggtatagcattctttatcttttatactatattttactgtgccttttctatgtttagataggtttagatacacaaataccattatgttacaattgcatacagtattctgtacagtaacatgctgtacaggtttgtagcctggagtaataggctataccacatagcctaggtggtataccatataggtttgtgtaagtacagtctatgatgtttgcacaacaacgaaatcacctaatgatgcacttctcataatgtatcccccttggtaagtgatgcatgactgtggcaatattatattgctatacattataatagtaattttataaaaatatagttatattcaatttatagtattatatccttatactattgccattatatttataacaaatattattaatattaataattatttatgtgggcctgatagtgtattatcccagtgaaatgttttcaccttaagtttcgatatgtacttaaaaataagtctattgtttgttaaaactatctaataattcatggttttatcaattacaacaggtccctgttgtagtttctttctgtccaaatggtctctcaacttgacaaatctttaggagcatgaatttccatatttcaaaaaatgaaaagataaagaaatctcactggaaactgtggttgggcagatacaatatggagacaagttagattcactatgctttacttcctatgaatgcaatgacaccatatacgtgtgtcctagtatatgtgacatttatatgtaatattaagctcaaatttaaagtatccattgttcttttggaatctttcagtaatggaagtttattctttcacaggtatcacggttacatttatacataccgagtgtcccagacagaaacaggttcttggagtgctgaggtatagttgtatttatttttgcttctgggggtgtcaaggaggtatttgaaatttaggctggttttataaaagagcaaattatacattattaagtattcataaggtttaaatctctaaagctccaatccaaaattgttcatggatcattaagaaagctttagagaattttggtcccagtcctgtttagccatcattttgcagagttgtatgactttgggagaaagataaaaaagttgaagaattatgtcaaacttttagtgactatgtgaaatcttagcatatcaaaagtaggtaaaataattaaatgaacaattatttaccaaatgataccaatatgagtattggtatcgtgggagattaaaaaacatgatgcttattttctaagagactacaatatacttgggaagttataacttgaaattaaacagttatgagtggaagaaactaggctttgtcaacaggtgaatctgggttccaggtctggtctcccctcctctctgataggtctatgatcttgggcaggttacttgacttttctgtgagccagtttcttcatttgtaaacggagcctaagaatcctcccttatgcacaaggctcaatttgaaaagtaaataagataacacacataaagaagctgtttgccacaaggcctggcacacagtgagccctcaaaaaagtgaactcctgaaaattgccacaactcctattaataactcaatctgtgcatttaaaattttctgaagtctagacttcaagaagttaaaatagctctcacgtttactgatttatcagtaagttggaaagtataaattacagaccacaaatgttttgaaccactgagatgaattaggccaagttttcaaacacacttttgctgtattatgtaaggatcattaaaactataatactaactaaagataaagttataccatttctaattgaaactatttatacctgtttatttaaaaaattctctgtatcactgcagagatgattgaataagaaattaaactttattatgaagaaagttatgtgtaaaatatactgacaaacacacacacacacacacacacacacacacacacacacacacacgtttgtatattatttcgccagaaatagctcttctccccagagaaatacccttcagctgctgaagaatattatgtaaggaaaggatcttaaatgcttagggtttaacaactttgtttttcaacttgttttcctgcattttgagtataacatcatatgagattgttacatgcttgtgatcatgttaaagaagagagggcttattgaacacaaatgccccctcatcctgttgtctgatctgacgttgtttatgtaataatattgtaattttctgcaccaagagagcagaagattggcatgacatccgcaaatagaaaatagtttaaaaaattctttaatttttgaaatgcatattgcatttttttctatctactaaatttaccttcttagcagtgcttttctaaggtgaaaattaaactagtgtatattctcagagctcataccacctgactggaaaaaatttctctagagcatattgaagaccagctgtgatctaatacatgtttccatggataactaagaggtgacagtatgggagatttgcaaatttgaagaatagctgagttcagtgacaggatgagagttgtcagtggtacaattcttgtgataaatgtattttcgaaactgggtaaatgatagatattaatactgatttttggaacaatgttttagtttgccatgctgcaggaaaaatcaaggcagtagcatgccaccatctgtgcatatattatgctagaaatctaggtaagtgagatttgttttaaagagtgtaatgaaatcaaaccctggccccactgaattatgaaagacagatatcatgtgtttttctagttttagagagacttttaggttaaatctttgcctagtgtattatcttatatgactcagactaaaagtttgttacattgttaatttagataattccacaatctactttcatttattaatatgtgatttgttggcaatacattattaaaaatgtactgacatcaccctgttgacatcagtgtcttcaggctttactgggtatatgatcaggagatcagcagatgttaaataattgtccttattaatctaagtaaaacactgtaaaataggccagtcatttgcttatgaaacatcagatccccaattcaaatagcttccatacttccagtgctattattcatttctgttagcatggataatcaagtgttagctacatatcagtacccataaaaatgttgcttctctgttttgttttgttttgagacagagtctcactctgtcgctcaggctggagtggtggaatggcccgatctcggctcactgtaacctctgcctcccaggttcaagtgagtcctgtgcctcagcttcccaagtagccgggattgccaccacacctggctaattttcatatttttagtaaagccaggctttcaccatgttgcccaggctggtcttgaactcctgacttcaggtggtccgccggtctcagcctcccaaaatgctgggattacaggtgtgagccactgtgcccggctatgcttctgttgataaatgactttacaagccacaagaagctaaaaagatgtgtggtttgaaatctttccacactttaggtgtgtatagtttttcttctgtttgatgaccctagcttcgctagatcctgtttggcccagttctaatctgaaaggcaagagactgggtcctgggattctgagccagttctgcctctggttgtctgtgtgactttgggcaagctgattaatttctttgcattcatattttcttatctgtcaaatgggaataactgaatcagccaataactgccattttgtgaggaaatagtgaaggcaagagataggaatgtgctttgaaaatgaaaaagtgcactgaggaaagtataaggaggcaatttgtgcctatgacctgcatttgcaatttggagactctatcttggaaccaacgaactgtttggacttctgcaagaatggccatgttattttggatgagttctcaatcgagctttaggaaggtggagggtaggtgagagagtggggtggagctgggtgagagagtgttctacatctactgtgaacatatgggggaacactaatatagagctaaaaagaatttttgtcatgttttcaatgaaaaattaccccaacataaggaaatgactgagagttactatggatagtgtagtatgctatcttcagcataccactatctagctgacagaagtcttcatgctcgccttcatgttttctcattaaatgctaaaaaaacaaacagctcccacctcaaaaatctaccagatggaatagctgaaaaacaacttaaaaaaaaaactagtcattgttcaattgctcatagcaatactattttattttacgtaaaatgacaggtttgagctgatgcctgaagcttggctcataagcttttgcaggaaattgttgttgatttcaggcagtgtctttgcaagacaactgatgtcaggaaaggaacacattttaatagtcacctgcaaataactgtctctttaaaaacacacaaataaataaataaaggtgaccttatatagtctttcattttcatgtcatagagaaaaccttgttacagtgacgtgctgatggagagaacaattttgggagtatagggaagtttcccaaggaggaaaaaatttaatgtgaagaatggcgcaggaaatattgtgaggtgaaagagtatgaggactgaactagccgtgcactgtgtgcatcataacagccaatttttaatttcctgtgtagcattttatattgtgggatgatggcagggaggatgggttgttggtttttcttttgttgttgttcctcaggctttttattaatgacctgtaggatctgtttttttgtttttgtttttgttttttcctgtttaactgcatcccctctgttggtgaattcattgtgggtaatggcctgtatacccttagaggtttgagatgtctgatggggagcaggcaggaagggcagggcaatgagcaagagcttgtacaaactaataccacctttgggagaactgaaatgacagctcattagctcctcttgcagggaaattcagccaaccaaagtaagctcttctggaatgttgtttttccttcttccttatgttttcaaatatttcaacaagttacacaaatgttacttctcttagcatccctagcacattttgtaggtctttttgtatcattatgagataggtaaataatttgcttggccttttattttccagacagcacctggggtacataaaagatatttccggaaaataaaaaatctcatttcagcatttcagaagccagatcaaggcattgtaatacctctgcagtatccagttgagaagaagtcctcagctagaagtacacaaggtactacaggtatgatttcctcttaatttttgacagggtttggaagctcagagttatgagtcaacctgttcataaccatataatcaattagaagttatgtaagaaaaatgcagtgagaaagtagatgtagccagcaagtcaaatgagaggtgacaatttatgtgctataattttcatctattattctaataacttttaataaatctctgtaaaaacatcaaaaattctataagcccataacattttaactgctcttgtctgtctcatcttgttctttcctgtccctttaataggtagctaagtatgatttcacttcactaattcagacacaaataatgtgaaagatggtataattcagagaacacctgggctgtcctttatctttgcttagtaaactgttttttccttcagggacatgaaagctaacgttagcctggcacacatgattctgatttctgaattggtggtgcttgaattaatgacatttttctgaagcaaaggaaattaaatagtgcactttattgttccactggcacatattgttacatatcctgagcaaacctattttagtgtatgtgtcgtgctaaagactgaataccagccaatgtctgtagctatctgatacgtgactgtttactcctctattgaatggggtttatcatttgtttggagtaagaggataggccttgattgaaacaataaatatttatgataaaagaaaacgagtccctttttgacagggacctaggctcaggcataaactgacaattagactcaagtggtgaattaaattaatgaatagttagcctttataatacaaatgcaaatagagctctaatttccaagttggctagttgtttttttctgcctaatattccattctttataactcagttttaaataatagttgcttgaggtatattactgtgttgtgtcattgtgagttttatgcagttggaaattttataagtttgagttaatctgtaattttaatagtttgtaagtttattttttcttgatttttgttatttttctttagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttacctaa

SEQ ID NO: 1970 - DNA, 26879 bp, Homo sapiens; identical to SEQ ID NO: 1969

SEQ ID NO: 1971 - DNA, 5605 bp, Homo sapiens
ttgctggctcttaagggtctttaatggtttcattttgtggcccttccccccaaccctggtgactgtcccagcaagcagtcagtagaggtccccggagttcagtgggggcctggagatgtcggacttgtgagggaagggccactctccccttgtaacctgtgggggaggagctgggtcattcctgtggattctgccctgccccccacctcccctgcctgtgccacctctggtacctctggtggctgctaggtggaagctgcagcaagggggtcccaagtgcagggcctctgggtgctacacatctcacagccagggcggtctggggcattgatgaaggtgcaggaaggacaggaccagctgggctgggggaagagagacagttgttgcttccctgctctttccaatgcccatggctgtcctggccctccctgcccagtcccgtgcccacctggagtggactgggcaggctggaggcagctggctgggggcctgggggtagccccaatgatgggggaaacaagcgtccaagttccccgtccatcttctgggggtgctgagggctaggtcctgtggctgagggggtggagctcaggactgtggggctgcaccccacctcccacaccccacccccatcgaggactgacctggggcttctcgaggagctgacagcaagtagaggaaagcagggtccccatcctgccgaaccccgtaagaggcaaggctgcgctcaggcacacacaggcaccgtccgatgacccagcgttgcacggctggcgggaaaccgagctctgagaacacctgtggccagagcatcagggcaggtgatgtcacctaggctcctctgcccctggcagggctccccagaccctgtgcccacctgctcctggagagctgcaacagtgcagtgggggtggacctgcagggcaacgtgtgcagaggacgcggcggatgcggcagaggcagcgtcttcaagtgtgacctgcagcctgtgccagaatgtgggttcagggatggatgggggacctgggatggtcacgaggacaaggtgaagaagcagccccaggcctcacctgatggggccaggtgggaagcaggcctcctgaagctgaacactcagggccacacgatgctgggccaggacggctgccacttgggctgcccccttctcgtctccacctgcaatagcccgggccaggctccctgccagctcttctgcagggtaaggaaaggacagctgtcaccactggggactatctgctatccccgaaccccccaaccccctccccccacctgtacctctctccgtcaagtttccagggctcctaggaagatctgcctcaggtggagggcccttgagtgtggaggcttccgggggactgggcagggagacagggcatgcttctgggcccaaggctggtggtgagttgctcttgctgcctagaggtaagatatgggtgtgctgtgctgtggcctctgtccaggcctctaggcccttggttttccaggacctttgccttctccctcacctcagtccatgccagggccctgcctcaggccacacttctagccacaccttctcccagccttggctctggcaagaccctcagaggcccctgccagacttctgttagtgctggagctgcacttagttcatatttgggaattagagccttttcaaacccttttgtgcctggctaggccacctctcttggctctttctgccagccagggatgcctcacagcagaaccaaagcaggccctcagtggccctgcagtcagggtggcctcttggagcccttggggacctcccctctccgggctccctgacccacacctgggctgccagcactccagacaagccactgccctgggcgtcttcagagctgagcaccctgctgactcaccttcttacccgccctgtgaggcccagcccactgcaatgggggggtccccatccagtgctgacacagctcccgtggtctcaggcccactatattctaccatctccctactaggataagcagggccttccacgcacccagcgctgttcctggccccggccccggccccggcccccactgaacctcaaggatcacttatacatgctcacctcagggtttgtttgctgcttccttggtcacatggttcatgccatgaccttcaaatttcactccagtgtcacctcaatgaggccttccctgccaccacttttttttttttttgagacggagtttcactcgttgcccaggctggagtgcagtggtgtgatctcggctcaccgcaacctccgcctcctgggttcaggcgattctcctgcctcagcctcctgagtagctgggatcacaggcatgcaccaccacgcccggctaattttgtatttttagtagagacgggatttctccatgttggtcagactggtcttgaactcccgacctcaggtgatctgcccacctcggcctcccaaagtgctgggatgataggcgtgagccaccgcgcccggcccctgccaccgttttaaacagcaatcctcccagctccaccattctcattcccacaccatctaacagactttcttttttaaaaaactctacagtaattttattatttttgtttttttttttggagacaggatctcgctctgtcacccaggctggagtgcagtggcacgatcacagctcactgcagcctagaacccctgggctcaagtgatcctcccatctcaacctcccgaatagctgggattacaggcagacacgactacactcagctaatttttttttttttttttttttgtgagatggagtctcgctctgttgcccaggctggagtgcagtggtgcaatctcggctcactgcaagctccacctcctgggttcacgcccttctcctgcctcagcctcccgagtagctgggactataggtccccaccaccacacccagctaattttttttttttttttttttttttagtagtcagggtttcaccgtgttagccaggatggtctcgatctcttaacctcatgatctgcccacatcggcctcccaaagtgctgtgattacaggtgtgagccaccgtgcccggcccactcagctaatttttaaattttttgtatgttgcccagccctgtacttattttatatgtctgcctcctcccctctaaaaatgcaagctccaataggatggggatgggaggttttgttcatgccaaaggagtacctgggacagggcagctgctgaatacatatgcttggtgaatgactaaagagagcttagctccttttataaaccctgagttgcttgagtctctcttacatcactgtctggctgtcttcctacccctctggcagctctgcttatctcgtttgtgggctgccctctatctgggagccccatactacctagtccttcatgtttctcagtctcaactgctaactcttccatttaagcagccatgtgagccaggggcagtggctcatgccaataacagctacttaggctgaagcaggaggatcaccgtagaccaggagttcaaggctccagtgagttagggtcacgctactgcactccagtctgggtgagagagggagtctttgtctgcaaaaaacctcccaagcagccatgaaactcagctaattccatcttcttttttttttttttttgagatggagtcttgctctgtcacccaggctggagtgcagtggcaagatctcagctcactgcaacctctgcctccgggttcaagtgattctcctgcctcagcctccccaagtagctgggactacaggcacacgccaccacgcctggctaatttttgtatttttagtagagacagggtttcaccttgctgaccaggctggtctcaaactcctgacatcaggtgatcacccacctcggcctcccaaagtgctggaattacaggcgtgagccaccccacccggccactaattccatcttctaagcatctctagaaacatccttctccccaaccctatctgcaccaacccttgccactgcagaactctgtcttaagcaggaggtatctgagtctgtcactctcccactcctgtcactctcctgctgctcttgggatgatgtcttctcacacaggtcctgaccctgcctgctctgcctcttcatgcttgcctctcatccttcctgagggttaaggaagtgcaggctgaggttccagggcttcctggtggaggctgcaacttgtgctggctggggcctcagatggtgtaggagactgactccagcagccactccaagtactccaagctactccaggctccacctactccctcctggaagccttcccagacatccagcagtggggaaggtggatccaacttccccaaccaggactggggggccaaggctattccaaattgtaattgtatccattacagggcactgaccattctgtccttccacggtggcacctcggactaggactgcccaccgctgagcttcctgagggttgaggaagtgcaggctgagggttccaggccctcctggtggaggctgtagctcgtgctgggtggggcctcggatggtgtaggaaactgactccaggggccactccaaattaacctgagaagagggagagtccaggctcagggcgtccccccgccctacatcgcacgaggagcaaagaaatacaaggtaacatttatagaccatttacacggtcctaagccctgtacgcctatcatcaaatcctcacaatagccctgtaaagtaggtccaggtaggtcccagtaggtccgagcgtcacccccatttcacggacgagaaaacagaagcaaagaaacataactgcttaagggcacccaggtggcaagcggaggggcctaactttgggctccgtgccctgcccgggccaagaggactgaccgcgcgccctccgcccccactcaccgccccaggtcccgcgcccagcagctccagccggaagcgcccaggccgctcagggtccgcgctcagctgcagcctccgcagctgtgcctcggcgtctggcccggcgcccagcggcctcaccgcggcgtgcacagccaagagcactgcggcggagcccaagtccgaggccgccgccgccgccccgcccgctggcggcgccatctccggtccggccgggtcccacccctccgagcgcgcttccgtgggatcgggccgctgagccccctccgccggtcggaaacacgggccgcgaacctggggttccgggcgcgcccagagcgtcgggcctgggacggcgccgagtggtgcactctggccaagcctgccccgctggctttgcccacaaatggacacggcccgagggtctccggacaccggctgggcgaggctggcggcgtgtacgaggctggggcagggcggccgaggcgctcacgttagagctggtctttgggggcgaagggtcagggggcgaagcaccggccacaactgaaggcggacgcggcctcttcgccccaggggctcggcggacgtagatgcatccagcgtgcgactatcccagcgcctaacggcagctggacttcgctcccgggacctccaatgggctgccaccttcgcccgcagaccccagcccccgccacgcccacac

SEQ ID NO: 1972 - DNA, 5599 bp, Homo sapiens
tggctcttaagggtctttaatggtttcattttgtggcccttccccccaaccctggtgactgtcccagcaagcagtcagtagaggtccccggagttcagtgggggcctggagatgtcggacttgtgagggaagggccactctccccttgtaacctgtgggggaggagctgggtcattcctgtggattctgccctgccccccacctcccctgcctgtgccacctctggtacctctggtggctgctaggtggaagctgcagcaagggggtcccaagtgcagggcctctgggtgctacacatctcacagccagggcggtctggggcattgatgaaggtgcaggaaggacaggaccagctgggctgggggaagagagacagttgttgcttccctgctctttccaatgcccatggctgtcctggccctccctgcccagtcccgtgcccacctggagtggactgggcaggctggaggcagctggctgggggcctgggggtagccccaatgatgggggaaacaagcgtccaagttccccgtccatcttctgggggtgctgagggctaggtcctgtggctgagggggtggagctcaggactgtggggctgcaccccacctcccacaccccacccccatcgaggactgacctggggcttctcgaggagctgacagcaagtagaggaaagcagggtccccatcctgccgaaccccgtaagaggcaaggctgcgctcaggcacacacaggcaccgtccgatgacccagcgttgcacggctggcgggaaaccgagctctgagaacacctgtggccagagcatcagggcaggtgatgtcacctaggctcctctgcccctggcagggctccccagaccctgtgcccacctgctcctggagagctgcaacagtgcagtgggggtggacctgcagggcaacgtgtgcagaggacgcggcggatgcggcagaggcagcgtcttcaagtgtgacctgcagcctgtgccagaatgtgggttcagggatggatgggggacctgggatggtcacgaggacaaggtgaagaagcagccccaggcctcacctgatggggccaggtgggaagcaggcctcctgaagctgaacactcagggccacacgatgctgggccaggacggctgccacttgggctgcccccttctcgtctccacctgcaatagcccgggccaggctccctgccagctcttctgcagggtaaggaaaggacagctgtcaccactggggactatctgctatccccgaaccccccaaccccctccccccacctgtacctctctccgtcaagtttccagggctcctaggaagatctgcctcaggtggagggcccttgagtgtggaggcttccgggggactgggcagggagacagggcatgcttctgggcccaaggctggtggtgagttgctcttgctgcctagaggtaagatatgggtgtgctgtgctgtggcctctgtccaggcctctaggcccttggttttccaggacctttgccttctccctcacctcagtccatgccagggccctgcctcaggccacacttctagccacaccttctcccagccttggctctggcaagaccctcagaggcccctgccagacttctgttagtgctggagctgcacttagttcatatttgggaattagagccttttcaaacccttttgtgcctggctaggccacctctcttggctctttctgccagccagggatgcctcacagcagaaccaaagcaggccctcagtggccctgcagtcagggtggcctcttggagcccttggggacctcccctctccgggctccctgacccacacctgggctgccagcactccagacaagccactgccctgggcgtcttcagagctgagcaccctgctgactcaccttcttacccgccctgtgaggcccagcccactgcaatgggggggtccccatccagtgctgacacagctcccgtggtctcaggcccactatattctaccatctccctactaggataagcagggccttccacgcacccagcgctgttcctggccccggccccggccccggcccccactgaacctcaaggatcacttatacatgctcacctcagggtttgtttgctgcttccttggtcacatggttcatgccatgaccttcaaatttcactccagtgtcacctcaatgaggccttccctgccaccacttttttttttttttgagacggagtttcactcgttgcccaggctggagtgcagtggtgtgatctcggctcaccgcaacctccgcctcctgggttcaggcgattctcctgcctcagcctcctgagtagctgggatcacaggcatgcaccaccacgcccggctaattttgtatttttagtagagacgggatttctccatgttggtcagactggtcttgaactcccgacctcaggtgatctgcccacctcggcctcccaaagtgctgggatgataggcgtgagccaccgcgcccggcccctgccaccgttttaaacagcaatcctcccagctccaccattctcattcccacaccatctaacagactttcttttttaaaaaactctacagtaattttattatttttgtttttttttttggagacaggatctcgctctgtcacccaggctggagtgcagtggcacgatcacagctcactgcagcctagaacccctgggctcaagtgatcctcccatctcaacctcccgaatagctgggattacaggcagacacgactacactcagctaatttttttttttttttttttttgtgagatggagtctcgctctgttgcccaggctggagtgcagtggtgcaatctcggctcactgcaagctccacctcctgggttcacgcccttctcctgcctcagcctcccgagtagctgggactataggtccccaccaccacacccagctaattttttttttttttttttttttttagtagtcagggtttcaccgtgttagccaggatggtctcgatctcttaacctcatgatctgcccacatcggcctcccaaagtgctgtgattacaggtgtgagccaccgtgcccggcccactcagctaatttttaaattttttgtatgttgcccagccctgtacttattttatatgtctgcctcctcccctctaaaaatgcaagctccaataggatggggatgggaggttttgttcatgccaaaggagtacctgggacagggcagctgctgaatacatatgcttggtgaatgactaaagagagcttagctccttttataaaccctgagttgcttgagtctctcttacatcactgtctggctgtcttcctacccctctggcagctctgcttatctcgtttgtgggctgccctctatctgggagccccatactacctagtccttcatgtttctcagtctcaactgctaactcttccatttaagcagccatgtgagccaggggcagtggctcatgccaataacagctacttaggctgaagcaggaggatcaccgtagaccaggagttcaaggctccagtgagttagggtcacgctactgcactccagtctgggtgagagagggagtctttgtctgcaaaaaacctcccaagcagccatgaaactcagctaattccatcttcttttttttttttttttgagatggagtcttgctctgtcacccaggctggagtgcagtggcaagatctcagctcactgcaacctctgcctccgggttcaagtgattctcctgcctcagcctccccaagtagctgggactacaggcacacgccaccacgcctggctaatttttgtatttttagtagagacagggtttcaccttgctgaccaggctggtctcaaactcctgacatcaggtgatcacccacctcggcctcccaaagtgctggaattacaggcgtgagccaccccacccggccactaattccatcttctaagcatctctagaaacatccttctccccaaccctatctgcaccaacccttgccactgcagaactctgtcttaagcaggaggtatctgagtctgtcactctcccactcctgtcactctcctgctgctcttgggatgatgtcttctcacacaggtcctgaccctgcctgctctgcctcttcatgcttgcctctcatccttcctgagggttaaggaagtgcaggctgaggttccagggcttcctggtggaggctgcaacttgtgctggctggggcctcagatggtgtaggagactgactccagcagccactccaagtactccaagctactccaggctccacctactccctcctggaagccttcccagacatccagcagtggggaaggtggatccaacttccccaaccaggactggggggccaaggctattccaaattgtaattgtatccattacagggcactgaccattctgtccttccacggtggcacctcggactaggactgcccaccgctgagcttcctgagggttgaggaagtgcaggctgagggttccaggccctcctggtggaggctgtagctcgtgctgggtggggcctcggatggtgtaggaaactgactccaggggccactccaaattaacctgagaagagggagagtccaggctcagggcgtccccccgccctacatcgcacgaggagcaaagaaatacaaggtaacatttatagaccatttacacggtcctaagccctgtacgcctatcatcaaatcctcacaatagccctgtaaagtaggtccaggtaggtcccagtaggtccgagcgtcacccccatttcacggacgagaaaacagaagcaaagaaacataactgcttaagggcacccaggtggcaagcggaggggcctaactttgggctccgtgccctgcccgggccaagaggactgaccgcgcgccctccgcccccactcaccgccccaggtcccgcgcccagcagctccagccggaagcgcccaggccgctcagggtccgcgctcagctgcagcctccgcagctgtgcctcggcgtctggcccggcgcccagcggcctcaccgcggcgtgcacagccaagagcactgcggcggagcccaagtccgaggccgccgccgccgccccgcccgctggcggcgccatctccggtccggccgggtcccacccctccgagcgcgcttccgtgggatcgggccgctgagccccctccgccggtcggaaacacgggccgcgaacctggggttccgggcgcgcccagagcgtcgggcctgggacggcgccgagtggtgcactctggccaagcctgccccgctggctttgcccacaaatggacacggcccgagggtctccggacaccggctgggcgaggctggcggcgtgtacgaggctggggcagggcggccgaggcgctcacgttagagctggtctttgggggcgaagggtcagggggcgaagcaccggccacaactgaaggcggacgcggcctcttcgccccaggggctcggcggacgtagatgcatccagcgtgcgactatcccagcgcctaacggcagctggacttcgctcccgggacctccaatgggctgccaccttcgcccgcagaccccagcccccgccacgcccac

SEQ ID NO: 1973 - DNA, 10952 bp, Homo sapiens
cgtagcgcccgcagagcaacgcaaagaggaagaacagagaaacggctatgagaaaaagggccgaagagtgagaagcagagggccttacccgagggggcggcaaccgggggccccacggtctccggccgcgcccgcgctggccgctgatagcgggctcacaacgatgacgtagcgaggagcggaaaacgcggtaaccaaggcggccccaggcgcgcacttccgcccggccttccaccggtccaggtctgcccctccgcagcgatagttcacgctctcggcggggctgtaccggaagttgcctctacttccgcccgttccggggcggggcttacttcgcagcgactacttgccgcacttccgggctgccaggcagctgctgtggctccaggatgatggagacagagcgacttggtgagggggaggggagggaaatggaacggagtagccgatatggaatgaactttgacccctgacttttgacctttccccgtagtgctaccccctccagatcccctggacctaccccttcgggccgtggagctcggatgcacggggcactgggagctgctgaacttgcctggagctccagagagtagcgtgagtgacttttgaccctaacctttgacccgcattgagtccaaacctccttcaccctcctcacagtaggatctagcttaaccttgttcatctgtgcctgtactcctgtccatcccagcctgaaggggtgctggacagattacagcccagtgtacctgcagtacatgtgaggacagagcagaaagggctggggatatttttgctttgagagctgctctttcaaatgtggcatttctccgtggagctcccttctgtatccaagcaccagggcacttggtgactgagatgataggctttgagcctccaacctttcatccttaggtctgggacccctttttctaaaatcagtgagtctccaatttcagtgtgcttcatgattagccagggagctttttaaaaatgcacattcctaggtccagcctccatgtttctgaaatccaaaatctgccccaggtaattcagtagcaggtagtttttggccaagcctgattgtcctagtctgtttgacacatctgccatttctgatctgaacacaagtcccatcatctcttttgtctgcattttatcctctttccttacctaatgcctctcatcttgcccttgtttcagcttccccatggcctccctccttgtgccccagatctgcagcaagaagcagaacagttgtttctgtcatccccagcctggctgcctctgcatggtgtggagcactcagcccggtgaggagtctggaggggcttagactagggtgatgggttcctgaaggaagctgggacagaggaagaaagaagacccaaaagttactatttttctctccagaaaatggcagaggaagacggatccctggtctcttttggctgtcctgggagccccagtcccatccgacctacaggcccaaagacacccaaccacaggccagatactgggttacaaagaggtaggaggtcaggggtcatgagaaacagttggggagaaggggaggtggtcagagacaagctcagcctcattggggctctgatctcttgccttaggtcttgctggagaacacaaatctctcggctacaacctccttgtctcttcgccggcctccagggccagcctcccagtccttatggggaaatccaactcagtatcccttctggccaggtgactcttgtggagatgggatggtagaagagggtgtctttaatctccagggaagggttccccacctatctcgtattaccctcatcccatgaatccctgtctgtcctgtctcttcccaggggggatggatgaacccaccataacagatctgaacacacgggaggaggctgaggaggagatagactttgagaaaggtaaggtggggctctgagtctgagccttgaggaggaagagcccaggctatcactgggctactgctagccctcccatgtttttgagaaaattagaaaaagatattctgtccataacaacctttactgtcatctgctgggaaatttctacaacaacctttactgtcatctgttgggaaagtgtcatagcaaacatccctatctacagcatctgtcctgtaaatggtatcttttaggtttatataatgtacacaatttgttcaccagtgtgcagtgacctgatttcatgtccctatcctacagatcttcttactattccacctggtttcaagaaaggcatggactttgcaccaaaaggttagttttagtttttgagtggggtgtaggagaagtcatgtccttctcctaaggaacagagatggacatgacaaggttgaccttgttggcttgctcctcagattgtccaactccagctcctggactactaagccttagctgtatgttggagcctctggatttgggtgggggtgacgaggatgagaatgaggcagtgggacagccaggaggtcccagaggggacactgtttcagcctctccctgcagtgctcccctggcccgagcaagcagcttggaagacctagtgttgaaggttggtggttctgtgtagtggaggcaagaaagagccttgccaccaggatgtgggctggctaggatgggtctgaggggaagaaagggacatcttttgggaggagtgctaattgagagccctctggttgtatctttatcactgctacccctgactcttccaggaagcgtccacagctgtatccaccccagaggccccagagcctccatctcaggagcagtgggccatccctgtggacgccacctcccctgttggtgatttctatcgcctcattccccagccagccttccaggtactttggccccatcttcacacgctcctctacctctttctgggtcacactcccagccgaccccttgtctcctctattggccagaggtcagatccatcccaggccagtcttggtactcagtcccagcctcggctggctccggccttcatccgcccgccctgcgtgctccatgagcaggaggcagcaaggccccgctcctttcttcagctcctgtctatttctctctcccatagtgggcatttgagccagatgtgtttcagaaacaggccatcctgcacttggaacggcatgactctgtctttgtcgcagctcacacatctgcaggaaaaacagttgtggctgaatatgccattgccctggcccagaaacacatgacacggtatgagttcctttgccaacctcccccttcaccagccagccccattttctcctgcatcctttgaaaatctcatctcttcccccacctctctagctcatcctttaagtgagaggttcagggctaagactgagacaagagcccagagagaaatgaaaagacatggtggggagaaagtttagaagaatgacctgggttagtttaggaaggggttggggacagaatttttctggggttatatcatgcaggagaatgtaagggcagtttgggtgaagaagaggagcacctgagcttctggggcatgcttccacgagggctccatgtgggagaggaagtgcgggccatgagtctgcggagggactggctaacttcatgctctcttcccagcaccatctacacttcgcccatcaaggccctgagcaaccagaagttccgggacttccgaaacacattcggggatgtggggctgctcaccggggatgtacagctgcatccggaggcctcctgcctcatcatgaccacagagatccttcggtgagagatggacactcaatacaggggagttttggctgggaagatgtggccgttgtggagagtgtgctgtctgaggagggggtggagacgagccactggggagtcaatccttggcctcttctccccagctccatgctgtacagtggctcagatgttattcgggacctggagtgggtcatctttgatgaggttcactatatcaacgatgtcgaggtaagggccatgggctccccagaacccggcagtcctctcctttgggaccagttgagcgtctcccttattccacacactcagggccccttactgctttctttacccccatatggaatcctgtgcctctttatgggcagaagggcggcccctgccctcatgtgacctcccttccctctctgtgcccagcgtggggtcgtgtgggaggaggtgcttatcatgctacctgaccacgtttctatcatccttctgagtgccaccgtccccaacgcccttgagtttgctgactggattgggtgagacgtgtgtcccgggttgcctgggtgaagggggctacagtactccttgattcgggtgggggactaagtctaccacagcaaggagagcggtcaggccttaggggtgatgctggggaacatgtcccacctggtggctgtgggatcccctttgggtccagattactttgcatgttgaaatgggatgagatgttgggggatagccttccattctgggtctcagaaaagactgggtaaagttggaggggtagggaagggggtggggatgtgggttccttcccacgttcccacccctgacctgcttccctctcctttcttcaggcggctgaagcgtcgtcagatctatgtgattagcactgtaacccgccccgtgcccctggagcactatcttttcacagggaacagctccaagacccagggggagctctttttgttgctggactcccgaggagccttccatacaaaagggtaagcctcgagatgggggaaagagttagggctgggcccccagctggacattgtggctacccctccctgtgccccaggtactatgcagctgtggaggccaagaaggagagaatgagcaaacacgcccagacctttggggccaagcagcccacacatcaggggggccctgcacaggtgagaactgggagggttttgtacctgccagcacctgtttttcctcctatcttttttttccccttgtcccccaggggttttgacttgagctttgagcactgccccagttaacactagctcacctctcattggttcaggaactcaacctctgctccttccccttccccttccttctccaggaccgcggagtgtacctgtccctcctggcctccctccgcacacgtgcccagttgcccgtggtggtgttcaccttctcccggggccgctgtgatgagcaggcctcaggcctcacctcccttgacctcaccaccagttcggagaagagcgagatccacctcttcctgcagcgctgccttgctcgcctccgtggctctgaccgccagctgccccaggtgcgtctgtgtgcgtctgtgtgcgtgcatgcacacatttggcagactggtggggatagggtgttccgagactccatccctgaccatgggcctcctcccaccaaaggtcctgcacatgtcagagctcctgaatcgcggcctgggtgtgcaccatagcggcatcctgcccatcctcaaggagatcgtggagatgctcttcagccgtggcctggtcaaggtgcatgtggtggtggaaagggactcctcagggtgcttgttgcccacttaggggctgcccagagggcagaggggcagaggtttaggcaggccagtgctgtggttaagaatctgggctctggattcagactacctgggtttgaatcccaggtacaccatgtattcacagtatcatcctggaccaattatttaaccttcctgaactttaggtttcccatcttaaaatggggatgcataagatatgaatacgtaggtctcagaaaagaaacccaggaagctagcaagcattcgaaaagttattagtaatcagaaatatacaaattgaagtactcacaagatacgactttacagctattagactggtaaaatttaggaaactagttcatgccgagtgttgccagagatataggaggttgtagggttctgggaatcctttacgggatgcctagccagtttggaatgcacgctggcactatttagacaaaataactatattggccgggcatggtggctcacacctgtaatcccagcactttgggaggctgaggtgggtggatcacaaggtcaagagatcgagaccatcctggccaacatggtgaaaccctgtctctactaaaaatacaaaaattagctgggcatggtggcaggtgcctgtagtcccagctacttgggaggctgaggcaggagaattgcttgaacccaggaggcagagattgcagtgagccaagatagcaccgctgcactccagcctgggcaacagagggagactccatctcaaaacaaaaacaaacaaagaaacaaacaaaaactatatcatactctgagcttatatttcattcctgggtatatatcacaaagaaattctcaccctggtctgtgagagaacatgtacacccatcctttgtttgtggtggcatggtgttggtagtaccagggtgcccttcactgggagagagggaaggttagtgtgggggatgcacccatagagtgttctgcagcagttggaagcagtgggttagatgtggccacaggaacatggacagatgttgaaacactaggtggagaaaaagaagcaaaaaaaaatcagatatataaccactttttatatgaattataaactacaagctcacaaaagaagacatgttctataagatcatatttatataaaaagatatttgttggatacattggaatgattgcagtcagggatgggaatgggatatgaaggtaaaagttaagaaatagaaataagtagctacataagtaaaatgaggaaaacaataatacctgccctatagatttgcctggagagttcagtgagatcccataagtaacaactgggatggtgccttatgcctacaaagtaaggtgggcttggccagggctgggggtgtgtgtatgtagagcctttgctgatcctttctgttctcctctgtcccaggtcttgtttgccacagagacctttgccatgggagtaaacatgcctgctcgtacagtagtgtttgactccatgcgcaaacacgatggctccaccttccgggacctgctccctggggagtatgtgcagatggcaggccgggcagggcggaggggcctggaccccacaggcaccgttatcctgctctgcaagggccgagtgcccgagatggcagacctgcaccgcatgatgatggtgagcgggccagcatgctcggcagggccccagctccaggaccttgctggattctgtcttcgattctcctctcttctttttcttcttccttttttttttggagacagggtcttgctctgttacctaggctggagtgcagtggcacaatctcgggtcaccgcaacctctgccttccaggctcaagggatcctcccacctcagcctcccaagtaggtgggattccaggcacatgccacacaggcctggctaattttttttttttttttatgctttgtagagatgaggttttgctatgttgcacaggttggtcttgaacttctgggctcaagcagtctgtctgcctcagcttcccaaagtactgggattataggtgtgggccacagcgcccaacttcctccgacttttttgttttgcctgggagaagctgaggtaggagtgagtgaatccaaggatgagattggagcccatctcttccagttttctcccatgtgaatatggagctagatggggcctttgagtccatttatttcagtttgctcccttatgttacagaagaggtgagcaagtggtttgtccaaggccccatggttgcagagctaggaccggatctgacgggagtaggcccagtccagaagactggctggggttcagtaggtcccaccctgatctcagtgacttctgtgacctgactccaggggaagccgtcccagctgcagtcccagttccgcctcacgtacactatgatcctcaacttgctgcgagtggatgccctcagggtggaggacatgatgaagaggagcttctctgagtttccctcccgcaaagacagcaaggtaaggagcctggggtaaccagtgtgtggagcaggaggttggccaaagacaggctgggaataggtaggcatccagaggccagtgtgttgagggtggggagtgtgacagattgggcctggagactcccctttcacagcttcccctgctcccacccaaggcccatgaacaggccctggctgaactgaccaagaggctgggagctttggaggagcctgacatgactggccaactggtcgacctgcctgaatattacagctggggggaggaactgacagagacccagcacatgatccaggtgagcaagtgtgagtgctgaggaggtgataggagaagggaagagaagatcgtgttactctaggtgctactaaacttagtccaagtgtctgtccctgtgatgcctcctcccatctgtcctttgctcttcagcgacgcatcatggagtctgtgaacgggctgaagtctctctcagcaggaagggtggtggttgtgaagaatcaggagcatcacaacgcattgggagtgatcctacaggtgagggtgatgggaatttggactccagagggtgggagggagcaagccctctctccattttccccacttggccagggcaggttgcgtcatcatagggccctcattttcccctcttgccctccttttcaccctctcccttcccatcaccacatcatgctcactccttcctcccaccaccccaagaagtctgctctgatcgcttgacttggttgcccctctctactggtgagctctgcatggttgcttcctgattcctgcccaagggtgggtatctggtctctgcctttgatgtctactcatcacacccccctctcctggcctctctgaccacccccaggtctcctcgaactccaccagcagagtattcacaaccctggtcttgtgtgataagcccttgtcccaggacccacaggacagggggccagccactgcagaggtgccctatccagatgacctcgtgggattcaagctgttcctgcctgaaggtgagagtgtggcagatgtctgttttctgccagcagtataagcaggatgcctgggtccatggcaatgtctgccctgctctccccttttcacagggccttgtgaccacaccgtggtcaagctccagccaggagatatggctgccatcaccaccaaggtgctccgggtgaatggggagaagatcttggaggacttcagcaagaggcagcagccaaaattcaagtcagagatgctagggaggcccttctcctccagaggggcacgtagaggcagggaggggcagtggtctgggagtttcctccagcctgagggagaccatgaagtggtggggttgtagtgagggggctcccccagcctaagggagactgtgaagtggaggttgtagtaagagggcttccacagcctgagggaggcttctgggggagagaagatcttaccccagatcttaagatctgctccctcttcaggaaggatcctccccttgcagccgtgaccactgctgtccaggaactgctgcgtctggctcaggcccacccagccggacctcccaccctcgaccctgtcaatgacctgcagctcaaagatatgtcagttgtagagggtgggctccgggcccggaagctggaggagctgatccagggggctcagtgtgtacacagcccccgttttcctgcccaggtaggaccctgggtggtaactcccaagctgggagtaggggcttttcctctgtggtcccctgtagactgaccgcccccatctcagcccttgtcctcagtgcacccctgctaaggggcaaggagaaggctgacgggtggctctctgcagtacctgaagctgcgggagcgaatgcagatacagaaggagatggagcggctgcgcttcctactgtcggatcagtcattgctgctgcttcctgagtaccatcagcgagtagaggtgggtggggcagtggttggggcaggggggctaggggacagcagtgtgtccaatgcccaccctttttcttgcaggtgctccgaaccctgggttatgtggacgaggcgggcactgtgaagctggcagggcgggtggcttgtgccatgagcagccatgagttgctcctcactgagctcatgtttgacaatgcactgagcaccctgcggcctgaggagattgctgccttgctctctggcctggtctgccagagccctggggacgctggggatcagctcccaaacaccctcaagcaggtaggggacaccacccctttctccctgccagggctgtggcattcctgaccttcaccttcaggtagtcccccaggtgaccccctccagccctgtaagtgccccaaggatggaaaatggctgccttcttgatctggtccttccctgtcctggagcaggaaggcaggccttaacctctccttctttcctgcagggaatagaacgtgtccgggctgtggccaagcggattggtgaggtccaggtggcttgtggcctgaaccagacggtggaggaatttgtgggggagctgaattttgggctggttgaggttgtatatgagtgggcccggggcatggtgagtacctgaggtttgggattttgcagacggctggctggggagaacctgcccaggctgagtgcatccagtcctcaccctactttccccacagcccttctccgagttggcagggctctcagggacccctgagggcctggtggtccgctgcattcagcgcctggctgagatgtgtcgctcactgcggggggcagcccgcctggtaggagagcctgtgctgggtgccaagatggagacagcggctaccttgctacggcgggacatcgtatttgcggccagcctctacacccagtgaatgccccatgtaaaaacatgatgataaaacagcaaagcac

SEQ ID NO: 1974 - DNA, 6556 bp, Homo sapiens
gtgttcagtatcaaatctagttttaatcttctataacaagtcaccttttcttcccacctatatccaactgcgcctagtggtacagtgagaatgatggcctcctctctttccctggagtctgaggtattggcaacagcagtcacccactgctgagaggacttaggacccagcagaagtcaagggtcattagtgccctgcagctgcagggatagcctcacttcaggtggggatggggtaggatgcgggcaggacagggcctaggaaaagaagaagggtacaggagccttcctgactgcagaagtttcctgtttgtctgaaggcaggaaataggagctaacggagtctaaggccaaaggttatcttttaaatagagcataggatcagggagctgggacctcactagccactgataacttccagcgccacccgggtgacagaaaaggcgcagaaatggaaagtgaaaggttcagggctagccaggcaggcccctccttttctccccgcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctgaagggcagcccagccagaaagccgcccactgtcagggggaaagggaagaacctaagccagtggtgctagctccagcttctcactggtctatatgcaaagcacaggtgggggtgagggagagactctagaagttaacacttaccattggccatgagtcccacaatggcgtgggaggtgccacacaagttgggaggggcactctcgttggctatgactccaaacagggcaatggggccatacgaggagaaaccaaatacagctcccaataccaggatccagagctgccaagggcagagtggagtggcattcagagtcggaaagccgacctgcctacccacccctgccaaagcaagaagaaggcttggtccccagaaacaaacagtagtcataaaaggacagtaagtaagtgattcttttccttccactccccaacacaactgacaatacagagctagagtaggagatgccacattgagcaaacccagggacctaggtgggcaaggaaaggaggtacagaagtcatccctctgagctagaggctgtcctcaggatttacacaaactggattggctaggggtaaggcagaagggtaggacaaaggtgagacagaccaggagaaaaaccagagatatctttaaggcacctcatgctctgtaaagcctgtgagctccgcgagagggtgaagagccagagtccagaaagcaacatcctagaggagcacagggaagaaaagaaaaccaggcccagagtggaggaggagaacccagacacagaggaacggtccaatcagaactgaaaagggtatctgagaggcgaagaaaagattggcccaggctgaagccaggagagggagacagagtcagtggcccttgcgttctctccttgtgccctgccgtgagccaggcctttcttaattaccttgggggagtcactggtcactgttacccggaagaggtacatggacactgtcatgccagccatcatgaacagcaacaggccatggcgagggttcccgtagttggacagtcccgcctatggatacagtcccggcaatgtcacgtcctcagaacagggcagagaacacccacccctggactctgacacagcagggcctctgctgacgggtctttggcaatcccaccacagttcttggccctgggcagctctgggaggccctgggacctgctcattacattctgaggccaaactctacaacatcccctcctcccccgtcaggcaggactaggacacgtgctggggagggcacctagtctgttcccagcccattttcctggggctgtggagcaacctacagctaagctaagaaatattctggctgtccttcacatcagttaaaactctacccaagagccttacttccacaaccgtaggaaagctaagaccagcctggaatcattccctcttcacccggtctaaaccagcagatgccaacctgcctgtgccctgggactcccatctctccagtgcctgtcccagccacgccgtgaagactgaaagggacccttctccttcctgtcccttctgcccgctcacctttgccatggcccggtctgacaggtagccagctgcgatgctgcctacaaggcccccaacttccagggcactcatgtaggagctacctgcagtagggagttgtggtgggaagagggaagggaagggtgggagggtgttacacattggggttgtcccacaatggcttaaacctggagaggtacagggttcccataggtgactggccatagctgcctgagtagcgcccggcctcaaggaacgaataaagaggataaatggaagcaaggcctgaatttgcatcccctgcattggttcctgctccttatgcccacccttgtccccatgctcatcttacctacaagggctgactgtcctttctcctggataaggaagaactggccccagtcagtacagcaggtctttactccaaacaccacaaggtaaccagtggagagcacccacaggtaaggggacagcagcagctcctgcagggtgctctcctccttcaaggagcctggaggtgggaaaaggctgggcgtcaggctctgccctgactgctctccccaacctgaacccccaacattcattaaccagccacaggggcagagtccatctgcacagccaggatcagcatgaagggtattccctcaccccactgctctcctctccccctctccgctgcaaggtcaatgaatgagaaacaggaccagggaggaccaagccacttaaggaccaagctcaatgaatgaaagacaaacaggaccaagccactaaagctcatgattctatctatccaggacagggaagtctgtgctgttgtgaggaagggccagaaaataacgagtcacagcacttgctggctctgccgcttgtccagtacttgactgcctcttgggatggatttgtgtttgctacccatgcagcctacatcaccacctcttcccccacatccactgaccagcacaggaccgggcaaacgcctagtcttcaacaaacatctgcctgctaaatgagtgccccagtggtcggtctgggtgggggctcacccttcttgccctcagagggcatggggtccaggttgcggagtccaacatcagcaggttcattgtggatgagcaggagacagaggaaggagacaaccacaccacagtgccccagatagggccagcgtgctgcgccagctgtagctctgggcaaggatggttgccaggatagggcccagccctccagccaggttcatgctggttgacaggatggcccaccaagtgccaaactgagatggctcaaaccactgtggggcagagggcgacacgtaggtgtccagcctactgcccatgttgagggtggggtcagatggggcagccccagaagctcacattacagggaagagggagagggcgcttctgtttggcagggcagtttcctcctctgccacctgatcccaccactctcagcctcctaaaatatcttgacaagcaataggagctggccaggaactgctcaggaacctgctctgggttgggtgtggaggtggtgggtaagaaagggcgctcccacatgctctttaggcatcctctatgacaatccaaacaggctctttggaagcactcaccttccgcaggaccttcccacatgggggccagcccagcccctgggccaggccattaaggaaccagagggcagcaaagacaggtactgtggagctccaggcaaagaatatgttgaccaggccaaccaggagcagcccagaagagaagagccagcgagcactcatctggtcagacagcaccccactgacaaacttgctgatagcataagctgccgactggctgctggtgatgaaccctgcagggaacattacacttaggggttagggaccaggggagaaacacaggagcaatgaaagaaggcatggggtcaggtgtgcaggggtgcccagtggggtgagacaggttacttcccagaggaacaggaggagcctgtgctgcaatctgacactcatggggccctactacttcggccacttctcctgcctcaccatcggcactagccccagactgacccatgattctcagctacagttgtcagggaacaaaaagggagcaggacgtggcagttccccctccctgggatttgcatatgggatttcccacctcactctggatgccagtcccgggcctctagcagttctgttgctccaccacccaacatggggcaaagggctcaggattggagtcagggaccttgtccctcctgaagggtagcatgccaggccacatgaagtcgttgtgccaactttttagttcccagtgctcacagtgtcagtagccagcactcaccctgaagcctccacatgcacccacacaggtgtgaaaaccatgctcagaagcccctcaaacactctcggaataaacagtgcctccagggcatgcacacacacgtcaaataagcagccctccttagccccgcaggcacccatgtccatggatctcagagcttctttatctggcatatgcagactggcccctggcctctactgtgcagacaatccacccacaccacatgcctgtacacaaacacccagtgtgtctggctggttctgtgtccccaggtccaccaccctgctgtttcagggctcacccaaatcatccttgtccaaagggatctcttccaccaatgatggcatgacaaaggagaaggtcttgcgattgaagtaatacaggctgtagcccccaaacatggctgagaagatcacagtgcgataatagccatagccctgggctgccatggtagaaaagagcaggccctaccagccaagacgcacagcctctgaccacagttcctgcttgccgctctcacagttcccagatctgctgagttgggttttttctgctccctcctccacccagcctcccaggctccctttatagccgccttctggacaatcattaagcctggggaggctccaaggggacccagtgtcctgagggagacaagaaaacaagagattactgagcgccaaactgtagggggtggaggaggtcccggaaggaggcatgcctgtgagccaggccagcaccctgtgtccccaggatttctgcctttacctcctctatcatgtctgcttgcctgtgaaaccagctttgattaaaggttcaacctaattacttttgtctgcctgagcccaggggaggcaggggtgggatgagcagagatgccctctctagccctgctccctcagtcacagaaccttctcattcattcacggaaggtttattaacttactagttgacaggcactgcacttggcactattagtttctacacccactcaccaccaccgcaccaaaacacaaagtcagacacataccccggctaccccacttctaagccttctagagagggcctcaatccgtggaactctcaatacttagcacataatagatttaattgtttcctacagttgccccttgtaattctgtgcaagggggacctccccagttcaggtcccacggtgtcacacagaaagccccgctaagggctgaggtcctgatggggccccacagagctacctctgggtccccattaccctgcgacgtcagtctgggcttccttcgggctagctgggggctgcagggtctggtttccaacctgtgggacgttggcaggggccgcaagcagagggactgggcagctcgtgggcgggaaggtgccccggcgggcttcgggctgcagggcacaaccgtcccgcccagggccccggcaacatgccccggcttttccgctcaattgggaaagcaactggagcagaaggcgtaggcgcacgcggagcgggcgaccgcacgtattctcccggaggccccgcgcttctggcacccagaggctcagcctggtaggggagggccaggcggcgggcgggagaggaggagaggcggcgggcggcgaagaggcggcgggctcgtggcacctgcccagccccgtgggtcctcacgctacccaggacacgctactgtgcggctgggaaccacgggggccgggggtgcaggagctggagaggtgcggagaccacaggactggcgcgatagaaaggggtctcgtgctggtggtcagggacagcgcctcggtggccccaagacccatgaattgtctctggaactgcaggaacagctccgggtcgtatcggaagttggggttcgccaacaatggctccccaagacctgagatccccgccctcaggtgactcccctcccccgcataccgcctcctacctgaacagaggcgggagcccgaataggacggggcggggctagcgaaggctgcgcaagc

SEQ ID NO: 1975 - DNA, 6556 bp, Homo sapiens; identical to SEQ ID NO: 1974

SEQ ID NO: 1976 - DNA, 6556 bp, Homo sapiens; identical to SEQ ID NO: 1974

SEQ ID NO: 1977 - DNA, 6556 bp, Homo sapiens; identical to SEQ ID NO: 1974

SEQ ID NO: 1978 - DNA, 5218 bp, Homo sapiens
gtgttcagtatcaaatctagttttaatcttctataacaagtcaccttttcttcccacctatatccaactgcgcctagtggtacagtgagaatgatggcctcctctctttccctggagtctgaggtattggcaacagcagtcacccactgctgagaggacttaggacccagcagaagtcaagggtcattagtgccctgcagctgcagggatagcctcacttcaggtggggatggggtaggatgcgggcaggacagggcctaggaaaagaagaagggtacaggagccttcctgactgcagaagtttcctgtttgtctgaaggcaggaaataggagctaacggagtctaaggccaaaggttatcttttaaatagagcataggatcagggagctgggacctcactagccactgataacttccagcgccacccgggtgacagaaaaggcgcagaaatggaaagtgaaaggttcagggctagccaggcaggcccctccttttctccccgcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctgaagggcagcccagccagaaagccgcccactgtcagggggaaagggaagaacctaagccagtggtgctagctccagcttctcactggtctatatgcaaagcacaggtgggggtgagggagagactctagaagttaacacttaccattggccatgagtcccacaatggcgtgggaggtgccacacaagttgggaggggcactctcgttggctatgactccaaacagggcaatggggccatacgaggagaaaccaaatacagctcccaataccaggatccagagctgccaagggcagagtggagtggcattcagagtcggaaagccgacctgcctacccacccctgccaaagcaagaagaaggcttggtccccagaaacaaacagtagtcataaaaggacagtaagtaagtgattcttttccttccactccccaacacaactgacaatacagagctagagtaggagatgccacattgagcaaacccagggacctaggtgggcaaggaaaggaggtacagaagtcatccctctgagctagaggctgtcctcaggatttacacaaactggattggctaggggtaaggcagaagggtaggacaaaggtgagacagaccaggagaaaaaccagagatatctttaaggcacctcatgctctgtaaagcctgtgagctccgcgagagggtgaagagccagagtccagaaagcaacatcctagaggagcacagggaagaaaagaaaaccaggcccagagtggaggaggagaacccagacacagaggaacggtccaatcagaactgaaaagggtatctgagaggcgaagaaaagattggcccaggctgaagccaggagagggagacagagtcagtggcccttgcgttctctccttgtgccctgccgtgagccaggcctttcttaattaccttgggggagtcactggtcactgttacccggaagaggtacatggacactgtcatgccagccatcatgaacagcaacaggccatggcgagggttcccgtagttggacagtcccgcctatggatacagtcccggcaatgtcacgtcctcagaacagggcagagaacacccacccctggactctgacacagcagggcctctgctgacgggtctttggcaatcccaccacagttcttggccctgggcagctctgggaggccctgggacctgctcattacattctgaggccaaactctacaacatcccctcctcccccgtcaggcaggactaggacacgtgctggggagggcacctagtctgttcccagcccattttcctggggctgtggagcaacctacagctaagctaagaaatattctggctgtccttcacatcagttaaaactctacccaagagccttacttccacaaccgtaggaaagctaagaccagcctggaatcattccctcttcacccggtctaaaccagcagatgccaacctgcctgtgccctgggactcccatctctccagtgcctgtcccagccacgccgtgaagactgaaagggacccttctccttcctgtcccttctgcccgctcacctttgccatggcccggtctgacaggtagccagctgcgatgctgcctacaaggcccccaacttccagggcactcatgtaggagctacctgcagtagggagttgtggtgggaagagggaagggaagggtgggagggtgttacacattggggttgtcccacaatggcttaaacctggagaggtacagggttcccataggtgactggccatagctgcctgagtagcgcccggcctcaaggaacgaataaagaggataaatggaagcaaggcctgaatttgcatcccctgcattggttcctgctccttatgcccacccttgtccccatgctcatcttacctacaagggctgactgtcctttctcctggataaggaagaactggccccagtcagtacagcaggtctttactccaaacaccacaaggtaaccagtggagagcacccacaggtaaggggacagcagcagctcctgcagggtgctctcctccttcaaggagcctggaggtgggaaaaggctgggcgtcaggctctgccctgactgctctccccaacctgaacccccaacattcattaaccagccacaggggcagagtccatctgcacagccaggatcagcatgaagggtattccctcaccccactgctctcctctccccctctccgctgcaaggtcaatgaatgagaaacaggaccagggaggaccaagccacttaaggaccaagctcaatgaatgaaagacaaacaggaccaagccactaaagctcatgattctatctatccaggacagggaagtctgtgctgttgtgaggaagggccagaaaataacgagtcacagcacttgctggctctgccgcttgtccagtacttgactgcctcttgggatggatttgtgtttgctacccatgcagcctacatcaccacctcttcccccacatccactgaccagcacaggaccgggcaaacgcctagtcttcaacaaacatctgcctgctaaatgagtgccccagtggtcggtctgggtgggggctcacccttcttgccctcagagggcatggggtccaggttgcggagtccaacatcagcaggttcattgtggatgagcaggagacagaggaaggagacaaccacaccacagtgccccagatagggccagcgtgctgcgccagctgtagctctgggcaaggatggttgccaggatagggcccagccctccagccaggttcatgctggttgacaggatggcccaccaagtgccaaactgagatggctcaaaccactgtggggcagagggcgacacgtaggtgtccagcctactgcccatgttgagggtggggtcagatggggcagccccagaagctcacattacagggaagagggagagggcgcttctgtttggcagggcagtttcctcctctgccacctgatcccaccactctcagcctcctaaaatatcttgacaagcaataggagctggccaggaactgctcaggaacctgctctgggttgggtgtggaggtggtgggtaagaaagggcgctcccacatgctctttaggcatcctctatgacaatccaaacaggctctttggaagcactcaccttccgcaggaccttcccacatgggggccagcccagcccctgggccaggccattaaggaaccagagggcagcaaagacaggtactgtggagctccaggcaaagaatatgttgaccaggccaaccaggagcagcccagaagagaagagccagcgagcactcatctggtcagacagcaccccactgacaaacttgctgatagcataagctgccgactggctgctggtgatgaaccctgcagggaacattacacttaggggttagggaccaggggagaaacacaggagcaatgaaagaaggcatggggtcaggtgtgcaggggtgcccagtggggtgagacaggttacttcccagaggaacaggaggagcctgtgctgcaatctgacactcatggggccctactacttcggccacttctcctgcctcaccatcggcactagccccagactgacccatgattctcagctacagttgtcagggaacaaaaagggagcaggacgtggcagttccccctccctgggatttgcatatgggatttcccacctcactctggatgccagtcccgggcctctagcagttctgttgctccaccacccaacatggggcaaagggctcaggattggagtcagggaccttgtccctcctgaagggtagcatgccaggccacatgaagtcgttgtgccaactttttagttcccagtgctcacagtgtcagtagccagcactcaccctgaagcctccacatgcacccacacaggtgtgaaaaccatgctcagaagcccctcaaacactctcggaataaacagtgcctccagggcatgcacacacacgtcaaataagcagccctccttagccccgcaggcacccatgtccatggatctcagagcttctttatctggcatatgcagactggcccctggcctctactgtgcagacaatccacccacaccacatgcctgtacacaaacacccagtgtgtctggctggttctgtgtccccaggtccaccaccctgctgtttcagggctcacccaaatcatccttgtccaaagggatctcttccaccaatgatggcatgacaaaggagaaggtcttgcgattgaagtaatacaggctgtagcccccaaacatggctgagaagatcacagtgcgataatagccatagccctgggctgccatggtagaaaagagcaggccctaccagccaagacgcacagcctctgaccacagttcctgcttgccgctctcacagttcccagatctgctgagttgggttttttctgctccctcctccacccagcctcccaggctccctttatagccgccttctggacaatcattaagcctggggaggctccaaggggacccagtgtcctga

SEQ ID NO: 1979 - DNA, 11570 bp, Homo sapiens
cactttacttactattagttgtttattatgtcaaccttaaataatgagattcagaaaataagactaagtatagagtttctttgagtgcaaagtttgagaatagccacccagtaagcattgactccaaaggcatggggtgagcattccaaactggagaagttaaggtttcacttccacaggcaaagagagaggaattttagcaggattacaacattttccatacaagaccagtgcgtatgttacagtgctttgattggttatagattgctacattccaaggaagatgactttattaccccctgagaaagggtggtgatctaagtggggatctaagggagtcttatctctggtgccatttggtcttcctaagtaattacagaaaaaaaaaaaataggtggaagttgcagctgcatgccccatgactcaggctgcagagaccaattcctgtcaaggctcagaataacttaaagttccaagagctttaggtttgatttaacaaagcttgaataatagtaataaataatattattaatctcaaaatcctgggctcaagtgatcctcctgcctcagcctcccaaagtgttgggattacaggcgtgacccaccatgcccagctgaattatttaatttcacagttataaaggacacagctcaagaatagccaaatggaagagatacataggatctctacgtatggagggtggaggtgtggatgccatgccttctaccaccttcccagcacctacacctgtttatcaacctggaggctcttcaaaaccccttgtttgggggtttttatggaggttccattatgtaggcatgattgattaaatcattggccattggtgattgaactcaatctccagcacctctctggaggctgggaggtggggctgaaagttccaatcctctagtcatgccctggtctccctggtgaccagccctcttcctgaaactatctaggctacccccatagcaccccccgggcccccagtggggaatcatctctttagcatacaaagacactcatcactcaagagattccaagggttttagcagctctgtgccaggaactctgggcaaaggaaaaatatttattttttattacactacaagggttaaggtagacatcaaggtggacatcaggactggtgtcctgccctgggcccagcctcgggccagtgggcctcccagcacctgcctggctacaagggtccctagatgggtacaggggtatcttcctcctttcctttctttctccaggagattgtgactgctttaagctgcggcaagaacattgtgcccatcattgatggcttcgagtggcctgagccccaggtcctgcctgaggacatgcaggctgtgcttactttcaacggtatcaagtgagccccagggccctgggaccaggggggtagggtacaaatcaccatgacaggcagagtgtgggcaaacagctgactagcagctccctctgcccagctgtctgaaccacattggctcctgtgcccacaggtggtcccacgaataccaggaggccaccattgagaagatcatccgcttcctgcagggccgctcctcccgggactcatctgcaggctctgacaccagtttggagggtgctgcacccatgggtccaacctaaccagtccccagttccccagccctgctgtgacttccatttccatcgtcctttctgaaggaacagctcctgaaaccagtctccctgggctgagacaacctgggctcttcttaggaaatggctctccctccccctgtcccccaccctcatggcccacctccaacccactttcctcagtatctggagagggaagggaagtcaggcttgggcacgggaggttagaactcccccaggccctgccattgggttgtctgtctccgtcatggggagggtccctgctcagttctggagacactggagttggggtgggggtggttctgcattcccttctcctgctgatagcagtcagcttgaggaggatgaaggaaggcagcctcagacaggaattaaggcaatgcccaggcgggcctgggcactgtattctgagcaaaggcctgggcccaggagccagccagggatgagtgccatcatggctctccactcagactgtgcctggcccctgcacttacaacttcctgccgctctgtggccttgccctgtaatcactcagtgcccttagctagcctgactaagtcccagatcccctacagcttccttcggtgtggtatcttttgccacatccagggcgagggttgaggcaaaccagccctccctctgacttccttgtcactgcagccagctttgctgcacttgctggtgcacaggagcctcctgtttgggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcctcctttcctcatgcagcacaagtgctcaccggggccagagccagggcatggatatgacaagcagggcagcctggacactgccctcacaggacagcgccaataacaatacagtgtctgagtatctccaggggatgatttctggctctttgtctccaatcagtcccactccctcctgaggtccccaagggcagtattcagagaggtttcctgcgttttatttctatttggtataccctccactgttgtccactgccctgtgtggccttctggttgacctctgcccgatcttctgtctctctgagggaatcagagtccagcatccagccccagctggaacagctgaagtcacaagcctcctctaagccaaggccagtgtgttcagaggtgactgccacccatactaggacaaacacagctcagatcaccaggtcaagcacctaggcctggcttctcctgagacagaggactcagaagtggcctttcctccaaagcctgctcagacacaggtctgtagggccagggtgttctgcttggctgggctgcagctgctacccctcggttggggctgagtcagccagatcctccccctacttctccccaagggccaagaactgctcagggacattaaaggtcaaaagtccagccacactcattcatcctttccccaggcccatgaagagaggcatctcattgtagaatgtatgaggaagtgggaagtatctcagagaatcagctaagtttcctaacttgtccatccaaatgtgatcaccacgattcaacaatttggggcattgctgatctagccgttcctagtggggcttgctcaaggttgcacagcgagtcagtagaagccctggctggccccacttggtaccaatccaccaggcagctcagggctcctgcccagcccagcagcttctgttgtctaacgtatggcaggcagactgggagcaggaaaacagagggccccaaagcccaaggcaccagaaggtttgtttcagtttgctgaagctgatttgtaatgattggcactcttcagccaggggagtgggtaggccatagccaaggatcgattccccaaccacagcaaaggcaacactcttcctccagagatcaccaagcccctcttacctccctccctccttcccaaggctggcactaaccaggtaccacattcattgttaaggaatggctgatgactgctacacgtgttgggaacctggttggggctgtgcagtttgggctggaaggagagatgccagccctcgtgctgcctctggtccctgaagtgtcacctctctcaggacctctcctctggcctgtggggttataagtgatggatagcagaaagggagaactgactcctgtcccaaatagctcctctgccacctgtcctgcagtgggcctgtgtgggttatgattctagatcctagacagaggctgggtcagctgtggatggggtggtgccttggtctctcttgactacctcgtccaaagagagcactgcccttagacaagagttgcttgtcctgctgtgggctgggcttccagctgcagacctccagttgcttggtgttcactttgctcctcttgccctctgtcttctggtccaggcagatcaggggctctggggaaactgctggaactcgaggtgaggatcagccttttccagcatcctgtgagagaccagagagagagtttggatttcatgtggggaaccctcaaggcctgtctggagaagtgacacaggatttactggggtgggctggtccaggtagctctcctgaacctcctccttccccaagctgagaagctgagagctggaggacaatatccagggacatggctctggaaaataacttttttttttttaagagacagggtcttgctctgttgtccaggctggagggcagtgacataatcatagctcactgtacccttgaactcctgggctcaagtgatcctcctgcctcagcctccttagtagctgggactaccagtgcataccaccatgcctgggtgattttttaaattttttatacagacaaggtcttgctatgttgcccaggctgatcttgaattcccgggctcaagtggtcctcctgcctcagcctcccacaggatcgggattacaggcaagagcctccacgcccggccatgaaatataattcttaatatcatacaggaaaaagtcagcgggtcaagctagcctgtggcccagccacaactagctgacaaagcttcctggccttccctttaacacagttctgctgccatagttccatctataaaatgggaatggagggaaataggggaactgggatagagaacacagccttgccaagcagcaatgttagcctgatccttcctccacctagctcgccatctcgcccttggaaaatggctcctggaggattaggcagccatctgcaaggagaggggcaacctgggacaagacacccagagggtaaggattccaggaatgaagctgccatttctggttgggaggagaagaggaaacttttaagagaaagggctccattatgagcatgggttcagggccctgcattacccaatcagaacagccgggatgagcaggaggccagctcccaggaggaaggggaaccccttcataaagttcagagtggctgggtagagtgagttgaagaatgccggaggccgtcagcatggccaggctattcacacaggccacagcagaaaagagagcacctgtgaagaaataaataccatactctggagtccgaaagggccatattccaactctggcaccaccacctcacagctgtgtgaccgggagtagtcacttaacctatgtctccccttcctcaccagtaaatcctgctacatcatgtactgtgacaaggattcagtaaggtcatatgtggacagtagctggcacagaggggctactaaacaaatggctgctattaaatccacattaaaagtacatgtgatctgacagaacccagcacataaaagaaaaaaaaaagtacatgtgatattgtctgatgaaagcttgatggaaatggcttttttctggtttatcctctttggaatcatctcctgtttgggattaactgctggtctgatcagttccaatattcatagcggtgtcaccactgaatagcttcttatcctttgggttcctgttcctccttctgctaaataaggataatacctatttcctagattgtgagcaacattaagttcacatggaaatcacccatcactgggcctggtcccctggaagtagctagttagtaagggctgttcttttctcctgtttctcttgacatctctgggcacagagaaagtgctgggaaaaaaagtttaggtgaatgaatgaagacacatggattctggggacaccagaacccacagtgggctctgtatggcaccagagtctctgtcatcatcagatcctcattccaggacagatggaaaaagatgaatgtttccagactggggcataaagacccagaggctggagaagctgttctttatagatataccaggagaacccacagtttacaaaatgtgcaacaacccaacagaagttgagattaaattctgtcacatctagaggggtctgtgatgtcatcaaaagcaaaccacccacatcacagatgaagaaacaggcctgtggcagggctcggactaaaacccagatcctgagaccagctgcttttaaacacagacgtaggtttgcatcctagctccaccatttactgagtaaccttgggtgagccaatgtaaccccctgggtctctgtttctttatctgtcaactgtggaaaatgaaacccatgtcacaaggttgttcacttctgggcttgtacacgctgaccccagagaaacagggaactctggcatcaccacacccatcttacagacggaaaagctgaggtctgcagagagtaaatcctctgctctggttatctagaaagaacataattgtgctctgctgactgcaaatcccaactctgcggtttgaaaatccaaggtggcatgatcctctgcccattgtgggcaatttcacagaaatgtgtttgttttggccacttacttctccagggtgagaggggggaaggcaagctgttcccccagccatggctgcccatcagcccgtttcgggcagcactggacatgaggaaccagacacaggtgggttctgacactcaccctgctctgtctctctcaccagcttggagagtttagcccggatgacaggtgtgatgactaatgacaggaaaagcaacccatatcctgtggagaaacaaacactcatcaggaaaatggggctggggagaggggcgtccaagggaaaggcagcagagctcctatccataccccacgtggggcttaggttagacccaggaagaacttccttgatggtgagggtgggaagacagtagtcaaggaggaatggagactgcccttgtctgggcttggccacctgctagctctcatgaatgaatgctaattcccattgattgctttcttgtctgaacctcttgtggtcacagcaggcatcacccacccacttggcacttagtagggatatggcagggcacagaaaacaagcatgggctttggagtcagccctgagttcaaaacctgatgccattacatattatctgtgtggcctggggtacttaccctctctgatcctgactccctgtatgaggaagataataaggccttcatcacaggatggttctgaggcataggaggctgaataatggtgcccaatggcatcagattcatagccctggaacctgtaaatactaccttatttggaaaatgagtctatgcaggtgtgcagttaagcctcctgagagagcagagttatcctggattaggttgggccctaaatgccgtcacacatatctttataagaggaaagcagacggagatttggcaccgacagaattgagaaggcacaaagaggaggagagtcaatgtgagcacagaggcagagactggtgatggccgccccaagccaaggaatgccagcagccccagaagctggaagaaatgagaaacacgttctctcctggaggcttgcaagggagcactgcctgctgactgcttccattcagcccggtggtactgactttggacttctggcctccagaactgtgagagaatatgtttctgttgtgttaagcccccaagtttgtggtatgtcattacagcaatctcagggaaccaatacatgaggtaaaaaggtaacatctatgaagagcatggcatagggacacagcaaatgggagttccttttccctttgcattcagttacttacaggcttcctgttttcttcataaccatttctctccctgtgcgactgctgactcctcagcaaaactgcaaactcctacaggacagtggatcctccaaagaaggtatacgatgaggcatccagggaccctagcagtgtcaggcccctcaaatcccactctgttgagacctccccccgacccagagcaatgacagcatctttatcatctctgcatcccccagggccatcagcaggagggaaaggttcccttctgcttaattgtcagacaagcagttgagttaagaaatctgtgattattgtattgttgactatacacagcacattttagggctctatcaaaataaatctgtccctttaaaaaaagttaactaaagccgggcacggtggctcatgcctgtaatcccaacactttgggaggctgaggcaggcggatccttgagctcaggagttagagacctggactgggcaaaatggtgaggaccccatctctataaaaaatacaaaaattagcaaggtgtggtaatgtgcaccagtggtcccagctactagagaggccaaggtgggaggatcatctgggcccgggggatgaggctgcagtgagccatgatcgtgccactgcactctagcctgggtaacaaagcgagaccctgtctctaaatacatcaatcaaataaaaattttaaaaagttaacttcctcatttactggcctgttgaccctctcccatcaaaaaaagaaggggaggaagtgaggagggaaaggagaaggagaaagaggagaagaggaactgaagcaggaatttcatatctgtggtccgagaagactggtttttaaaaaacccaaagaagctgactaagggtatttgaggtaggtcctgtgattcttatcagagaagtgagtaccaggcattaatggcatggactttgtttaagaacatatgaataggcggtgggaggccaaggggtaaagcaattagtgtatgagccacacttttgtcttttgctctatattactaacaatattaatggttgataacagtgggttaattactttagctactgaaggtctatattttccatgtatcaaagatggcatttttgagggatttcttagttgtctgttctccagtgcaggctgggggcataactatgtttccaaagacacaggaatgaaccacatctgggggcagtgagtggccggcccccagttcttacccagtgcctctgggacaagctgtccctgagcccacacactttacctgtgaacatgagaggcgtgatagtggcaaaggcaaagaccaccatccccaggatgttgaaggccaggccgatctcagctacccaggcatcggccaggcagtactgcaggagcttcagggccagcaggctggtgaggtaggggagatgctgagctgcagaaccatagccgattagtttggagtcccagcagaggggtgtgcttagttcataaagggttaagatgtcctgggccccaaagtgcacagtgatcaccacgaagatggccagtgagtagagggctaaatgtttcctggacttctctggggcgggagccacatagagctggacaatggatcggtggtgacggaacgtgaagagccgggtggactttggctcctttaaggtctcaccaaagcagaaagctgcatagagagtcatggctatcagcaaggccaaggccagccagaaggggttggcataaccctgggcccggagccagtggcccccgaggaggcttgccagcatcccagccaccccgatgctggcttccagcagggccatccggaaggtgcggctgcgactggagctgacatctgccacggacgcaaagctagcagccagaaggccaccgaagtcgccgaggagggcacaaaggatgcgacccagcacgaagtagccgacgtggagctgcagctgcaccacaaaaacggacactagggcctggagcagcaggcccagcgaggccagcactagcagcgggcggcggcccacactgtcgctccaagctcccagcagggtggacgagaagagccccaccaggaagccgcccacgttcatgtagagggtccagtgggaggtaagggtctccacttcctgtaggggcacaatgaccagggtgcggttcctcactctgggttccacaatccccaaatcctcgccatcccgggagctacagggatgaggacttcctttggagccctaaacctcagagaatcttagcacagctttcaaaatctgccagtggagagggggaaggacatggaccaaggccccattccctttcctttccccccccttttgttaacctgcaaggccagactttagctcagcttttcgcatcccacccgctgaggttctcggtcaggcccctttgctctggtcccgcccaccatccaaaatgcaccctccctccagttacccgccactaccattacgcaggccccgcccctccgctgcccccacgctccagaccagggccctccacctgccaggctcctcgccgccccgctacctgcatggtggggtccgcgctgcggttgctgcagccccccctttggcgggtgccattgtagccgaggtcggcgctgaagcggtgccacagatactgcgtggtgagcgggccctgcaggaccaaggcaaagttggccaggaagaccagcggctctaccgggccccggcacagcacggcagccgcagggcgggcgcggggcttttccggggggctcgcgctcccctccatgtgcgtgcgcggcggagctgtcgccaggcgggcggcggggcgcgcgagcgactcgctgcctgggaccagcgacgcgtggcgtggggcttgcgctgtct

SEQ ID NO: 1980 - DNA, 11570 bp, Homo sapiens; identical to SEQ ID NO: 1979

SEQ ID NO: 1981 - DNA, 318159 bp, Homo sapiens
taccattttggtttttatttcttcaaaacatgaaaacaaaaaatgaagtagatgacaatgagaaaggagaaaacatttcatacagaatatgctgtatcactagtgattaaatcagaaacaattagaaactttatttgtctgtgtcagtaatatgtaccatttataaggaagagcacaattagtgcatttcccgccccccccccaagctgtgcacaatacacacaaaataaaataattttacacaactataataataacaatcctgaacaaccagaatcatagtttcctagaacatgaaaatttaaaaagcaaacaaaccaaaaagctttcaaattgaaatcgaccaatgcaagaatttcttaaagttctctgtgaaaatttgctacaggattattgacattcctaatacagctaaaaaatgagtgcaaaaatttttctaatgtttaaacaacttatattccttgaatatatttacttggtgcttctaggctagctttccatttagcaattctcaaaaaaaaaaaaaataaggatgggaaggatgggttagaatgacaaagaattgtaaagtgtgggccatagaaaagttccattgccaacaaagataaaagatgggatacactgggctttctcagtgatctggatcaccaacatgattgcccttcttggtttaaaatggagagatatatttatctgcaagtcggtcaaagataaagagggtggttttccaaacatatgccttatgctctcttagttaaagaaattcttgggtataaatacaatttggacaattgctttgatacagtttcagtgtgtttatgttaaaagagtttcataattgttttttcttgcaagataaaaatctttccatatggctttcttcacttttactcatgaaaatagtaatcacataaactgtaacccttctgagggcagggatctagactgttttgttcatggcttagtccccagaaagtatcatactacctggcacattaagtgggtaaccagcatttaattactcattcagtcaccaaatgtttattaaatgaggaaggatcatggttactgagtgacagaagaaaaaataagtctcaacagctttaatttattaagtatttttgaatcaatacagagggctaggaatgtctccagcctgggattccttatagacacagaagtctccgagaggtgaccaaagtcattctattatttttctcattagtggactcactactttggaatgttgggtttatccatgttctttggtattttaacatagaaacagctattctttttaaagggttaaaaatatcccagtccaatcctcctgggaggtactagtcttatttaattgccttctctttcagcataagtagaggagacaacacttttaaaggcccgttggtcaccctggcttctttcttactcagcaactactgatataatcaaagaggactagactggacagtgaaagaaacagggctcaaaatagccttttaagtaaaaaaataaaatgaacaaaccagcactatctaccatctgtgccagacagtgcagatgtgaaataaatactttgcagggaggggtgttgtggaaagggtggctctgaaagcctaggcacatccaacatatcaacgtctctataaggcctttctccttggccttcctgaattaatgggtgatttttagaggcctctgatgtgttccacatggctaattttccatgaagatctttgtagtttgcctgctatcctctcaatagctttaacttctccccacatgacagttattgcttcttagaaatgaatgtgcagaaccgtgaacaataatccattttctccttttatccctagtaattaatcaaactcaataacagcacaaaagtaacaactcaggtgaaaagaaaactcacttatgtcttcaatgtccaatcaacattgccaaatgggagaacagtatgtactatactctactatatacagatactctttgttttgttttatttgtttttcaccatgcactgtgtaacaggtatcacaacaacatttccgaacggcacatgaagaaggagcaaatgttcagtcatgactggaacaggattgtgcaagccatggatgcctttgaaaataaaactgacagacaatcccaagcaacggcaacatgggactgagacacatgttaatgcaaatggaaaacgatgatgtgctttttgaatggggttattcttactgtttgcataggggatggcaggtggacaggaggaacagggttgggatggggcacctgggggcttagctgggctgaatgctggaagaaggaccttgccaatcacagtccagagctaaagagataagaaagaaaggattttgcacgttcctgggaatctaggcacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggtaagtgaacatgacaaatgtcagtttcctctgtccattatacataatttttatgtatatatatgtatatatataaatttactatatctgatagttcctttagaagccttttatgtggcagtaggcctccagggaggagaagaaaatgtacaagagccataggagcacaaagaggcaggatgtgaggagcttggcagtccggggcccacccagctcacctccgatttctggcctccgccgatacagcagcacccccacattgatgaaagcaaaaatggtgaagagagtgacagagaaagctagtgtgccaggggacactttgaactgttccccattggctgcgtggtagatggcagcgatggaccaggccacaccgattcccaggaagacattcaccgcgttgctgcccgtgacgttacctatggaggcgtctgcatactggtcctgggtggctgccactttgctggcaaatgtgtctgcagaggaagaagagaaagtcaatgacactcaatcttttagagatgtctttggagtgctgcaagcttcagctgtgtactctaggacccaacccttaatataaacccagtgaccaagaaatggctttgatgttcctctgagtcagactcatggggtgaaaagaacaggatctagatattgggagttaagggttcagtgctggctgtgtaatggactgagcaagtgatcttggtcaagttttgtatccacagatactgcagttctttgtaatattgaccttgcagggcagcattttttcagaaagtagtcacagctcacctacatcagaatcaagtggggtcctttcaaagagtgagtattgcaaggtgccatgcggctgtgctggtcataatgacagcggcccaggaatctattttaacagtatcctaaaagattctaggtcactaaagtttcggaacagctgctggagggtattactaaaagatgctgtatcagcagctctagtttatagatgagaaagttaagatgtcgggagagatttttcaagattcaagagcaagccaatagtggaattgaaaacaattgaactataatagagtagctgacatttgcttagagccttaagaataaaaaagcagattcagctatattactgcattgattgtgatggtacttttttattattattttttattattatactttaagttttagggtacatgtgcacattgtgcaggttagttacatatgtatacatgtgccatgctggtgtgctgcacccactaactcgtcatctagcattaggtatatctcccagtgctatccctcccccaacccccaccccacagcagtccccagagtgtgatgttccccttcctgtgtccatgtgatctcactgttcaattcccacctatgagtgagaatatgcggtgtttggttttttgttcttgcgatagtttactgagaatgatggttatgaggtgagggaacgaggcttagagatgacaagtagtggatgcaatatcacaactaggaaaaaaacatgttagggctacagctcctgcctcatgtcttcaaaacgaatgctttctcatggtgcttttctacctttcactgtgctgtgggcaccaatgatcattttcaaagccctttatttactcataatcctgactgtatctttttgtgatgataggaaaatcttggtccactacagaaggttgaacaacagtgacttaaacttcttgatgggtagaacacaggggtttagagcacatttgagctgggggacttcaaatcctgccttcgcagctgactgtgtgactctggaagattacttaacttctctgggcctcaatttcctaatctgttaaatggggatggtactgctcacttcagagtgctgttggtaaggtgaaatactacatgtaaataaaatgcttttgatgctttttggcacaaagtagtaggagaggctgtttttgttgttttggaaacacaatataaaccgagcaggctagatcggtttaaaagttgaggtaggatctgaaatagcttcctgtattaagcatgtgaacagaacttgcaagatactaaatttcttgtccacattatgcctacttacatcaaagtcctggctgggcacggtagctcatgcctataatcccagtactttgggaggccgagatgggcggatcacttgaggttaggagttcgagaccagtttggccaacatggtgaaaccctgtctatatactaaaaatacaaaaaaaaaaaaaaaaaaaaaaaaaagccaggcgtggtggtacacacctgtaatcccagctacttgggaggctgaagcatgagaattgcttgaacccgggaggtggaggttgcaatgacccgtgaccatgccactgcactccagcctgggcaacagagtgagactccatctcaaaaaaaaaaaaaaaatcaaataaagtcctttcagctaccttgcacagtaggattatagcagatattaataactgtcaaattgaacttatttccaaagccagtaacagcaagcattaaatgactgcaaggtgttgtgttatctgctctggtcctcctgaggtcctgggcatgctctgagcatgtatgtagttgtacgatacctgtactagtctctcccctctgttgttatgctattgccaccatccttcctccgtaaacttccagtggggaagatatgtacagcatgtaaatatagatcagcccatggattctcctgctttacaatggataagaaggctttttaggctactaaaaggctactgcatctgcagtatgacattcttcctgaaagggagttggtcaattctgaaggcctatcatcaattctgccctctgcctgtgatgaaaagcagatctgattattatttcataattaaagaagtagacaaacactgcttattccatgctaggcactatgctacacaggcaacgtgtgtattctcattcacccctctcacaagcattatgggctagatgtcattactcctctttcatgatatgagaaactgtgacgttgtgatattatgcctcttggatagggtcttagcaaatgtgaatttttaaaccaaagtctgatttcagagcccagtctcagtccacaccacattgccccttccaggaagcctgaagtttgtctttcctcttagttcatttcaggtggccctgttcctttcactcagaaactttgaagcaggttcttaccaaatgctctttactgtatcaggagaacaaagattgaagaaggtatgggcagtttgtgaatccagactcctggatttgtgctgctttgtgcattcatgatcacacattcacacagcccaatcaactatcacagagactggtgagtaaaagcaaagcgagacaaatcttaatggtttcttgtacttcattattaaaagttaatagaaacagggcagcagcctcaaaaagaaaaaaaaggaagtttttttttttttttttttttttttttttaaggtcaggcagtggaacatggaaagtaaaggaacaaaagtctgaggcaggagaaagcagcttccagctcaggtacagctgagaaacacctgagatgttattctaagctgaaatggctggtagcactggctggtggtgaacagatggccacgttaggtggggcagttgcgggggtggtaattccctctgtatgctacagggacaggtgacctggtgctgttccatagaacacacctgcttacctcccctggcacctgatacattgcacactggacttcctgggtatcccatgtgtactcagaaactctgggctttctagatggcacctttgctgccgcaccagaaggaaaggaagtttaaaatcaaagactcctgggtctggggactcaaagcacccaaaccagtcctttaggctgacatggagggcacacctgggtatgcagtgatttcctctccctcaagccatgtatcagtagcctattaatgtgaatgttgcataaggattcttacttgtaataataataggttcctattttcaaatgtctttctttgaatttcctaagagttaatagccaaagtgactagcttgtcacataagtaaaacatgtttttggctactttgtgtctcataggttttatttacttgggttagacatcaggccttttgtctgtttttattttcaattcaaaagcaatgtaaaaaaaaaaaaaattgcaggaacacacgcaaatccaaaccactaaccttagctccaacagagagaactctgttttccaaatgaagtgcgatggattctccccaaattaccttttattgccgctttgctgctcagcacatagggcaatacatcacataccatatgttaggtgctgccaagccctactttgaacactaagcctgtaacctgcctatggttaaaccaggcaaatgccatatcctaaaataaaatccaagaaataactactgccttgggtttgaaggggatataataatattcagaggttggcccattagataaaaacttttatatatggatcagatttccaatgcgattgacacaaaatatgttgataataacacatgtattttttccttcatctatgtccctggctaggtttttaatagtttttgctattaactcccaccttgaattctaattaattttagatcagtcatacagttttagacttttagtcctggctccttgatacatatgactataaatcaataagaaggaagactgttgaggagacagcatggctggaattaaactacacatcacaaagtcaggacgtaattgttctttgcagacctgcctcaagttcatggtatattaccttgcccaagtcatctggtcaacatgcaaaaataggccaatactctccctttccttcagcaattattctttacctaaatttctcaaactttattgctacttataggctaagccttaaacatctcttctgcaaaaaaaggtcattctcacagtcttgcaggatggatgcagggataatgtattatctggagcaagggtttcgccccagatggttcatcttattcttggctcttagtgttctttggggaccagctgttcagctctccaatgcttcatgcccaggaactgacactggcagtggttttaattggagtccatcctggctatgaaggtctgcttgcttctcccagcaaccagaccttgacgtattcgttcactgacaatgaaagaggcagccaaggtgtacagatcttcatggtgtagtagtggaagaagcctcatcaaagagactctcggctcttccaactgtctgtatgctctcggcaagtcacttcacttttttagattgcagtttcctcatttaattagagtatctctaagactctttctaactttactgtttgggtggtgcacagaatacattaaaatactaaatttatatgcaatgtttgattttgctggtttttttgataggagtttgtacataaccactcttcacaataattaactgatgattataactattttatcattgtgaagaagaaatgacttaaatatttgaaaatcctaggaaaatctcaagacctgaagatactacctttgatcaaactgtgacaatatttatggaattaaactacatggcacagtcatttaccttttaaaattaggtaagaaatgttggcaaaattatcaacttcaaatcactctgactggccattcattgatacgagtgaagccaaggtggcagacagatgaccatgtttcaaaggctgtgtctagtgttaatagtgttagaagtacctggagagctttgcttaaaaaatgtaggtttggggcttcacccccaagcttgtccagcctgccttattttgttgttgttgttctgttttattttgttttaggcttttgacagcctgaagccatggtttttagtttctgtctctagtgataagcagacaggagggatgtcgaaggggctttactggcccagacagaaacagaaactaagaagccatgactgtattctctctcttgggcatccctgctagatccacttaatcagactctctgaggacgggatacagaaatacaccttttaacaagcggcctaggttgttcttatttataccaaggcttgagaaccacagttgtaagacatgggaaggggagatactactcgaagtgcccacagttttgggggccttcctgcgagtaatagatgtttgagtttcagggaagcagctaatcggaaagaagtaagaagctggtttctcttagaaacatggatgcccttagctatagtggttattttgctgataaaatgtgggtaggcgtcacggagatgctgggggctgcttaattgtagcttcttccactcacaatatggttattctcctatttttttaaaccctattccagctaccctaaaaggccaaatgagggggaattacctaaattgattgaattgtgctgctctgtttgccaggttggaagcttacctacttcatagggttttgaaggaaatgagttaacatgaatagaatagggcctggcacttaatgggtgttcagtattattagctatttttataatacaacagagccagatccccagagaatccatacatggtagggaattctgactattgccaatgattctatacttttaaggagttataacaccctttaaaaattattaatttgacaatcctttgcatttaaaagtgtgatagagcttaaaattcttaattattttactttgaaaatttcatacaaccaaagtcattaaaagacattagagctcttttggtttagagcccaaatcttactaatggctgtaaggtagatatctttacttaaacagtgtatatattcctctcttttttcttttttgccttctataccctcatctgtcttgctcttttagaattaaaagagaaatagtgtttacttatgtacttgttcttctgctgtcactgaagaccttaaacaagcatttgtctttggttgcgatatttatttacccaagtaaatagaaaacctctctttctctctcacaagtgcatgcgcgcgcgcacacacacacacacacacgtgtgcgcgcgcacacacacacacacacttcactggttcatgtgaaaagaatcatcatttggcttccaagtgaagttcaagaggtaacagaattgctgatgtttgactgattaataaccaggtagatgaggagttgaaaaaaggaaacacactgaaaatttctgcccataaaagttgtccctgaagagggtaaagaagaaatggagacagtgacatgacctacttttagaagagaaggaagcagcgataagtaaaaagttcaagaggacctatattggcaggatcagggcacctgcttctagtcacttttgtccccagctacaaatgagagtcagcaggacaacttttgaaaacatgaacttgctagccccaccttgagtttctgcttaatcggcctgagatgtggctggagcattggtatttatcaaagcttccccaagcagattgagctccactaactgaccactcacagccctggtttctttgtccctgtaaggaggacaatgatgcctcccttagattaactgaggtaatgatgtatggaatgagtgacacatagatttgtttttagagtaaccatttttgttattgaaaaattagctatttttcatttttgcatgttaacttgaatgtttgcactttatggaggtgccccgggcttagttttcctactttgtatctgatatcctgctgtattttaagttcaaagaaagaaatttattctaattaaaggagagaaaaaaatggaggtttatttttcagggaacacaaaacagtgaagtgaaaggatacaaaccagcagcgcagcactatttgatctgctttccaaactgtaattggagtcatgttctcaaaaggaaatgataagactccactacacacacctagaataggattatttttcagtgtgatgttcacaggtgtccaagagagaatccaaggggtgctgacaaggtctagataactgatacatttgacaacggacagagtgtccaaggaaaatatcaagaagcttcatcatgttcaactccgactgtgactacacaatggtaaagcagctgatcgtttgaaagaaaataaatacaattattccatatagaaacatcaggctgactcctttagcaaacatggataagaaacagattaagaaggagctattttcatgaaagactccttattctttaataccattaatggagataattctctgataaggaaaattacactctgccactcacatacacacactcacttcactggttcatgtaaaaagaatcctcatttggcttccaaatgatgaacaatttttttttgattccttaaattcttggcttctcctggcattacatttgggctgtctttatagtactttaaaatgggctggaatgaacttgcttttaaaatagcatcaagtttttgatattttcagttttaagccatgattctgttactttcataataactcttattttaataatgcaaagtccgtgagggcaaaaagaatcataagatttagttaagcaacatttggctaattttgaaaaggaaaaaagcaagggcaaatttgaagctaaaaacaaatagctgaattaattgtcattttcccaagccagatggtttgttattatatagatataactgaaactaacttcctgcttaaacacaatctagggctgccctgcacagatcggtgtcctctgactcgcttctcctcccttcccaataatctccctctttcagttaatcctctttgcatttgaagcctagttctttcttctatgctttgttctatttctggaacatccatctcctatccaaatctcctcaaattctcttctctcctattttagagatagtaaagacataggttcgcctgtcttgctagagctagctgagaaggatcagatagagaaactgtactctaacttgaagagaaataaaaagaaaacagaaaccttcattctcacctgcaggtagccttaatgggttataaggaaacttcgttgtcagctggattatactggtgtgattctaagtgtatggatctagacaatacaccgaagatgcccaaaatgtgcctttccccaatggatatctacctagttagttactcactccagagacacttttttgaaggggctgctttgtgtattatcagttcacaaaaatatgaacactattaaaagtaggccactgcatgcaacctcaatccagcacaggaggcagcaggtgacacttgaggacacgtgagacttgaatgggttctgaaagtttccaataattcacctattttgccttccaccttgctgtgatttggtgtaaaatttcctccattaactcattcctacagattagtcataggatacaaaaaagcatatgtgcctatcaaaagcctgaaaagtctactaactatttggcccagcaattctctacttctgaggctctagaggcaattttacaaacacacaaatttatatcagggattggagcagagtttctatgttagagaaaaattagaaacaattgtctatcattttagaaaaaataaattgcaacttcatataacatgatactgtgcaactgttaaagtacactaagaaaaacattcatgacacactgctttgtgagaaagcaggttatgtaactatgcctactattagtccataaaaaagtatgggtaaatatttgctatatatctgtatacacattttttgtgcaatttacttaaatgtcccaggatttcacaattttaaaggtgcaaatggctgaatgtagatggtggtgagatggcaggatttctttttgttgcttgcttattaacattttctatttacaaagagcatgtattgtttattgcttgtgctactaaaaactaataaatataggttaaaaatagacatttaaatagagtctctctgggaaggagtgaacggctgaatttcagctttttcctggtccttttggttaattcagcattcataattatgttagacaaatccttggatgaaaagcatcctatatactacacacagagcaggtgcatctcgaagggtgtagcggggaggaggaaggagtggaatagaagaagaggagatagccttgacatcaggatctggcctgggatccagtgtcccgagggtgcctaggacagtccacaatatggaacaagaatcgtaaaaagcaacttcacccactatgaaagtttgcccaggaccagctgtgaagggaagatgtgtttgtgtcttcattttcccccacctactcgtgttaagcattgaagaactgcagagcagcaccaaaatcttctctcttaattttatattttgtgctacaaataccttctattttatttactaacagtatgttttagtgacttcaacccacaaaattgctttgcatattcacttaacctgacaaatactttttacaggcttgttaagagattcatgtccttgagatgtttgggaagggattgtaatgcccatctttcttgggctcttactagatacgtaacttataatgaaaaaaagaaaagaaaagaaaaaaaggcatagagctctacctaagctgctaagaatatgccatgagcctgatctctcaaaatgttctcctttttctctctcccagggacgtaggacagtttcttgtggatacttaacaaacagcttttgttaaatatctcttatttttatagattcttgtaattttcagagcacgtccatgaatgttatactatctgctgtgcctgacaattctgaggaggaagatgggtgggagcagttacccttagtttcattttgtcagggtgaggaaacggaagctccttaggggtcagatgaatgtgagggcacgaggtgggattagaatccacatcctgtaatttctggtgttcaggtcctcatgctgccagtacatttccaggatccttcatcagtttgccagataacaactccatgctctgaacatgataacacatctacgctgactaactctcagggctgctgtgggtatcaaagagatgaattataaaaacatacttttaaaatgatgaagctatataaatgtagttactatgaaagcattttttatgtgtgtgtgttaaatgcaaggggtctatcttcctgaaaccatcattaaccactgggatcttactgtgatcatttgttggatattccaaagtcctaactaatccagaatatttagaatggagggtctgtgggagaagaatccagggcagtgggataccatctgctgagaacagaggtggtaggggagctcatatgagagtatcaagtgctggagtgagaaggaaaaataattcaaagccattatttgaagtggaaagaaaataacttttcagtttctgggactagacctgcctgagtaaatctaggggtggggtgggggaggacacagattagaggtttgaagtgtgatttgttagagattagtagtgtacaaagtcaaagtttcctattaaaataccccctcccccacataaacactctccattctatggctccatgatctcgtttaattttcttctcagcagtgttcatcctctgtgctacctgaaagtttatcatctgtttataagtaccagtcttactccacgggagtagacatatcatctgtcttgtttatcccccacctccgccatgcccaacactggccagtacatagtgggggctccttaagtatctgagaatgaacgaaaagaaatgcagaatggcttgaaagcctatgctttgccactgggtcatattgcttcctttgttttaattttttaaatggtatttatctcttttttaatgactttatgaatggtgtggaggaaaaaccacttgaaaatttgaggatcaagaatgccacattgcttcagagactcagtttgggcttcctagttagctattggcattgtcaaaatacagtgtttcattgtgaatatttcttgtcattagtattccactgtagactcagttcagttatagaagctatagatgagagagcttaatctttactctcaggataagaatacttgacatagcagaaagttattgtcaggttcttctatgtggtttaccccatttctccccaaagcacagactaaacggcaggaagcacgtccaaccacttccagcgcagcctcaaaccaagtgctggttccccttgagcaaccagaactgcagtcttctaatgtgataactgggttagttttggggttctgatttgccatatttcacccatctgaaggctcatcatacacagaatccttcacagaaggacattttcatgatcacttggcatagttgtggttacctgcttttttgcgactataactcaggaatcacaggctatgattaatcctctggtgggcctatctgtggaccccagtgggggtcattttagtctggagctacagcaagcctttcttgttatcttgacccaggattttttacaatgatgacctaataatagcttataatttatggaggactatgccaaaaagtcccctgggctccagagaggcaggatggggtggggagcaatcgagggagagaaaacaaatacaacacataatttcttgaatgtaactaatacaaccaaaataagctgttttctccttgagtacaaaatacaggatttatagatgctgagctgaacaaaggttataaaatacgggcactaacggagttagtgtttttagatcatgtgctagaaaagatgggtgaacaatgcaaagcatctgatggattgaaatccttttctggaatgaatcagagtataaacaagtaatacacagcttatgtttcattcctgagaaaaggcaggatgtgaggtctgtgtgccgaggagcagtgatgggattccagctggcgctgtgcataaatgccaagcaccatgatttcatatctataatatgcactaccccaaacagatattaaaattttttatggccacatgtaagctttgccttttaaattgagttagcattttatttgttctcttttctaaaaataccagtgggcttaaattcatttgtttctcatgcagggaccagacatggcaatgaagttttgctttcttatagcccctattttcttctcttgcatttagcaacaatgtgtcattctttgtgcagggagatcatgcacagagcctcttaccaataggccttggtctctgtactctcttcctaatggttgtaatggatttgaattgatttaggagccagcagtcagcacctacagtatgacgtgctggggccatgaatgagagtaagaagctccatttgtgagagttgcctccttagcactgtgttgtgatcaactgactgaactggtcaccgacatttggcatttgtctatcattaaacatcaggtactgccctaagagtcacagtgctaattctaagcgccattgtgtgatccccacccccagcaatttgcagtgtatgaaccaagattactgttgggggcagggtagtggaattgttttaaaaaggtggacaaatccatatatacacaaaacaatgaagaacaaaaaatatctcatgtaatttacaaatatatagagagagattctgtgatgaataaaacaaaataatttcaaaatcttacagaatccatggtaaattctgacactatcatgtagagaatccatgacatttttatattagaattagtccttgtgaaaaatagagaaaagtcaaacctattgagtcagaaagtacatcagtggttgcctggggcagagggtggagatgaggattatctgtaaatggccgtgaggcatcttactggggtgatgaaatgttctaaaactggattagggtaatggtagcaagactcagtgaatttactaaaaatcatgaaattgtatgtactacaaatggatgcattttatggtatgtaagtgataccaccataaagctgttaaaagatgcagactgagacagcattaaaataaaaacaacccaccagaaaacagtggtccttgagatgtttcatttttttttttttttgagacagtgtcacactctgtcactgaggctgagtgtgatggcatgatcatggctcactgcagccttggcctcctgggctcaagtgatcctcccatctcagcctcctgagtagctgggacaacaggtgcataccaccatgcccagctaatttaaaactttttttttttgtagacacagggtctctctatgttgcccaggctcatctcgaactcctggactaaagcgatcctcctgccttggcctcccaaagtgtggggattacagacgtgagccagcacacctggccaccttcatttcaaatgtgaaaagggagaaataaaagtcatcaactcaacattatttacaaatcattccttagagactgacactcttgtgaatgcttctgctacactcgatgctcattccctttgcaatacaccctgagcctcaaaagaaagggaaatttacactcattcacataacacatgcataacaccaaccctccaaacacaaaacacatgaacgcacacctgtacagcatgatgtttctaccaagtgcccttgctctggccaacctagagtatgtaagaaggcctagatagaatagaataaaatatttttagctctcttctcttacactgtgacttttatgggactgagtaaagttggctggtatggggttggggcactaatccaaaggctctgcaggacttcagattgggcaggacacatgctgagcatccctgctccctggaccacctcctggtaaatgacatcattgttatcatcctgattcccctccagctttgtactcaatgccaggtgcccatgcagtactgccctttgagagaaataaggagtatgactaccaacaaaaaacccttaaaagtatttaataaaaaaactcttcctttgaggagaaagaataaaagatgcaaagagctttgaaatggatctttcccaggtttttacagaatctttgggtcggctgcatgcggcctattccccactgtttcttagtatacgataacaggcagttatggtgccatttatagagaaaatcttgtaaattctggttgctagccttcttttgtttcattctctcctcaaaaatgtttgcctttgcaggcttcctttaactctaatgacatcatctattcatgggaaagtgtgctggaaagtacaaagcatttaaactccagactgctgcttgctaaagtgaggttaagataaggtcctgtggaaagccatttgagtgattagggctgtcccgtgctgcccgtctggcagtgtccctggttagctttgcctcttggcctgactgcagatctgagggtccattcagcagtactgaacttttttggtagtaaagaaacgtgttgcttattagagtatgtgaaaacaaaatatacttgccctttagtagcctcttggggaaactgacaccatagccactgggaaatactggcttagggtaaagtcactctgttttcttttccatttaagctgatgtgaaatgtagccatccaattaaatatgtatgcacactgtcacaatggcacctcttgacactggctatctgacttgaaatgtcaatgttgagaggagaaagctcatggtcagtgaaactgcaggaaacagaagcacatttggatatgtccacctcactagaattcctaccatagggaaaaatgaagataggctgaaaatttacttagtttttcagttttcaattgctgcaatgtagctaaggtaaataacccaggaggcctaacttgtttatcagtgcattgaaatagaaagtaagggagatccaacatttttaagggtctactatatgcgaggctctgtgttgggtactttataaattctctctcatgtaatcctcactacaactctgtgagatggattttcatgttcctattattctggcttagaggagttaagcaatttgcctctggggatgtcatacatctagtaagtagcggagggagggttgggtttgaacacaggtctacctgcctctctaaagctcatgttcttttataacccctcagcacgtagtcattgtgctaagactttgcataacttctctgagacagaggctgttaactgtcaatctatctgtgagctttgcactgagaacaacacatctatttgaagtaggatgggatgagaagaaatgatggaattaatctgattccctgctgtccttcaagggagctcagaattcagaatgactgggtacagtttcccaaggggaacatgtttgtgatgagtgggcatttttgtgttcgctcctgaccacctctctgctgttaagagtagactgagtgtgtttactggttggtgagaccttggaatattaacctctatggttcccactcctacttctgctcagagatctagaacactggaatgtaatttccaaagctgccagtaagcctgggcagaacatgactgctaggagggtgtcctcaacatgcccttcctgggccccactgaccggcacctgggtagctgtgtatcacagctgtgtttggtctagctcgggaagaccaaatctctctttgtgttcagattcattagtggcacatggctgtgctgatgaggattatcttggtattctattttttttttttttttttttttttttgccagctgggtcagaactgaacatctttcagttgtcttagtgattaaatttttacatacaggaaatgctaatagtttacaggtatagaactggatcttgattcatttctgaatttttttgaaagcatggactccattaggtgtttttcatgccaaacagaataatagttcctgaccttgaagagtttaaatgtaatcttactgttgcatgccttaaaagtaaaaaataataaaattgaggtaaagagagaaatttaaaaatttcttaaaacgtttgtgaggcatatggaaaagagcatatgcaatactttaaaaataagtccaagatggcacgatagagtagctaagtaccagattataaaaacgagagataacatggattccacagtttaccatccctacaaactttggctaaatatggacaagtcatttattctctatgagttttagtttcttcatgtaacatgaggatacttgtattcactctcctataagctattaagtgattttagacagggccactggagttacatccaggcatattgtaccctatacagctccaggagggtcactcagattatggggcctcttggagtatgtagcatacaacctgcacaaccatacaagttacttgatggtccaccgagaagtaaagcgacaggacccagtaaattgtaaagtacttgctgtttaagtattctacagaatatcttagttttgagagttattagaagccagaaaattaaaaactgaaaaacataagctatcaatagctaactgtttttctcagttactaaaaataatataatgttttgtagcacagtgctgaacaaacagaaaaaaatatcattttcaggggaaggatctaagcgtcaaaaaaaataaaggttgaaaggaggcaaaatcagttcacatcacttaatgacataacctaagtaagataatagataaagtatatacagtgcttatgcctagatatagtggagctttgtggtaaattttaaaaatgttccttctctgctcaaaacttttcccatttattctcattttctggtgttttctattccttttgacatttttttagagttgatctcagtgtaaataatgataatagtttcctgtattttataccaattttcagttgatacattctctgagatccatgctgttacttaatcttcttgaaaagtttgtttgaattgccatgtatcattaggctgattttacaggcccagagagtcaagaaattggttaaagccatgcagtaagtaagggttagaagtccaggttcctgaattcagctctaaagctcttgtccctctaccctcttggtgcacagtcgttaacaccacgctaagagaacatggtgaacaaccagggtaaccagttttatatatcaagttctttctatggaattcagaagtcgaaaagtgttgcaatttaaaaatgacataaattttccccaacataaggttttattttattaaaaaggttctatatacaaaattggggggggggggggtggaaaccaaaaccatctatttccttctccttcagccttaaaatccttagagggaaataattcatgtttgacagaatccaagggataaaagaatattcgaaacataggaaggacacagaaaatcatacaatgccagaaactaaaggacagcctatcatacccaatttttaagcttttctggcccagtagcaaccagctggtagcaggaactagtgggagaagtcagcaagcatcaggcacaacccccaccaagacgcgcagagaaagatgaaggcaagacttaatggggcaaaaatcccccccccccaccgactcatcagtatctcagagttctccctgcagttaaaggaggatgcttacttctatttatttgaatccaataggaacaagacatgaaaggaaagtccatattttgaatctgggatataagctggaatgtcctggcccaatatacccaaggcttatccaagtaaataactgtaagctaaaagaatgtccaatgactaggtggcccttagtccaaaaaaaggctgggctccaaatgctccttcttaattttttccctttattttgaacctgtttttccatagaaataatgtgatacataacatagtgatacacttgtgttaggctactgcaaaattcagcactccagagtatacctaaagtttttgtttgtttgtttgtttgtgttttttttttttgagatggaatcttgctctgttgcccaggctggagtgcagtggtgcaatctcggctcactgcaacctccgcctcccgggttcaagccattctcctgtctcagcctcccgaacagctgggattacaggtgcccaccaccacgcccagctaatttttgtatttttagtagagacagggtttcagcatgttggccaggttggtcttgaactcctgacctcaagtgatctgcctgcctcagcctcccaaagtgctgggattacaggtgtgagctaccgcacctggtctacctaaagttttaaaagtactggcctgaggtctgggtcttgcgagaagggatcatagaagagaaaagaatgaagaaaataccaaaaaaataccttgctcctcatcacagttcccaccatagccaaaattatgaaagaggaaaaatgtttgttctgaggtcctcagtgcttttaacttttgtcccttcttactacaataaccgtctcagatatgtcctattcaagaataagcaacactaaaaatcatctacttacctccctcaataatttcaattcttaactgtcgctagaagttattaggaagaaagcaatctgattgaaccaacttgtactaatgtgtaaatgactgatttgtacatgtatttacatatacaacccaaagacaaacacacagatacacaattgcattacttctgtgttagctaggcaccattctaggcactagattagtggacagagttagaaaataataacattcaaaaataagtaaactaaaaaaatccagaatgtaataaatatagaaaatagagtgaaataatacataagaactggttgactacttcacagttggtgattatgaaaggactctttaaagatatcatttaagatgagatgtaattgaagacaaacagccagtcttgtgtaaatgaaggggatatgagacagctagtgcaatccaaagaaaggaatgagcttggtgtgtggatagaaaaaaaggcccatgggcccaaagaacagcaggcaaggaagagaacagactggaaagataggcaggggccaaatcacattggtcttggtaagacagagtgatgcttttcagagtttatcctaagttaaataagaagttactggaagactataagctgtagtctggcctgatttaccgcttaagatgatctctagcagaagcagggagacagataggaggctactgcagagatatgggtgagagaggacagctgtgtagactaggatggtggtggtggagagatagctagatgggctcaaacaagacacactttataggaaaggtcagccaggtgcagtggctcactcctataattccagcactttgggggcggcaggggaggggtggcagggggatcacctaaggtcaagagcttgagaccagcctgaccaatacggtgaaatcctctctctactaaaaatacaaaaattagctaggcatggtggtatgtgcctgtagtcccagctactcgggaggctgaggcaggagacttgcttgaacccgagaggcggaggttgcagtgagccaagatcgtgccactgcactccagcctgggcgacagagcgagtctccatcttaaaaaaacataaatacaattaaaaaataaagatctgtaggacctttgaccatggggaggagaaaaaggaatcaaggatacctggacggaatatgacttgttctcctgagaaaggcaagatgtggaaagagtaggtttggttaaaggataaggccattgggcagtagaaatcaacagttctgttttagatacagtaattctgagctgcaaattacatgtctggcatcaatatagggaagacagctagtacataaatctttcacttagaggaaaattgaggctggggatatacatttagcagtcattggcatatagatgtcatttacaccatggagactgatgtccaggaagtaagcatggaccaagatgagaagaaggatggagaccagtcttgggcttactccaacatttaaaggtgggaagaggctacttgggaagcctctttctccagagaagtaagtctgaaaaatggtgatttgggaagaggaggccctttctctattcacaggcacgggtcttcaagctcttgccaaaacacctaacattgagggtaagtgaagacctttatgaatccttctctgccagtagagtatgagcatttgctaccagctggtgcaaggaagaagctttgtctcacttgaaaatgtataagcttttccccatacattttgaatagtatggtaaaaacacttttgatgagatatatagatattaattccttccttgaggcaggaggactaacgggaaagttttcaatgtccgtctggcctttagaatctaagaatcccaaagtctaacctagaaagaagcagcagaatatcagacactaggaaagagcccttctgtttcaggaaaagtgccaaaacatgggcctagagaaaacgctgggccccaggactgctgctgactaaatagtaggctataaatgaagggaattatttttctttattcttctgcctgtagcaactgggctttgtcacctagaaacaatagcatcatttttcttaggagtcaggatatataataaaacattgctctgaatcagcagggtcaaaaaataaagtcagaaatgtgatgttcatccaacagcctgttcaattttcagtttttggaaaaaatgtctttatatagatatgattgtctgagattacctctgaatatattgtttggggagcttgctgcacagttaatattgcagcaaattatggaattctctcaataacagcacaaagaaatctgcgtcccgatggaaagcatttatggcagtgtagggaaactgtttcaacaacaaatgattctgttgtattttccccaaacagattttcttacctcttgatgtctccacctggcttctgagttagttttaagtggcagaacaagtgactcctctaaacatgaaggtttgctgtaatccataattcatattatagggaaaaattttaattataaggctgccacaattttcaagagtttcttaaaacaagagacacacagaggccttttggaagactgacatttagaaaaagccagcttgagggtatattggataagaggtattggggagtaaaaacactttcaggaacaaggatttcagataggaaaagcattttttaaatccttttgaaaacaagagatgtatttggttggataaactgctgattttggacaattgttataagagacctaatttttgcctttatgatcattatttgcacatattctcctcagagactaaacccatgaccaacagcgtgtgctaacttggacacaatgtgattcagtgacttaaaccataggaaaagtggactccaacatattttcctataattacctcagatagaagcaacggacaaccacaatgttgattcctttggttttatatatagtctctaatcaaaacaccttaagaatattttaagtttttccttctgcttggtaaatttctggtaactctggaaaaagatgcaaagaaaaggaccaatatggaactgctggaacgtagttgggattgagagggagtctgctcttctgtaaggatcgatggtcaactgaacgacttcaaacagccctgcttgctaaggtgaaagtaagagaaccctctaggtctcctagctcctccattcccttaattggttaccagaagcatgtggagtctttaatcagaacccccaggcaggcagtcagttgcataacaccatgccttatggctgaccagtataaatctggatacttcatccatggttaatgaatgaagtgtccagatttatactgttcagatcatcctaacttattcaatataaaaatcaccagaaatacaattttattaaattttttctatgtcccaggtgctttactagatgcataatttgcaggtatttttttccaatcttgaccataattctgcatgttaagtatgattatccctattttttaaatgaagaaactgaggctcagagaggtgaagtaacttggccacagtcactggacgataaatagcttcctgaagaagaataactggtgaatttgagtagaaagaaatacatgatttaaactgtagttgttttcagactcaaaccaaaagtcaggcttgacaactatggcaaactttagtagaaaacaaagtgactatctcaggactgtgggaaatatggaaagtggacagtgaatagcaccattagcacagctgtatttgcttctagtcctgccttttcccaagtctactgtaatgcttgtccttggcttggtatttggttaagaacgtgggtattgttgctcaaagtaaaggctatatatctgtcaagatgctaattagtgctggagactagatccagagtttcagttacaataagctctggtgtgtaccagagtcacttgtgagctttacaacccacattcctgggccctgtcactcctagatcttccagaggttgttgatggttcttagggatttgtatttcttaacaagctctcaggtaattctgatccccaccaaagtttgaaaattattgctatcaatgttgtttgggaagatgatgtcttactcagaaatatgagtaaacataataaagtatagttgcaggtcagacaaaaaattcagcttgtaaggaatgcatgaagggatgttcatgaaatatacatttggcctgtccacttttgtcaggattacttttttcctgtcttgatcaatgcctactttctcttttgtctcattaatatttgggtcaagagaatattttatcaggtctccagtaagtacgttttcctagttacctaaatgaatacagtttcatagagatcattaaaatgtaccaagtatataaaagacagaaatttggttcttaaagctgactctatatttttgttttgtcttttcaaaagtgctcattgcaatgggaagctgatctgaaaatctatccatcaaaccaatctggtctcttacaggccgtggagaccctctggggatctgggatgctttcctgtcattgcaatgacactgaccggcttttgaaccttgagaagggccatgacaatgttccggcagtaacatttatttatacctcagggctctcgtctttcataggtcttggtttgttatcacagcccttgaaattgtaggaaagaaagtgtcaagaaggcaaatgaacttctgctactgggggaattatacatgaatgtaatttgtacctggcactgatgttccaagtgcgacgaacacgactgcagtcacagaatctttcaggccaatggtgcagccaaagtgggaagccaggtctccaatgaaagctgtcagtaggccaatcatgaggatggagacaatgaaacacgcccagccattccagtattcagtaggggggacgaaggcaaacaggaccttccagaacacagtcagaaagtgcatcacgtaatcgaaacaggagggcagcttctcttccccacattcatcgtcgtcatcatcttcccctagagagaatggaaggaagcacatttcatcacaacctgtgttgccgggtcttcctctctctcaatctctcctatctaggtcggtcatccctccactctgtgacaggaggccatgagaggtgggtgaagtttagggttttccaagagttaatcataactaatgaattagttatcaagacactgaaatgcctcttacctgtggctcattggtcaatggcaaaaacttaacccctacccagttctgcatccatgcaatcaacacaccctttctactttcacatctggtaagacttgtcacttcagagaaatgaaaatgatttattccaaaaggctggcaagccctgtgtcagcctgagaaataaccctcttttgaagaaagaaaactatagatggagttctactagggttcttttcttgcaacttgaagtccaactctgggttatataatcacctacaggataatgttcacacagggccgttaatcatggctctgagccttgcatatttctccagcgtcatctcctgcaactatttcaaactcaagccttggaattacttgccaaataattatatgccaaaaaatgaaatttatttgcatttttccaaaccagatacactttctcctacttttgttctttagaactaaatgtgcttggcatatcctaatcgctccacccttatccttcctcacccatcctttaagactcgcttcctctgtgatgcactctctgacctccccccaaacccatgctgggaactccttctcagaggagcttcccaacacttgtaactctggatcagtggttctcacaatgtgcttcctgagcaggtggcacagagaacttattagaaattcaaatgatcagtcccactgaatcagaaattggggagggggtggacagcaagctgggcttgaacaagccctccatgtaatactgatgcatggtcaagtttgagaaccgcttttctaaattgtacatgttcatgttctcttctccagttgactgagaacccttccagggcaggaattcatgcatctttgtgtccctgctgtttgataccatctccagcatgtgaacaaaggtggttaagtatgtattaaatgaaggagtgcatgcagaaatttctattgactttatataactatgcaattacctgatatatatatatcacaattttgccaattaagtcatattatcagtgtacaaagaaatgcacaaagcatgctatttaaaggaaccaggaaatcaataatagtaatctaaaatggagatttcacttatgtgaaaataatgcccattgacatgttttaaaatgaggatattgaatgtcaacttttcttgaagtggtggcaaatacatgtgttatgtggccattttggaaagaagaacatctccttgaagtctttgttgacccattccaaccttgtcatcagggtgctactttacttggtcccactagtgcagccggcagtaggtggggctgcaattttccacctgaaccacgtgacctgagatggccagcatggagcacacatgtatggtcttcgtgagacactctgtggtaggcaagccattgggtgcagatgatgattgagaagaccctctgaaagcacaagagatttgagggaaaaacccctctcagaaaacatctaaagaggaatgtctggatttgtcctctgtcattttacaggaaaagagaagaggcaatggcctgctctttcatgagcacatggttggaattatatgaatacactttgggcgtctgtgaagaaagcagcctcatctttgaggctttggataaactgctgggagaagccattgcagatgagtggaatagcctttggagaactccccagtgaggagcttgagtcaggtcagctcatcagaatgtttgtgagtgaaaaagcattgctgaccgtttgctctgctgttcatgcagtatttattatatcaactttacctggaagcagaagatactttttaataaaaacacctggtatgggctgcactgtgtctccccaaaattcatatgataaagctctgtcatcacctcagagtgtgaccttatttggaaatagggcctttaaaaatgtaattaagtgaaaacagagccattagggtgagttctaacccaatatgactggtgtccttataataggaaattgggatgcacagggagataccagggatgtgcgtgcacagaggaaagaccatgtgagtgtccagtgagaagacagacatttacaagccaaggagattggcctcaggagaaatcgaacctgccaacaccttgatctcagattttcagttcccagaactgccagaaaagaaatttctgttattcaaaccacccagtctgtggtatttattacagcagccctagcaaactacagcagcccttcagaagcctctctatatcatgacgtggaaatgtaggaacaattactcagtgtttctattacctactcttttttgtttgtttccttatacatttcttcttttttctttcttttactttccttaccacttctcttttaccctacactttagctccaggtagaactccatgttagagatgcaattctcagggtttatttgaaggaggaaggaagaagaaagtcacattaatacattcccattcccaggctctcctcttacccactccccattccagccggggctgagaagggtgcatatactcagaaaagttgagaaaaagcactaggttttctagttatatttattttggatcctatcctttttaatttctatatttgtgaacattttataatttcacagggcatatgaataaaatgctttggaaagcattttaatcaatcattcacagaaacatgaactatgctgccttttctctacaaaattacttaatttggggcatctaaatctcttattttgaagacgaacaagagaacaaataatgaagcttctcagaagaaatgccatttataaattgagagtagacattatatttgtcttcaagatggaaataacacctttcccgtgagagatgtacacaggaataattagatcatgtttgtaaagtgtctgagaatatttcaaggtaatgattatcatggtagttatcattatttccctccatttaagattgttactgtgtttctccatcattatttgtttagtcaacatgctaggtcctaaggttacattataggtttttaaaaacaaaaattaattttgccctctgaaattaccttcatgatcaattaatgcaaaatgtgtgtgtgagtgtgtgtgtgtgtgtgtgtgagagcgagagagagagagagaacgtgtgttctttctgtaggcttccaatatcacaaagaatcttaaatgttttaatgcataagtctggaatgggaggcccatctgcttttataacatttgaaaggaaagtggcctcccatccttttctctgggatctcactgctctttataaattttaatctccaactcagacatcacttaaatattaaaaatgaccacggactgccatgcatgatgcacaattaccctgtcttgggaaaggacaaagaaatatcatgttcatccatcaccatctggactacacttaaaagtctgttctttctttgtgaagagtagtgaaacattaaaaaatcctaggagcatcttttatgtgacagcaaaaatgatggtaggatgcctgttctgtggttctgtatgttcaccagcctagggttcctggaggctacataattctttcaagtcccttctctgtgttagaaaagaaagacaggttggtgggtttgcttttatagaatcccaagtaaattcctcttatctcagaatcattcttttcagctaatggaaaataacctgtatttgattaacccttcctattgccttttaaatggcttccctgatacacactggacttcttaaatataactacaaaagtaaccaaatcattaaaaatgcagatagtgcacagggtgtcagttcagctattgatgtaacagtacttggaccgttcctgctcggaaacatgagagcaagagcatcatcagcatgactgacggtgaaagacaaccccctgggctttgcatatatctttcttttaaagtaaacaggtgtttctttacgtgtctctctacctgctcagggcttgaattcagggagagctctgataaccagaaaaagagactgctggaaggtaatggacacgtgggtcagaagacttaagccactttatagttctgacagcttgttttggggcaagacacttaaatttcccaagcctcagttgctcacctgtcaaatgagtttcctaactcccatctctcagagctgttgtggggattggaagaagaaatgctcaagtcctttataaaactatatgcatctttatagacaaatgtgccatattccattattgttacttgtctgaaggaaggcagtatatcaatacaatgtgagtatcctgatttcactgagtatatattctgtttgaatgagccattatcattcatttccccaagctgcttgcttttaagaaaagaaagaaacaggaagggaacctggtggggtgtctcttaaatgacaggcactaagctaaattctttcacatacctgatcttatttcatccttaaaataacactgcaaagtgggcattattaatcccattatacatatgaagatcctgaagttcagagaatttaagtgacttgctaaaataatctcacacagaatttaagtgactgagttgggatttgatctaacagtccagggaacattttactatagaaaatgccttatggaagaaagtagaggagttcagtatcacatattgattcgaagtttgagtcggaatttttttaatgcctagtgttatatagatacagtggtacctttttttttttaggaatgtgaaaatattgaggtgccataattaatatttgtattctaatactttctagatacgatttttgggttgtttatttctttggcagagccagccataagctctttctcagacccgtggggaccaagaaaacatgggaaataaaacaatcaggtaaaagcaggggatcatggtgtgactgttttggaacctctatttttttctatttaaacatttgtttaaaattttatcatatgcatttgagattagcaatgtcatgttataagatatatttagatagtaaaattattatagggaggcaaattaacatctatcatctcatctagttactttttcctgtgacaagagcagttgaagtctacttatttaacaaacatttctaatacaatttcattagctttagtccccatgtggcccattcgatctctaaacatgtgcatccttcctatctgctattttgtatcctttgacctatgtctctcattgcctgccccaacccctgcccatagtaagatggtaaccactgcttcattcctatcttggtgtatttgagctcttttcaaacatatatattttccacatataagtgagaccatgcaatatttttctttctctgtctggcttctttcacttagcataatgtcttccaggcccatccatgttgtggcaagtggcagaatctcctttcttaaggttgaatcataaggaatctctcctttagagtgtgacaagttcttatttccatttctggttgccaaaggtcaaccatccagttctgaatcaaacatcttggtttgcctctagctcatcacccttgaatttgggaaagtggcctgaatcatcacaagtctgtatgtaaagcggtctggaaaatgtatgctgctgttcatctgcggatgtgtctgactttcgattctttccaggcactcagtaggctttctcctccagaattatgacttttttgcaacctgacatacagtaattacaaatcaaattctactctcctgttacatatttctgtttctcttttctttaaaggttctgagagaatcgtaaagaataaaagatgaaagaccttagcgatcagctaagaaaaataaaacagaatggtgattcaattgatacatttttgttccctagtttgcatctgtatatatctgtttgtgtatgtgtgagaaagtgtgtatgcatgtgtatgtgacgccataagggccagcagtttttactgtcttgctcataaaatgatctgaaacttcttttctttcttttcccttttacatgcttttaccttatgtctagtgacaccttatctcttcccactcttaatggcctctgccactaaattcagtaacccaaagatttattcccaaacaagagttgatctctcttttttttgtattttggagatgtgcaataaacatttctctataccttaattggtgggaagtacttaacatattctctgatgcaaagtagatgatgtcaacaacttttcttctaagtatattggaagacacttcctatcaacgatagctcagaaaacaataggttcgaattcctagatctatgagttgccagtgcacagaagaaaatgtaggcattttcttctaccaactgaaacgtgggtcttagaaaatacctgagcttaaagctttaggagggttttgcagtgtgccaagttcaaccccggcttaatgtgaatttctttaaaatttctctgccgaatggttacttgtgccacttctgagagtttcagctattggggaactcataatctcacaatccaggtttagagtctctggcagtcagctcaggctgttaggttctactcatttgtccaggccccatcccctaggccagtggtctccaaactttttggcaccagtgactggttttctggaagacaattttgatggttttgggatgattcaagcacattacatgtattttgcactttatttctattattgttatgtactcaccataatgtggaatcagtgggaaccctgagcttattttcttgcaactagatggtcccatctttgggggatgggaggcagtgaaagatcgtcaggcattagagtctcataaggaatgcacaacctagatccatcacattggatattaatactattgtacataaaatttgagttcaagtttgctatatatttgtaacttggactactggactgttcttggatggagaagacactatacaggccccattagccatccctacccgcttcttccaagccacagctaatctgtgggccatactgtcccacgggactagtgctacttcttaaggggtttgggccaggtgatgtgtgacagtattgtaaagggcgtcaagaaggcaactcactctctgttaataactttcaaacctggctgaaatgaatgaacatctagatgaaatcatccacaaaaaacagaatgcttacaagcttaagccattatggtctttgttggggtggttaacatagcacaagaaatatttaacgtgacagaaatatttctcagcaaatgtagccactgtccaaatgaaaaacggattcactaaggagttctagctccatgcaagttcgattattaccaaaacaaatctgtttaaagctgaaaattgatggctttagtgtctcttgttcctaaaaaaaaatccgctatatgaattgggtgttcctaaattacagtttaatgtaattagtcatgtgtgtttttgccccaagcttggttgtttataaaataactccaagttagggtaagaatcttgaaattcagagtgttctcttacccttaactaattgtaggactgacagaattccaagctcccgaaatagggaaacattccctgtagacttgaatacctaagaaataaggctttgtcaagtagaattggtactcagcaagtgtagatacctcctgctagtgtagatggtttagttacagtgggaagtatgtgggcacaccaggttctaagactggcctgaggactctgataacactttgtaaatatcaccagctgtgtctaaattagcctcctgtagtgtgggaagctgagtcgtgaagcaactgtttgggcagtgataaccctataatttttaacagacatatcaatgttatgtcctagagaatgttaacatgtatataaagggtaaatgtatacccaagtctgctccacatgcagaggggcataaatgctgcccagagcctcttaagatgctgctatgattcatctatgaatgcaggttcacttactgagtgttacttttatgcatgtaggtaaaagtgtacatcccacttagtcttcatcctcccaggagcctgctgcagtaggtattattttctctgttttagagatgaagaatctgaggctcacacaatttaaatgacttgcttatgagatctaaaactctgtcacctcgctacaattacatgacccatggtttccatagagaaaaatctctgtggtttgtacagcaaaaattcattctgataaaatgtaagctcacttagcattgttttatgaaaagtgtaatggggaaatgtctctcctccttaaattaactctctggatatgatataatacacaaaatactatattgttctttcagagaatgaatggctggctcaattttattcttcctggaattttatttaaaaaaatgcatctttatgcaaatcctctattcgtgatttatttcagcctcattgggaagtgggattctcctcattttggtggcaaacatctgtctctctgggcagcaaatggaaaggacgctggctctacagcaatgacaataacactctcataactcttttcctgatctcaggatctcctgaatggactctgttctgaacatagggtttgaaagttgacgtttgagcaaagtggtgatgcaaattgagtaacagtctaatgatggcctcggtttgcacaatacaaagtgatggcagttgctcaaggcacccctcatctgcctgttcctctttccttctttctgttgtgattttttaacgagatctcagtaaacacggccctccactgaccgtaaggtcccatgatttacttgctcttggccacctcacagatcctgtgtgcctcagtttctccttctggaaaatgggcatagtcaaaaccaactttctcttttgtgctattggaaaggtataaacaagatttttaagagaagttatatgcttacatatagtaaacttagttttggcttgagggaaattagctgattggtggaattcagatggagcatctccttccctcactgctcctgaacacttctattagagggtaagtaggctaaggtgggtgctgacaatcttgtttgtctgtctgccatggctttcttgtctctcataaatagtaaccatgcatcacgatgttgtgatgtttttcttcaatatcagccatctggaaaatctctctttccctcctattgtcaataagtcagtggcctatcttttttatttggtcaaggcctggtgcatattctattaagtctgtaggtttgaactctaaaatattttgggtcactgttttgcacctcaagcccaggctgaacccctaacctggacctctaggaaatcttcaaagggaatgggatggttggaagactgactttattagtgccactcatttctttagtaagtatttattgtcaacttatgtatcaggcacagttctaggcattgcaaatgcagaaaaataagatccctgatctcatagaatttccattctggcaaggggagatagtaatcaaagtaaacaaataacaaatataatatgtaataatttcagatactgatatgagttatgaatataatgaagtctggtgactgggaggccgagaaacccctctgagcagttgacatgtgagctaagactttagtgaggagaaataatcggatatggagggaaagtattccatgcagagaaaatatctcatgcacaactgtgtagagaacagaaatatgcctgtgtcctactggcattaagctttgggaggcaagtgtgacaagatggaaagaggattgacttgggaatcagaacttgtgggtcagggtgggaatcccaacttcaatttctccatttcttgtaaatgggttcatgagtagctactgcacgaggctgctgtggggcttatgtggatataaaacaactattcaccaattgggagaccatttggtcactcagtgctgctaaggtgttggtcaggaaagcttcaatctttgctttgtctaatcctaaggcatcacatcaccaagaagcccattggtcagtaggtaacatcagagggcagacatggagtatctgatggttaaggcgttggttctacaactccagaagaaaaatgagcaatgctttatggtgcagcaggagccttgggttctaaaacagtctctctgtgatcttggaggagactccctctctctgttctcaggttcttatttgttaaaaaaaaaaaaaaaaaaaaggcaaggggaggttagaatcactgctcctttccagctcggggccaggattctaagatgctctatctaacaggccataagacacaacacccagccagacctgaccaggcaaaggcaaggcaagggagaagcatgcggtgggatgtatgtgccaaggttggttcacgcgagtggcttttcattgcaggagttggaaagacaaggtctttatcaagagagcaggctgtgaacagcaagaagtaatgctgccagtcacttttatgtggctcctctctgcctatggagagtgtttgtgtgtggtggagggtggctatggtttctcttccttccacttctttgggttaggctgcaatgtttcccctactgaaaacagcatacaaaggctcccgactggggatgaaaagtcccctcatgcctcacaccttgatttgcaagcaacaactaaaactgtattcacattgcagcagcccatgccaacaaaagagctcttggacccagtgatggcacattgtttgcagagcagagctgctgccaccccagacaaaactgcgttagagacacgacttcgggcatacaaataagagtgctgaatcattctagagcccttcaatacggtgttttcctcaagattttataatacgcaatttaagagaagaacagaccaatgagccaatattcttttcagaaacatcagctaaagcatatccagaggccagaaaataattgctttttttctcccaccctctcgtacttccacctttgtttctggcctgccttgttctggaagtggaaactgtagctacccgattcaacattttctcctgctactgctgcatttttagatcgacagatatcctaaatttgctttgctcacctactagtatgtccctagaatatctcccataaatagtttatatctggaacttactctgtctttcttcttagtcatgtcctccgcttttcctcttaggatcatcattatcagctacataacagtgaaattttactaagaatacttaagaacactgagagaaaatgtcattttatatttgcatgtccaatttgcaaatacacagataaatatatcttatgtgtacaaatatgtgaaagttcacatctccatgtcaagtgatatgaagtttgacatagagaaaacaaatgtctcaaactccttttgaaacatggcgtgtgtatggtgcgtgtgtgtgtgtgtgtgtatgtatttatatagattgttttctagatcagacacagtatgatgatgtcttttaatccagttatatacggattggaaaactttaattcacaaataaatgtattcattctttataaaacaaagacttagcattgccaagcgctgtcttagtgccaagcactgtcttaggtgttagagaaatagcgatgaacagggcagatttgcggttgttgttgcttttttttatttagattcttcctacttctaagaggacttgagcagatctgttcctattaatagagcataagatattttaagacaaaaataggacaaaaaatgtctgaagcagaaataaaggatgcttttagtcacctgagttgactgaattttgaacacgtagattaaaaaaagactgtgctttccaatggccaaagcaatttagaaaccattgaattatatagttatgatcttccagttgcaaggtgacaaaaattaattttctagggaaaaaagcttctctttaggaatttatcatgttttctttaaagtttagtgagtggcattgtgaggttttataaaagataaagtactagctttcaaatgtcatacattaaagataaaaattaaaattacagataagttaaactccaatgagggcagttttaaaagaggctctgataagaactttaagatttactttgtgatatccaattctcatcaaggatgaatggctattgaattcacttaatgtgaccattaaacagtgtattttaagcaccaaatgtcttaagtgacatattgtgaagtcagtgtaattacacactttaacatgtattctaaggtaggtattgcatcttgattaaagttagagtcctaaatttctttctttttattaataaaaaggaaattctttattgggggcatgacatgcacagaaagtatgtatttcttgaaaggtacttgaatcttttgtatcactctcttacataaattctggtgcagcaaacaaccttccaatatatagttgtttatgtgcaatgaatacaggttagaaaaacctccaacatagtaaaacaacagataaatagagttaatgtgaggcagaagaacaggcgtgagacttgtagtttggatactacctctgcagttttttgttttgagacacagtcttgctccgttgcccaggctggagtgcagtggcatgatttcggctcactgcagcctctgccttccaggttcaagtgattcttgtgcttcagcctccctagcggctgggatttcaggtgtgcaccactacgcctagctaattttttttttttttttgtatttttagtagagacagagtttcgccgtgtagaccaggctggtctcaaactcctggcctcaagtgatccaccagcctcagcctcccaaagtgctgggattacaagtgtgagccactgcacctgacctcctctgcagttttgaataagatgggtctaccaagaaaagcagggtggcagcttgggtgggacactcagcaagacctggatgtgtaataattacacagaagccaggcatggtggtgcctgcctgtagtcccagctactcaggagggtgacactggaggatcacttgagcccaggagttcaagggtacagtgagctatgacatgccactatgatgtgccactgcagtccagcctgggcaatggaggagaccccatcttttttaaaaaaatagaagagagactataactgagatttcaaatttccaaattcaattttgtcagtacatttcaaaccgagaaaatgtcctaaatgtaatgaactagcttacattttaaaaaaatatcacttacaaggatggattggataatttaaagatacctgtgaagtaaaattagtagtaatttgtgtgataatttagaactctaaatttcaaatagcagttacacggaaagcaagttggcattttatttatgagaatgaagggtctttaagagaccctttagtatttccatgtcctaaagacaactcacaaggtcatctcttctaatgctattaactcacaggggaggttagaggtcttgtccagagccccataactaattggtggctgcaccagaattcattgaactcaagtatctagagaagccaaagattccaacaaataaagaatttaaacactttatttgtcatccatgttatatgtactctgtatcacagagaatgggaatcttttaactctacactgaaacaaggaataagagctaagttggatggcagcagtgttgctcatatctcctgttggtttcaaataactactatttgacctttgttcctacctttttcaagcatgccagtgattccaagcctgaaacaacctacctacctagataactaataatatcacagagaaagagcaggagcttggagaaaaggctgggcattgattccattttgtttcataagacctgacacaatttctagctccagatataaatacaattcctacaccacaaaaacattccttatgatgggatttagtctggactttctaggaaatccagtaactgatcctgcctactttctaggactgattctattcttcctggtccttctgcacttctgtcccaggcttgcacactcatttccaaacccttaccttccccatgtgtaactgagattaaaagacttgttaacttcatcccttttgtcctgaattaactcatctgaaatgtgagcacttgaaacctaaactaaagttgtaggaggaacacctaggattgagctgaaagcctactggaattagactcacgatgatggggtttcatattccagctaatcacttgctagttgtgtgaccctacacaagttacgtaaccactctgggcctcaggatccatagttgttaactttgggaaaaatgacatagctcagaatataggtgaagaacagaaataatgcctacaaagtaccagccatgtcatagaagccaaatggtaacattaaacaaaaagtgggccacaatttttaatttatttttatttattcttttttttttttttttttttttgagacggagtcttgctctgtcacccaggctggagtgcagtgttgagatctcggctcactgcaagctctgcctcccgggttcatggcattctcccgcctcagcttcccgagtagctgggattacaggcacctgccaccatgcccggctaattttttttcttttcttttttttttttttttgtatttttagtagagatggggtttcaccgtgttagccaggatggtctcgatcttctgacctcatgatccgcctgcctcagactcccaaagtattgggattacaggtgtgagccactgcgcccagccaaagtgggccacaatttcacactcatatgtctttgacaaagttttcttttttgtttttggagttagggtcttactctgtagcctaggcagtctagtggtgcaatcacagctcactgcagccttgaactcctgggctcaggtgatcctactgcctcagcctcctgagtagctgagactacaggcatgcactatcacacccggctaattttttatttttttgtagagatggggtttcactatgttgcataggctggttttgaactccttggctcaagtgagaaactttcttaggacagttctacctacttttgctcatgagactagcatccttcttcatgaacctcagtcaacatatgattttagacaaaggaaaattatgaatgttgatatcacataagaaaaagggcaaaatgagaaatcccattggtaacaccctcctcctttttttggttgtcttctagacacactgaggctatgtcaaatctgacacagcagaattattattattattattattttttgagatggagtctcgctctgtcacccaggctggagtgcagtggtaagatctctgctcactgcaagctctgcctcccgggttcacgccattctcctgcctcagccttcctagtagctgggactacaggcacccgccaccacgcctggctaattttttgtattttaagtagagaggtggtttcaccgtgttagccaggatggtctccatctcctgacctcgtgatccacctgcctcggcctcccaaagtgctgggattacaggcatgagccaccgtgcctggccctagcagaatttttaactgcttaaattggattttcagatgacctaaggctaccacaaggattaagtaatgacaatttccccatagtaatgatgttcaataacagacgagatgctgaaaagtctcctgcttagaccagatttcacggcaatcccttgaaactcatttgaggtaccatttttattaagacttttagagtagattagccttcaggctgatagtcaagtgaattattgtccaggggaccactgagttgacagtattttatattaaataattgaggatattaatccacaaagcatgcatggatggactgatgacagaagcgtcctttaaactgaactagtatccatattggactggtgggctaaggtgacatgccctctacttatttatttagctggaactgggtcactttaatttgctgtgaaatgtagtgagtgtggacaggtcagcagcatgcaccagctgggcctcatgtagaatgtcttcccttgtactgtagaagattccactggcattcccgagatccaattatgtaacaggaagataggcacttctgaatcatcatctcacttggctttctttgaggctaaacttcaactctcctctaatccccttccttctagaagaacagaagtgaagtgtatgctgctattgtgctgaatatttagtttaggcaagccagaggatgggcaagatatgcttttccattgtcaaaatccaacgggccatgaagcaaaatccccatcagggctactgtaggactataatggccatcgacagagctcccatgtttcagtattggatggtatcttagagctagcctagtccaactctctccttttcctgatgatgaaaccaaaaatcagaagtgttaaattctttgccaagattatacagttggtaagagacagaaccaaaactgctggagtttttttttttttgagtcacttttgagtattctttcgttataaagatgccaatacatactatgtctgatatgcaaatggatatgtcaaaagtaaaacaatttcaggaaactctttaatgctggatatttaacattaggtaaaagaaagagggaggagtgtgttgacttcaaagaatgtcacaaattactaggcaggataagcctatgggtgcacctaggaaaacaaattcttccctttgttcttcagggaattgactggcatcctccccaaggaacttgtgcactggactataaggagacctaacaaatattaaggaaaaaaaaaaaacatttctatttcaagctgcggctccaatatccaaacaaatatctactatataatgtgcatgtctatgtatgcatgttttgtgtatctttgtctttgtatgtgtgtatgcctctgtgtacgtgcatacctgatttgtatgtgtgtgtctgtgttcgcacaatgcatgcatgtctctgcgtacctgtgtatacgtgtgttctacatgtgtgttcactcaggcctcatgcacagcaagcaagtgcacccttcatgctggagagactgttgggctgatttgttgcctggtactgccccttaacagttttgcttcttgagcaagtagttacattgtttttccaaacctcagtgttcttatttataaaatggtatgcatgataccatgaaagaaagaagttaaccagtgtgtttttagtcccatagctattttattaattaaattgaattaactgcatttgcacaaaatttgatcatattttattataggttctataatagaattgcctcccaaacaaccaactttggcgtttccatgtacagatggcctttgtgaaaatgcatacggtttaaattaattcttatggcagctctatgaataaagcagttatctctactttacatatgagcaaactgagattctgaggtgtgagcgaactgagatcttgaggtgtagtaatcttcctggagtcatccagggaggttttggaaggcagggacacaaacccacacctgtctccaaagccagccttgcaatcattctctcctttgcctcacctctgcccaaagctgttgtgaagaacaatatggtggttgtggaactggcactggcatcctggttccctttatccagctaatgtttgccctcttctctgacacacttgtttcccttgatacctcagctggcacacgattttttagagtcgactcaccattctgccctggtagaaggagagagatttgggaaaaactcaaactggacagggaatgctggcttcatggagaagggcatatgctggcacactttaacagcacctcgtggtcctggacttgccttgcaagttttgacagccattgaactgcagaacccactgttcctagtgttcaacccaggaagaaacagaaggagaactgccaggatgtaactgcttaatcgcttcctaatctctggattctcataaatcctttaactcttcaaatatggaattaaaagaactgggttggcagaatcattatggtcacaggaggcccaagtactgagctatgaaattcagaaaaagcagagggacaagaagattgccacagggttgactttgaaaccagtttgaatacagttactgagaaagaaaagcaaatccctatttacaaaattattatttttgtttagcgagatatattgagttaattttgcacagaaaattgcatagcaaagaaacctctcagtagagccctttaaaagcaatttaatatttgtaataaggcaaattgtactgactctcaactatttagccatgaaattttaaaatccaatgaaagtctgacttcaataaatgctgctttacaaattttattgcctgtgtaacagcctaagaatactgacattctttagacagttaaatttaatcataaagacaaatactcaacttttgaaactgcccttcatgtaattgcgtataatttggtgcttttaaaacatgggtttgactttctgatatgttgtttctcaaaattgtaaataaggtcaatttacccagcagcctgcgaatttctaagcaattgtgccttatttccaagcggtcatttagaaacataaagcacaatatattgtatgacaagaagacttgagaggtttcatatctcagttattaacaattcttcaaaagctctaggcaggagttagttccatcatgaaatgatgacaccatggccgcaggtaatgtgacgcggccagtctctctgtgagagtagggagcaattttcctcattttgaaatttccttcttctaaagggcagtagatagcacactggaccagtcttcattagatataggatctaaggtctgttctaaagacatgttgcctctctcagactcagattcttccttaattatcgtaagataacgataattataatattaaacacaacatatgaaagtgtttgcaagtcaaaatccacctcttttaagtaaggcagtattaacatctttatagttgtttctctgtatacctattctcaccagaatcaaacacatgacactggccttgttggcagcataatcccattcactgtttaaagctgcccttttctattgctatagactggtcatagaatgtttccttgttcttgagagtcataaaactatgtgaatgaaccaacgtaaaccactcctctgctagaaaagcaaatttggccttaataggtctattgatggggtcatctcggccatctctctgaaattgcagactctatacgtatttcctgttcccttccacagctttgctttcctctatgacaaacttatcatcataaatatactttactttaatgtatctgtctgatttactgtatcctccattagactgtaagctccacttgggcaggggtatttgttgcattcgctgtcatgtgccttgcaccaagaacaataattgacatagaaaaacgaaggaatgatggccagcttatggttgttatacaaatgctcatatacctgcagctaagaaaacagaaatgattagaaatggttcagtataaggcttaggatgcttttaatgttttaattctaatatgtcaaggcccataaaagagtttgttcatttttaatattttctactattggcttcgtcagcagtttcttattctagaaatttttgtctgcttagttgtgtctgtgaagagggagtatagctcatgcctcatatattaagcttagatttatagaaaaacataagaaataaaagagagtttacccctccttctattagagcttatatgcaaattccaaatccactctcctgagcagttacccaccatttaatgttcataaattcccactatatattcaattgcaaaaaaccaaagcaagattataaacacactaataataaacaggcataaaatttttactaccctctcttctcacagcacttgggagatgtgtcaaattaccctgtggcagactggaaaaagggatttggggtagaaatcatggcccaactgctagtgacgcagtttccaaattttacagcttgggaatcactacgtatttaggaaactctacctttgttaattcgttgcaactgtagaagatgagcctggagggatctttaaagagagccagtgtagatggagcagaagaacaggaaaaaaaatccaaggacggggttgctttcatgaatctttaagagggactttcctgtatcgttatacaatcacacaaagagtggacagggtttgacaatacaggaagagcacacctctctctctatttaattccctcatgtttctgactccgtgagtttgaaaaacacttcattttgtaggaacttcctaaataaaactctgtactttgcttgtgcaagaagaaacagaatgtaattctatttctatttctagagccagtgcaaacacgtatttgttgcatgttgttgaagagagtgtaaaatgatgcagatggttgtggtcaagtgtcttagtgtcttccctttccacctaggattttgctgctttttttcttgaccttgacttggccacctttgtgctgcttacagggaattttccagacaaagcctagtgattggctattcgtgaattagagacacaaaacgctttaaatttatcttgtctatttccagaaagatgcaatatagatggaggaaaatgtcatgtgtgaagacatttgcttcatctagatagtcaatttagtctttaaaatgtgcatacattaacaaataaacttatttctcccttaattttgccatggaagccctttggtgctttgccatagaccaagtagccacagtaggaaaactcagctcagattgggcaattttaatttataatatgcagagaaaggcactcaccagcactgacagtgatagcttcaatgaactgttctctccagctgttagtcccaaccacaagggccaggtttgtcttcttaatgagtttgtccacagtactctagaaatgttgaaaagaaaaatataaatgctgggttcgctaaggcctcaggaaatccaagaccttgttgattttgaaactccagagttatataaagggtagcagatgttaggctcaaaacaacagtattgacatcaaacactgttatgattatgcaaacaagcatggtccttagttggaaacattctgaaatggaaacttctttgtagcaaatacaagtctccttcactgactaatgaagaatagcctcagtgtttagaatagcagatgctgcaaaagcccatccatccccctgaatgctttgccaacttgcttctctgctggtttcatctgtagtgtttcgtctgcaagtgaattaacatatgccctattcagcactacatatctgcgaatagccggaagtgacagattatggaaccaaaaaatattgctattgtattttgtttatcaatgaaatgtagccagataatggagtctccaggttgcctgctgcatggtcatcaataaatggatttgtctctgggtactattttgtcagcctcttgcctcttagagaatctcatgctcaccctattcctattgcaaacaagaatacacaaaaatacaagaaaagttcagttcttatggtttagggcacgttgcagtttaccttgccctaaatctcccctgctttactggcactgtgctgcataccccttatttttctttggaactttttaagcaccttgttttgtacaatcagtactctctagctttctaaattcagttaatgtaacaacaagagcagccaaacattcacgagaaaactaagtaagcagatggactgaaagcactactgcaagtcatggcaactacagggagaaaagtcatttccaagacactaaggctgctcatcccaagaaactaccacagtgactagtctacgaaacatccacacttactgtcagagcatccttgaatttccactaattgcaaagaggcagaaaacacattatttgtcataggtcgaaatctgtatatgttttatgcaatgtacttgagtggactatggtttaagagagcacatttccaactaactgggagtaagcaaaatgctatctaaagggcttgtattaaaggccaaaaccaaatcataatatcaagcatgtttgctcaagaagagtcattggaacagacttgaaacattgagaagataataagcatgaaagggcccatctccaactggctcactctgtattcatgacattattcttgaaagaattgtatgtccttacggtgatgacctttcagcttccagctttgtgtctagaactgctggtgcccctgataacagctgtaaccatcactgctcttggccaccataacttgaagcacttgaccagcatccatctttcttttctcaactcagccacatctcatcaagtactctgaccatcctcactgctacaaattcaaagtgccttgtagaatgtaataagaaatgacctcgatttttcctaatgtagtggaaacttgggacagttctctccaaagaggcactctgtgctgaatccatgacagagtatcccatcacctgggaaataaacaattgaacagataaacttctctaacattgagcacagactttcctcaagaaatagctgctaaagaacaaatgtttaagataaactaaacttctgtgtgtaaaactcagggtagattttaaactgtagttcatgttaatcctgggggattatagtatagccagggttcttcctaggacttaattttcatatgtatccttccttgacctatgggaaaaatgggagtgaataaagatatagttcagacacctgaacttggacactgttgtctgtatttacctaggaggttcctaaatgcttgtgatcagtttttcactgcactagattttcaaaggcttgtgaaaacctcaccctcagcaatgggtgttagtaaaaccaggtcctcagtcacaccatagtaaataagaactcagtgggtaaagcagagtgggccattgaaaggtaccacccagatttgggtctctggtacagttctgggagctctgagtaagttctttaaaatacctatgttctagtaaaagagatttcttaaataatataaaatctaggctgatacgtaagggcagttctaaaacatgcccctaacgtgccttgtaggtattaatggtaactatactgatgaactttgaagagatgactggaaataatctatggaagctatcctacaaagataagtaccccaaacaactggtttcatgtagagacttggggcactttcaaatggtcagatcattatagtggttaccagaaagggctttggacccaagaaggctttgctgcctggaagactgtgcccggccttgcttaacttaatgcttcttatgggaagttactatgattgctcttcctgtcatgggtgcatggaaggggaaggtctgagatcatcccataagggagagaacacacaattccccaggagaacccaggcaaagggcaggggcaagcttgcttcaggaataccaacccatagactctctgctacagaaaatggcactcagctctctgattccaaatgaaaagagggtgaatgaggaagagggaggttgaacacacatggagaaaagatgagtagatgggtcaccagaaatggacagtctgagattccccgacttctggaattacagggaacttgtgcacattccaggcatggttgtgcaacaagccaagttctgtgtcatacaatgggggtctaatgatcggggtctgcctagaaagcattggttccactgtttacccccggaccccctcctcctatggaaatgtgtgaaagaagagttaacagacagattctcagtggcctaaaggaaaaagattaattgcatttttatcttaaaatattccactttaatttcaaagacattttgttttccacctgtctcctatcaggcacctccatttgtgaagtaaattaaaaaataattaatggatccagctaaaggaaaagaggggactattatgagaagtccagataaaatctgaaacttctaaattggtggtctgattctctcttttgaaaccttcattctggtgtttcaaacaggaacagtgtctgcttttgaaaagtaagcaggtaaaatactgctgtgctctgggtttgtaattctggaaagcaagagaggggatgcacatttcatatcccactgcagaactgaactgtttcttcccctgtggtcttcccagatgctagaaccatgtagggtagaagggatgggaggggacagagggagcagctaaggatcaacaggaaatttcacttcaaagtcttaagctccatccccaggcccacacattcaacttctgcaaaaatgacttttatcatctagagaactgagaatccaattttatcagctcaactgtaaactccggttgcaggcactctgcattcggtatattgactgtactaaaatgtccttggatctgaagaggatgattaaatataaatgagagcttgtcaatgggatgttccatagggagatattactatccccctgcaaaacaaaagcctcctaattttcagcagtgtgaatgccttgctctgacagatttattagcattttcaaatagaacttggtttcttccacacataacaatctcttaggattcacctttgcatgttccttgctgcccctcagattaaaccttccctttggggcacctctgaccttgtgcagtcatagatgtctcctgctgggccctggttcggatgctgtttggtttacaggactccttggttcctgattaactctataattccaatttggccccaaaggctctcaattcacaagccagttcctgaaattacatctactactctttccaggtggatcttaagctttggccaaccctatgaacagtttctgtcccaaggtgagactggctcctggtgggcagtgttggtgagcataccttgaattcataggattcttcaatgatcacttccaacttggtgtgctctcccaggatggggcgccccatttctgcaatgcgcctctcctcttcctctttgctggtcagtggctgcttgtcatcatattcgtctgtgaaacggaagtatcagagagtgagcactgtgttctgtttaatttggaaatccctggatcctgccataagaaagccaaggaggaaggaagccctaatgacctactaaagccccctgggtgagatcacgatgctggagggaagagccagacagacacttggcatgtaaggcagcatatcactgtgagagcaagtgattataacatctcacaatctaagctcatgcaaaagttcagttgaggaaaagtaatgtatggggcatatcactgagaaaagactctgcctgtacattgtctatggtaagggagtcacgcagctattccctgtgacgctggctcagttggctgtttgtacacattctttcagcacgtgaccaaagggaaacacaattgaaagtgctagagtgaccctcagagatggcggagtctggcctcttcctcttcactttctaggggcaacagaaaatgcctgaggcccaaagagatggggaacaggaaattctgactttagcctctctcttgccaagagaccctattgcaagttaaacagcaaaacatccattccatatttctgtgagacgcttgggctccagtgctgcttcagtctggtgcaaagccaaaatttgttaggaaaaccttggccatgttaatcttaaagtaaacagggagggcgagggtgaggcctttcgggagttaaaatactcactcaccatgtgagcacaattatttccagaactaccatgtagcttacagtccaggagaggacggtgggtgctgaggaaatgttaatggatccaagagcccattaatgaggggaagctcacagttggctctctctttgtgaaggtcattaggataaatcccagactgaaaaggccatgcatataagaagggcaaacactggtcctataattacccttatcctttaggcccagaatgctgaaacaagacaagctacttcttctcagatttaagtggaatgaacattgtctccaatgaaacattatctgatatggaaagacctcagccctgatggcctcatttctaggacctctggacaaagtgcctccaacagggggctgttgactaaaaagacatgcaataaaagggatgtttggtcctggcttcctgcctggtgcatttaaatattagcttctgtagaagtccatacctcccattacctccaaagacccatggcctcccccctgctgagggaccacgctatggtggctccattgttgctttggcagctgttgcagggaatgaatggttcctaggctagctgctcgttgtgagggcagggagtgaatgagctagaggcagtgccagcatttaatatttcaagggtcaaaaccaacaaaaggcaaaagcagaatgtagcatattgattaattctttagtatacattttatagtgtcatcctaaaagcccattttaaaatctgctttcctagcctcagagattacagggcaccaaataaattagttgcagactaaaaataaatgattttggactggccagaagctgctgaatgttagcagaggcaaaggagaggggcaaggagattaattttaactataaaagtggcaatattttttatagtaggattgggaagttatgacccaagggaaggcaaagagttctggttctccaagatttgtccttgcaaaattatgtatgtctagtcaagagaggtggctgagatacatgaagtgcaatttatccagcactgaaattaataatgttgattaccactgctttgtgatccttgaacccaggataatgttattagtagttttcatagcagtagtttatgctagcatctttgtttgaaactttggctgaacatggatgagttgaagacttacacagaacaagaatggttttctcagaagaaggaatattacaacttggacatctatttaaactgtgaagctattgggggagaatatttattatggccttctttttgtagtttacttataaatgacaagctgcttttaatgggactcaaggcaatctacctagaaaaaatagagaaattacaaaacaaagctgatgtggtagcattgttaagtgcagcatttcatgaaattaaactggttttgatcatggtattaaataactggacatggaataagcaaatgaagtcaaatcatacaatgagtgaaaaggttctttcttttccaaaaatccttcagtccttctgatcaggaagaaatgcttaattcggtgctgttaggtctgtaactagttcctagtatctcgacttttgtaccttttaagataggtagtcaaaatagttctcaggtgtagagcacttgccatcatctagctagaatttaataacttttttccattgtaaaaattttttaattttactttctatttgtggcaaacgatactagttttcctgtgttagtgacttaaagttttcttttaaaaacaaacttaataaagtataaacatgaggcaattttaaaaattacattaagtaaatagtatagttggtatgcaaccaaagcagtatgggaatgacaaaaattaagaaatatagtgttaacttatttcatactaacctaaaaaacagtaaggcacactgtttctatcatttgctacactcttgcttcaaagggacttagatttcttaattccacacttttatccctttatgtattcacctggacaagcttcacaattttcattttgttaaatcttatctttcaaaaccccacctcttctggcaggaaataactccctattgatgagtgagaaggtttatgaactaccactctaaccttatattaattccttaatattcgttgtgtgtatagaccatggacattttcatagactgtttttaaattttttaattatctttacatataaatatccagcacataaactcactgagatagaacaataagtttcattgtgctttgaaccatccttgtatcctctggcacctattacaatatatggaatatagtaggtgctcaataagcatttgctgtgtgactctccaactcactgttaataaagcctcttagttgctcaacccatacaaaacggatcattttttcattgagcacatctcattgtactccataccatgtcagcacttcctcctctactttccaggaacttatgatgtaatggggacaggactagacaatgggcaacttctaggcatgataaggactaggggaccagggttggggaacaactcagttggcctaaagggagtcagggaaggaagccttcctttcctgaaggaagcttcaggaaagaggagctatttgaagttggccttgaagcacatatagaagattgccgcccggtgaaggtgatggtaaggatagataggaggtggtggaatgcggaagttcattccaggcagagagaaatcaaagtacaatggtacagggtcatggaagggtcagggcagttttgacttaagtatcataaacttttatttatatgtaactgagaaatggcagctgtatagattctattattgctctacagttatactgataaattcacatttatggtctagatttttgactggcaaaaatgagagccaagtctaatttttaacaaaactgttttctgtctttagatactttctgttgaatacggaaatggtttaacagcatttttaaaattttaatcatctattttgtttccttttctcttggagcattggatcaaaagcagatcattttactatggttgaggtcagtttcatttctttacttctgcagagtgagataatatgctgtggttttagttttctcagatggaaaatatactctttctcctcctgagtgcacatgcacacttttaaaattcaccatattttattgagaagttgggaataaattacataacatcatagtcttaaccaatccaaacaacttaaagatcaaatgcataattaacagccactgctaaaatcaatattgacaggacataaaacagtcctggaatagaatcaccagtgggggatctcccttctcctgagtaattgattttgcaagcaatagcaaataataaaagctaataggtacctggcatctggggaaagcagcattttgagaaagctgtttctaacgctctctggttcaagctgtattttgaagcagagtcagtgtaagaggtgaagtgctgagagtgggaaaacaacacaacccataaggtccatctcattatcaagatctctacctcaggggacactgttgagagtcttcaatgtagtcacattttaaaactgtacaaacaacgtagaatttggagaggcggacaaggccagtggtgggacaatttgctccagatcattttgatcctccactcagaactatgctgacaagtcagaaagcagaggtctctcctgacaatttttagcatgtggctggcctctttgattggaggctaaagtgactgatacagacccaaatatcattagagatgatatttgggctctaaacctgtattagatctgggatagctgtgtaatcctctagtcaccctgtcaatgtcatttatttcccctgtggagaaaccccacagatgtactatcatctgggcatatctggctaacatcatgttgcctgggggcagcaagggcaggctctgggaagaaatacagctcagctttaaaagaaacttcatggttgggcaccatgactcattctggtaatcctaacacttggtgaggcagaggcgggtggactgcttgagcccaggagttccagaccagcctgggccacatggtgagaccccgtctctacaaaaagtacaaaaagtagctgggcatggtggtacacacctatagtcctagctactcaggaggctgaggtgtgaggatcccttgggctcaggaggttgaagctgcagtgagctgtgattgattccaccactgcactccagcttgagtgacagagagaatccccatctcaaataaaataaagaaacttcattacacttgggataaaaactgatgtgcgagaagaaatatttccaagaaatctggaatacattaaaactcaggaaagagaggccatgggatcagtcttctctgcaggctgggctggtccctactcagtgctccttttctgccctcacgtgcttgtgttttgttgtaatccaccgtaccactggctgccagagaagctgcagcattatttagcaatgttttacagaggagaggggctaaaatgcatgactgtaatgtctctaacattaaagaactctgggaggctgtggttttcaaggatcatgatgaaatgagtacctgcaatggtgattacagtagagagaatcggatgttctctagcatgaaccttcctgaagacaggttggcctagcaaaaggacaggcagaaaaatcagcagaatggattgcattgatttgctatcagagctttgtggaattagtaagctaaacatcacacccagatgcacacatcacaagcaacgttagtttggggattcaatgatcataggtcacccctaggtaggtcacagaagggagctctggtggaagttactgatggagatcactgctcagagatgagcgagtatttcatgagccaaacaagactgtgtcaacaaaccacaagccccatggtagtgagtacagccagattcctacaggtatcttaaatgatgtgtcaaggtccttcaaggtaccgcttgcagaagcatcatggaacaacaaaaggtatagtggcaggtgtcgtggttggcaagccagtcttcatgactgaattgaagtaataatgtttttaagtcaaccattatagaaatagtgtactagtgattgggaagcctattagtgccaacaatatagccttgtgtaggccatttctccagtttctccccatgtaaaatggtgataatagtacctgctctgtctaagacaggcagaatgttatgtacgcctgtaggttttgcagaggtaggccatcgtcacagcaactgtttggataacctagggttaacctaggcctagggggttctcattgaactcctggttcagctgacttccagattcacttgctatttgcctctaccaagagctacccataactgacctgggagtcatgagatttgggattcagtgccacctctgccatatgcttgtcatctaaacttgggcaaggtctttctcctctctgactctcaggcttctcagttataaagtgaagctgaatttgaacaggctttgttcctccagcctacagactgaagtgatgaaaacattttcaactgtcagaattttcatagtttggcttccttaaaaagtcttgtgtcttattaagtctattatgtgctgagcataataggattagaggagtaatattaaataggtatactgactgatttttaattagagaactctatatcttagaagttttggggatcaaacttacattcttctctccatagtgagccagaatacttaatttattaaattattcatgtttatatggtccagtttccccattctggggtacttctcacttttcacttaactggaagtcataatgatggaatttattagatacatgtgggttttgagtagaaaaggggttcaatgtataatttcaagatgcaggtagaaataagctagaggagaggaaacaggacagtgctgggattagaacagtcatcattaatttcttcaaaccttcatttcctcccctatgtgtgagaacaatgtcttactctataagattggtgataaagtgatatgatgaaaaagaaatatttacaaactctaatgagttataatatttagagtgttaccttgtcgtatgactggaaggtcaagggggaatgagatcataggcccaaacaagggcctttcaatgaggcaaggtctgggaacaataggtaaagatctgcagattccaaaagcacctccaacacttaatgtccatcactaatgagatctctgaaatattggtattaggctgtggatcagacgattttttcaatttccatatattctgcttcaaatttagattttcacactcagctgcgcaagtccatgtaaaagctgcaggcaaagtcccagggctagattaattcttcttactgcccctgcatctcaaagccttgactttaaagcctccaactgacttccaagaaaaaaagttctttagggcttgaagctgcttttcgctgtagacctaagttttagaactgtcctcaggagcatcagtagagagtggctcctaggcattctggtttgatttaggaaaagaagggtcatgtaaagtgagacgatttcttagaaagtaggaatggacaggccagtgtagaaattcccaagttttggaacattctcttgttctaactgcattaatttcaagtcttaggaagaggtgatggtaataggaaactgccatttcagattacagtttcagccataggaagaacttaatgaactaactacatgaaatgatagaaacctttgtaggaggtgattctgtcatcttggatgccagttgtggccgaggcaggaaaagttggatattatcagacagatattatagaatttgatgtaaagaagttctgagaaaagaaaactaggatcccattacctgagatattaaaagggaggacagttcaaatgacatagaaggaaggcccttaaaacaaaatttgggccaggtgcggtggctcacgcctgtaatcccagcactttgggaggccgaggtgggtggatcacgaggtcaggagattgagactctcctggccaacatggtgaaaccttgtctctactaaaaatacaaaaaattagctaggcgtggtggcacgtgcctgtagtcccagacactcgggaggctgaggcaggagaatcgcttgaaccctggaggtggaggttgcagtgagccgagatcgcgccactgtactccagcctggcaacagagtgagactccatctcaaaaaaaagtcctgacacattcagtaataaaacagaaagatattcaaacacgtcaatgtgtttttgacgtgtggctacagagcatcctagtagccacaagtttttagttagggtctctttatcagatttcacaggatggaaggtgctgttggatagtacactatttctataatggttgacttaaaaacattattacttcaattcagtcatgaagactggcttgccaaatttataccttcttcaaatctcccagggataactcatttatccttgggtgatagaattagagtgtttacaaggggacttcaagcagttaaaatgatggaatgagaaaaaggagataaaagtttaaaaaaaggagtataaattcctgcacttgacttaaaaaataacctttagtagtgcacagttggggacatctgacccagaagagcttcagatgaatcagatttaagaaatccaacacaaagacttgtcctgtttaacattcttatccctttcaacttctgtgtgtctcagagtctatgaatcattttgtcattaaatgccatgtctagagagaagcagtggagagcaacagcccatgtgaaacggcccacatgaaactgcacatatttagaaaattctacttcggacagaatcacattggaattgcttgttcatgagtttacactaacagtggattaagttcatcccaattcccaacatagtattttcatgatcagaaatttgaagtatattttcttctaaatatttttgttcagatctctgatttcaaaattttgatatctgcacaatatattggaaaattttgatattggcacaatatattggaagatgtcacatactgatatagaatgtaggccattaaagatatcttcaacctacagcttcagacagacctactgtttaaatatttatctctctaaatgtgcacagatgactctaaaagggtgagaagatatttagagacaacagaggatgctgtaaggaaatatctttgttttgtacacaagaatatagttttagagttgtgctaaataatgcaatcaacacaggctgagtaccattctaaatttaaatgtttgaaactttttaattttgacattttgagtttttatagaatactttgtaatatgcttcaagtggcagaaatattactcattaccatgttattaatactaaaacctaagtccccagagaaaccctcagattggtgtggtgggatgaggggaaggctctgctcaacatgatattatattatgtattataaattatatatttacatacataatttatgaattaaaatttatgtgttaaagtgatgtatttttacgtattttctcaacatgtatttttatgtattttctcaatatggcatttatgtgttattaggatcctgagcttggaccacggatccatcttggatgtcagcttctatgtttctctgaggctagcaattgtgtcaccttattctagagctctttggagcctctatcagggaactgtacatcattagcactatgtgaacatttgtaaattggtcagtgtcaaaatatgaacagttacagtttttccatatgaacagcttataaacacaacacacacacattattaatttgtaaaacgttaaatgtgtaaaaccagcaagagcacaccatgtgccacagttaaatattaatgcaagttacataagatgtaggtttggattgatggttaagggtatttggggaaaaataaggaacattaaaaaaataagtcttaccaaacaggtattttccttcattaaaagcaaataaaaatgagaaattttttttaatgtaataacatctggtgagaacagacagtaaaagttagatagcattagacttgaaaaattcatacctgttattgtgaagccacctaaaaaagaaaaaaacaacaacaaatgttataatttgacactctacataacaaataccagtgacatcagactgcctgacaacccacccaaggtacttgccaaattatatttacaattaagaagactaggaaaatgttcatgactgaatcactaatcgttcttttaagattatgagatttaatgcacaaatttaattcttgtgcatacctaagaaatcaccgatttttcaaaaggttgtactaaattaaaaatgcaatataaactatttgaccttgacaaaatgaggtcaatggccctaaacaacaatcttgctagcaagtcaagagaaataaaagtcacagagctactgtatcacctgacggaaatggaaaataatctagaaaaatggaaaggaaatgcaagaaatgaaatgcttaccaagctcattcaataacagggctgtgaaggaaacagacaaagacaaacacagaataagagaccagatgaataatgaaagtaagaggaatatcagcagaaagaaatccaggcagatctgattacagtggtagggagccactgctaaaaatgggtataccccaaagaaatatagtgatgggaatatttctgaataaacaatcccaactgaaatttctgaaaatgtgtgtgattgaatacatacgtatatgtgtgtgtgtgtgtgtatatgtatttcaccttatatataatttctttacatttaataagacattgctagtatatatgtttatacctagtatgtaaatctagtttaccaaatacagtggaaacattgtatgaaattcattcttaacttgatatgagtgaggcttcctcattaaatattgcctcggatttggtcaatccaacatatggaagtcttaaatcacccaggaactcaggtatcacaccttttattcagtaagtacaggtgaaacatcctgggacattccattttgggttccctgcctggaaagaaagtttagcccaaggtaaagcactatcttgggatgttctatttggatgatattttgtccaccaagaattgcttatgttttaaaatccttaaagcttaatagtcccaggaattaacacctacttgtgtccttatctgtgacttctgtacattattagataaccagaatccttctagtggacatatcatcccaggaaactgacagggcattgggttggggggagggggacgtataatttgtctttcagcttatgtgctttaagcccagaatgtactgtagcactttattttagtaaaagcaaccttgctaaatatatcaaattatttcctgagttgaagacgggaatgttacagttacttttttgggcccagttttctctctaatgatggtggcattagaggatactttctaaaaaaagtcagtaatttattaatagtgacaagaatccacttggcgggtgtgaaactggatagtgctattaaggaattttaatttgctgttacatgagagcatattttactaaaacggcaattgtaagagcagaatccaagatgctcctccttgagataaagttctttggaggaatacattgagaagaaagtgctttctcctgtatgttaatgaggcattttggatcccatcttttaagaaatcagcataattttctggtctctttttcttctgtctaccatctatggagcatattaaataggcttcattaaaataggccttgagtgctccttttcccatcactccaaatactccaaatactccatcttgaacttgattaacacagaaacatacgtgttttttccccaccagcggactgtgaggccacaaacatgggatgaacgtgggataaattttcctatgtgtctacatagcaattagtcctatatattttatttttccctctacttgtaaaagcataaatttcttacaaagtggcccatctcattatatcatactgctctcaccaattgtttgtatgcaactaataagagctattaatatgtggtctgctcattttacacaataagtaaatcaccagaattccttttaaaatggccaccattagaggataattatatgaagccctatgaacaattcagaataaaaaatcctctgtaaagctgatacaagattgctgtctttcctatgaaatatatgccatatattaataatcagcaaaatcggcataatctagttataaaggacactacttttattttttcttttttttatatgtgttaataatttactaattctgtaattatcaagagattttggagcataaagctaggtaggctttggtttcatagatatggtgccttttaaatgttgtatttgatgatataaaaatatgctaaaatgagcactagaatattgaaaatactactctttaaggatctttgttcttattaaatatttttaaactgtgttctccaaagaagcctaattatttgaattctgaagtttcctgttagttgccattagggtcatctactaatactaataggtattaagcagtttcttttttccagctttattgaggtatgattgatgaggtattaagtcgtctttatcactaaaattttagggaagatttaataattggagtgacattttagaataaaccgtgagtagtgaaaaactaaacacattcttttatgtaatcatttctgaattacagaaatccctttcagtgttattaaatctggttgcaatcaaggttagttggcatttcctgaagaaagtgggcgttgcctgttgcacttgtgaattagggaagggaaatgaaattgctaaagcttcaaaggcaatgaagtatagtacttggaagccgaggaagaggagagagttaagtgtgagagtagggagacacggagagagaagagtacaatttctcgctggtatgtctttgtttactctcacacctttcattcctcttcttatccattttggttcctcaagcacaagggagaaactgcactctttctcatattcctcacggtcaaatattctaatggtaatgatcttcctgtgggaacacaagacaaaggcaaaacaaatggttggagtcacacgctcatgctcttggtgtccaccaagctgaatgttactgtgatgttatggagggagaactggcagcacatgggcctcctgaagtatgtaaaagggcatcttgggtactcttggctggcccccattaagttttctttgctaatttatcactttcacgaattattcccgcttcagttagcagtcagtaggtaccccattttggggtattttggcatggcattgcatggcatctgcagcaactttcccagaaatggatgcttgattgactgccctgaaaattaatctctcagacgttaatgtgcagcgcacctaacgctggctgatgtagctacaggcctgcctactgtggctcagcatgagatctgtgccctgttacataggtggagggatgtgtgcattgtaagtcatgttctgaagagtgcaggcatccaggggtggcacaggccagcagaagctgttgggctcagccctggagcagctcccccacctttcttctcactcatctccaccaggcggggctctccaatctcaaggaagaaggtcttgtttttctcatactcctcatcatcaattaccttgactgatattgttttgctgaaacagagaatagaaattgacgaacaaggggaagaggaaagagaagagaaggaacatagagaagaggaaagcaaggttaaccagctgcactttcagacaaacagtaatcgagaaacttctgtactgtgagttttttcttcaagaatgggtatcagataggtatgaaagatcagagatttcacccaatgcatagctcccctgagcagggccacagaattattttaggcaaaatatagcattcagtattaataggtttgtcatcatcataaggaggaaaagcagaaaaacacagatcacaataataagaaaagaaaaacacattaatttagtaaatgccttaaccattggattgtctaagctatgccctggaactcactcctttagaacaagtcaaaaaatcccatcaagatattaatagaagttatctctgagcaattggcttacaggtcattttttttccttcactgtgctttattatagttccaaatatagtatttttatcataaattgttattaaaataataaatgaataaaaatatcacaaagaaaatatagtcaagttatttcaccccacccaatgtcttagaatcaaactcttattcaggttagtcagattctccagctagaccacagcaggaagttgttcacgttttgtttgtctttctaaagatggaagctgtggcctcacaacagctgttgtgaaagtggggtggcagcaggtgcgagtcatgatgttgtagttattttcattcttccaaagttgagttttaactttctatgaaacatgccatttacactactttcaaacatcaccgatacaccaaggtgttttgattagaattcttcctgtaatccaacctttaacagttcttgccttatggcgctatggctatgagtgactgacaggcaggtaggacaaatgcaaatattatgcaaatctcaactttccataagcattcttgatgactctgaaaataaaccaacctaatgttaccttataattaataagggcttaaacaattcatatactacaactaacttattagaagcctcttaaaccctgatttgtcttgaaaaaatgtttccagtaacattggccaagtacaattctgatcaatgtttttgaaacaatgagtgtttgtagacaacggaattttaacagcatggccattctttaattttggtggagttttttaggtcttctggaaggaaattggcttatgatcttgtttttattttatttatctgagccattaagtttcattagatctatgcatactaaagaatatcagtcttctttcctaatatgaaggagtcataggtagaagatgcttttaattctctgaatttcccagcgcctaatgccaaatgcttaagtcttgctttttggcttagcattgtagacctgagaccaaatgattggttctggttccctgaaacccaataacgtactctctgttcctcagctaaagaacattcttgaatgatactcacattccaatttctcactcctaaaaagctgcagctcatgaaactcctttctatctcatttctgtcctcaaatactgaaatatgaacacactagatgaacagctataagtgactaaagccacaatcatcttttaaagagtggttagatatttacaaaactaccaacagtatgataatgtccagttacatgtatactgtaaacagctccttcctgacttttagaattattttttaaatttgcatctttagtataaaaaattattctgctgtgactaaactagaatatttaatttttccctaatatccaaaaattataaaatattagagaaggcacaggaggatggatgtaaggaatgattgattatttgataattagaactgaatttgatgttgtaaaatagatcaaatttgctctacacaaaactgccaaatgtctgtcctctttgtcaacaaaacttacgcattttgggtattaatttccatctcacagtcttgcaatcttaaactttagtggtacatttctacaaaaacaaacagcatggtgagaccaagggtaggaaagtgttgatggacaataatagggccacgctactgttctctgcacttgatggcccaacatccattatcaagatgcttcattgtagggtacatcaaactgaaacccctcattgtgagagtcacgttgcaatattcttgttagcattacttaaaaacatctgacgttatatttctccatcttgtatttgcaacccaccctgcatctcatcacatattttattggattatagaagtaaagcacagtggggatggtagaagtagccttgctaatagggtgaatgtttgtgtagaaaaggtacctgtttcatgttcacaaagcaacttattcacaaataaataaatcaccaaacaacatattgtttctaatccttggtgaatatcataaatatttaaatcttttaatagctttattttctttctttttttttgttgagatggagtctcactcttattgcccaggctggagtgcagtggtgtgatctcggcttactgcaacctccgcctcccaggttcaagcgattcccctgcctcagcctcctgagtagctgggattacagatgcccatcaccatgcccagctaatttttgcatttttagtagagacagggtttcaccatgttggccaggctggtctggaactcctgacctcaggcgatccacccgccttggcctcccaaagtgctgggattacaggggtgagccaccacacctggcctattttctatactctaagtagctgatgggtgtgggaaacacagttatatagctccacacaatttgtttgcatataaaataagcatttatgatttatcactagcatatccctagtcataggatcacaattcttagaaaattttgaagtacttgataactatgatactggaaaaatcaaagatgaagaaaaagaaaaaagtacttttgtaggtgcctggcaaagacatctaaaacagatggaatttgcataatggcatatcatttcaaaatcattagtaatggaatcaataatgctcctgacaggaagagccactaaattatatattgatttcactcctcttgcacagtaaagctattaataggaaacttgattattaaaggacatttcagtggatctaaagtggcaggatgaagtcagtccttatgaattagccctttaaatcaacagaggcaaaaatcagaaggcactggtaatgttcaccttttgcttcagaacagaacaatttctccccttagcaaaggtagctgaggtgaaataaaccaatgtaatttttaaaggaacacatccttaggatgtctccttttcaccttccagagcctaatgcatgaaagatactgctaccacttcttccttcacaggggatagtatggggttggtttggtgaagatgtcgttattttggcttgataatcagcagaagcatgttcctcacagttctgcagtagaaagaatctcaaggactgacggaaccttgaatgtcctccagttggccccattgccacaccaatcccatgtccacaggacttttgcactgtcacaaggactccagctccctgagaacctacatccattttggctgttctgttctgtttaccaacgggaaacatagctgttgctacttcttttctttaaatagacaggttaacaaaatcaagactggaactgttgggtagacacagtccttcatccaaatataattcttgcatttttactgcactgataaagaacaaatagaaaaactggtatcatgcaactttcaactattataattattataaagacaggaaaactcacttcttttttacagcttttcaaatttgagcagtatactataaaaactgtggtttctggaaactagcaaagcagttacaaatcttacgatagcattgaaatatttcttaatatggccaaaatttttatggaagtacattttggttctatttctaaaaaaaagaaaaagaaaaaaacattcggttaagaaagatcaatttattcagtggaaaaatacagatcattccttttgaagttggcagtgccttttatttgatgataccaaaccaacatctatactttacttcccagtctctctcttatcttaggtgtctcaaaggacctgaacatcttcaaacagactaccaaggagttcttatatctggttttgactcaggcagacagtcagaaaagaaagaaagatgtggctttattaatgagggttgaaaaagaaagtctcttcaaaatatattttagtttctcattgttaagccaaagtggtaccacagtctctttttcaacttaagcctcaatttgtccttctatggtttcttttctttaagtctgcccttgatgttgggagaagatcaggaaaggatgaaatggaggattaaagagaagagactcctccattttagatccttacacaaaagattttagtgaggatttcacatatttagatgcttacagttgctttttgtcttttaaggtttaccctctccttagatattctcagaggccagtggaatgataggctctttgcatttcttaattcacagatcttcataacagccctagaagtaattcctactacctgcgattgacagggaaaacaatgactctcagagaagttggtaacttccaaggtcacaaagtgagtctcctgtgactggcttcaggaaccaaaacctttcaatcatatgactcaaaattagccactaggtcccttattcattcaactgtgcagtatttttatggccactttaaaggatctggatcattaataacgagttttattgtttcgtatttacattaacaaagaatgactgtatgaacaatgatagaatttcaattctgtttttaaaaggactgcagcacacgttatattccatgatggctgctttaaaaagttaaatcattgaggagataaaggtttaattaaaaagagcgatgagcatgcaatggctcaccaactctgaggactctgaatagttttaaccagctgtctcagcatcagcctcacctaaagtgggggacttgttagaattgcagaatcataggctccatccaggcccacagaatctgcattttaacaagatccccagatgactcttatgtatgctgaagtctgagaggcaccaatctagagtggacaatgggttcttgttattaagttggatgataaaccaataggctggtagtagttgggcttgtgttttggacccagctgcatattagaatcacctgtgggattttgcaaactagaaatacctaaacccactccagatcagttaaatcaaattctgcttgtgggagcccagcatgaatatatttaaaaagtttctggataagtgcagtggctcatgcctgtaatcctagcactttgagagatcgaggtgggaggatagcttgagtccaggagttttagagcagcctgggcaacaaagtgagaccctgtttctacgaaaaatcaaaaaaacaacacacatgcaaaaaaaaccagatgggtgtggtagtgcttgcctgcaccccagctacatgcgaggctgaggtgggaggatggcttgagcccaggaagttgaggctgcagtgagatgtgatcatgccactgcactccagaactgcgagacagagtgagacactgtctcaatcaatcaatcaaccaataaaaatgtttaaacattaaaagttttttaggtgcttctaatatgcagccagggcttgctttaaaaggatacattaaataataatatacataaaataaagaatatatagaattgtgagacagtaatagtccaaactaaattttagatctaattagcaaggtaggtggaaacatgggaagatcattttgttttgtcttttactcctgctcttttctggattataaaatgtacttaaagttgttttcccctctcaagaaatgacggtctctgcaggcaaccttaatagtataggtgagaaaacacctttagtattcaggcatcagcgtttacactcatgcacagtgatttccttctcaagaaagtgatgggagctctggcgatacgtttttacacaacagtgattatatctggaaagtagacaaactaagcatttcagttgccgcagaagacagtaatgcctcatgtccctgccacagagcctctgagccatgtcaatgaagggccatgtcgggaactggaactttcccacatgtaagccatcacaatcccagactccagaaagacctgacccaggactgaccacgcatgaacctggcaagttctctgaccacaaggagtttgaaatttaatccacagtacacttgatgttaaaagcttcaggataaactcctcttacagcttacaaagacaaactaaccaaaaacaaaaaaaaaaaaaaaaaaaaaggaaaagaaagaaaaaaagatgggcaaaggatctgaatggcatttctccacagaagataaacaaatggccaataagtacataaaaacatggtccacataattagctatcagggaaatggaaatcaaagcatctgggagataccatgtcacacccactaggaagactacgataaaaaagacagacaataacaagtcttggtgacaatgtagagaaattggaaccctcatatgctgctaataggaatgtaaaataatgcagccactttggagaagccctcaaaagtttaaaagtagaattaccatgtgaaccagcaattccactatatgccaaagagaattaaaaacatgtattcacacaaaaacttgtgcatgaattttcatcgcagcattattcataatagccaagaagtggaaacaacttaggttcatcggctgataaatggataaataatatgtggtgtatccacacaggggaatattattttgcaataaaaaggaatgatgtagtgatacatgctacaacatggatgaaccctgagaacatcattctaagtgaaagaacccagacacaaatggctacatgttgtgtgattacatgttataggaaaagtccagaataggcaaatccagagacagaaagcagattagtgattgcctcaagctggggacttagagataaaaggccgggtggggtggagggagttggtgactgctgatgggtatttggaataatgaaaatgttctaaaattgattgtagtgatggttgcacaattctgaggacatataaaaacccaactaattgtatattttaaatggttgaatcctatgttatgtaaattatgtcttaataaagctagcatttaaaaaaataagctttaggctaaattctagtctttagaaaaggctgtttccttgggtgagaaaaggttgtcagaatgtttggagttttcagtaaggagtttcaaattttgctagtacagccaaatagaaaactgtgatttccacagttttcatttacatgaaagctaagcgccactgctgtgtctgtctgtaccctactcctttcctcaggattttgcatagaatgctggttgccccctccaggatcaaggactaagttgtactttgacacactaagcagttctggtggctgttacctcaggctggcttccttgactcctttcttttccccaaaatataaggtattatgaaaatgtcagaagcagcttttcttgcattgtgtttactataaaagcaaaggaaatgattataatcataaggaggcctgctgcctttgcaaagtcagtagctctgttcatatcaccttgggcattctctagttcttttgttggcatttatttcttactacctacaggagatgatgagcttgccatgggttgcctttgtatcacttggtttaaattcctggtgcatttttaagcctttttttcctttcaaaagttgattggtgagttgcttactgatttggggttagggaaagggaggagcagtcagagaagatccatgcatatattatcattttctgtaagtgacccaaaccaactcctccatctagtaaacatttcaagtggaataaggacaggttgctattcatattatttctactaatatttttacatcatttttagattactggtgagatattttgggcatggattcatttggggggatagtcataaaaacaggactgaatcatgacttaaatctattgtttcctttctcgaaatcttgagagaattaatccagaagtcaacattacccaggtttgtaacttggctctgctactttctagccaaggtatttgggtcacttctggcatccttctaaacatcaatgttgtaaatctatcaaatgaagataatagaacttacttcacagtgattatgatgttcacagtgttgtgatgatcaaataatggttatcatcatttatcaaatatggataatgaaattcgcaggttattgcaaagattaaataatatattgcatgcaaaaattattttgtaaagagctaatgaaatgttaggtactattattcttattagttgaaaaggagtggtttgttttgcagttcttgcctgcctgtttacccagttactaaaaggagcaaattggcagatggtagagttgtgggtcaggaaatattcaatggagtaataagcaataccctcaaatccactctcatatataactttggatcaaatcccatataatggggcatccaagtccagaatccgaaactcaagaacgcagggagcacagctctgccaggttctcattcaccactagcaggatacgcacagggatctgaagtcatgcttttcctggagctcctgctatgaagcctagcctgacaaacggtggtggtgctattctgtaatttaaatagactccaaggacaagagttgctaaagtagctaaaccaaagtaattctccaggaggccttgttgtccgtgccctgatcttttggtattgtcaaatggttattgaaatcattgcttcaagcagagcaagagacagcgacagctaaaatcctgctgttcccagggagaccaagggagctttagagagttctggagttggggttttctaacataaccttgccctattttactttcctctgccaactatggaaacttaatggcaaccagttcattttgtcaaatgcaaaataagaataaatttagttctttagtctatgattttagcaatcaattgtcagtgtcagtgtccaaaaaacaaatatatgagctacttttctgtccctagaagacattctggttgactactcgaaagagatactacagggatccatagttattgtttttaataaataataggctagtctgtctagtatccccacaatgttctatgctattatggtaggtttcagagaagatcaggtgagtaagtttgctaagacaaaattacatgggtgtattaaaaattgaccataattttgtgatatataaaatgtataccttaccattgcctcactcttctgcagttgataaacttcagccttaaggagggtaaagcaataaggacctggggtctgttacctacacatgcctgctgagaccatttctctgctcagtgaaaattaaagtggatcaagcatagggtaccatgttgaaatatggcaaaatagatgcaaattgattttttattgcttaaaaatactggcattttgcaaattctatgagagggtcacatttaacaaaacgatggcagattcttggcatcgtcaaacttattagttaacattcttataagactacctatttttctataatctgagatcttaactgtactccttaaatgcagattctctagaaaataatattttaacaaaatgttcaaagtttaaggtaacgtttaaaatgatttgtggcaaagagcatcttttctagaaatgaaacacatcaacatctttgtctggttcagttttagaaagatcagttctccatttgccactgcctattacgagaatttagaatgacaatgaaattgatgctgctggatttcagactgctggttgcccaaccttttcaaaagctctcttcgtcctgaacattttaaacattcctggaaggtcatcagactcgttccagagattatttctacctttggtctttcttcctatgttacgtttcttttttcaaagtaaaaagtgtcaaggaaaactctggaaggacttcactcctggcatgttataggacagcagctagaatatgctgaaagcatctctgtcagaaagaggtcagctttaaaataagaacaccaggaaatgagctgggctttcttaagtcttaaaattcatattctctttctctgttttccctccttccctctctgtgtccctggccacaaaatgcacagtggcaaatcaatctctgtctgcatgtactcttgtaaaacattcttaaagatggatgccagatattttcttgaacatggctaaaagaaaccaataattagtgaattggtgctgatttttaaatttcacattttaattttatgtctaatattttattggtatttcacattagattaggagacaagagaataggaccttaggtattagtaaagctaatttactaatatcaaggggtagactagtagaaatcaataccagatttctttttttaaataaaatttttgatgtatccctttggctgttgcttttcctgataacctggataaaactaaacttgattctaaacagagttctgtccttgtctatatgaaacatcataaattgccagaaggaataatagtccgtattagccagtttatattccatgggttctttctcactaaatacaatgtggattgctttaggataatgtatattcttttaaagcatcttcctgcatattattatgtttattatcgagacggagtctcgctctgtcgcccagtctgtagtgcagtggtgcaatctcggctcactgtaacctctgcctctcaggttcaagtgattctcctgcctcaacctcctgagtagctgggactacagaagcatgccaccgcgcccgaataatttttgtatttttagtagagacagggtttcaccgtgttggccaggctggtctcgaactcaggtaataccacccaccccagcctcccaaagtgctgggattacaggcatgagcccctgtgcctggcccattttcctgcatattaaagtaatacttgctaattattgcaaatttgagaaatgcagaaatgaagaaaaagtcacccataatcctatcactagaaattaacattttaaaatgttttgttttagcttttaatgaagttgccaagaatattatgaatttttgatgttcttctatggatgagctacttgggcttagctcttttagaggccaaagtttattttcccgacaatcctcctcacatgcttgggccccactctggactcttaatgtagaaggtaacgttccccatcttctctttctattggcttgtatggaagttcttgtctgaattctgccatatggaaaatgttcacatacatttttaaaaggagaaattctctcctcggtcattactaaccttttggctggttttgctggaaaagttttcaggattcatctgccaatgttgtttccctagaaggccatcctggctacctcgctaagcatcttatttgttctgtaacaaaaaattcttcatgctaaatcactcgcaaatgccatgctgcttagcgcccttctgctaatcacccattcccaagtttgtcatcaaaatagcattagttattttccactcaacttcagccctcatcttcccaagccctccacttttcattctagaagcacaatctctcaatccttaatcacagaaatctccctgttcacttctcattatacacatacgcaaactgagactcagtgaaattaaccaatgcctcaaagctagtggatgccagaattaggattaaaactcatcttcagactccgaatccacatctgttatttgtttattctgccattatcctagtgtttttcttctcgatgctgctaaaatctaattcaccactcttcatagaaaacttttctttttctcctctctttttaattaagtaaaaaccgatgctgataacagaaagaaatgcatgattttctttggtaactcagtaccatttcatcattgtccatcacgctgagggatgccttataaattcaatggctcatgcaatgcaaacaaatacttcctttagtaaggatggctgtgttgaatcttggcctgaaagatctttgacctgaaacaaaactacaacatccacagaaacgctacataaagtgtacaggtaaaataatagtcaataaaaatcaacccctagtcttattattattctcaagtcttctgggcatcccacttagcagttgcctgtctctccactttttcttccttcttcaaacatagtcatggtatgcagcccctctctaccactagacgtggtcaataactgtgtgtgtgggtgtgtgtgtgtgttttccccttagaaaatctatttgcacttttaaaggaatattcattttctaattcaaaagggggtaattgtgaaaagaactggctttacaacaatgtggtaagcttgtaggcatagttgagtagtgtgcctctatatggtgaaatactccttgaatgtctaatcccaaacaagtaattaaatatagtataaactacaaagtaaaagtcactaccgacaaaatatcaagggcatcaatatgcctcctgttttctgctttctgctgctactttctactccttgcaaggtccagtgatgtacccactaactgtggactctcaccgaacttttcactatagcacttacttgaatgtttaaatcttttctgggtattccatttagcttaaaaaaacatcagttatcattttggagttcatattcttgatagaagggatccaaacactttataggtaagcatcacaagataaaatcagcaagacaatttagctatttactggtacttgcaatttaaagcttaaaatcaaaattaaccaaaaccagaacagactttattgggtttaaactaaaaatgtgttttgctttctttcccttttttgtttcttgtttatgatggaagtttccccagctagactttatagaaccagagcaggtttgcaaaatgcaaataatgacactgtttaacaaaattgaaccactggaccaaacagtgagaaagtacttgctgagcaattcctgggttaattacaggattctgatgagctacatttaatgtgcccattgattgtagacgaaaatctgtaagtaagctttgaaaatttttttaaattttattatggatcatgtgtagttcagttagggctcaaaaaagcgaatcttcacccctatttcagcttttgacccagacataatcttatagggaaacgttgttttgaggatttttattagtttgtaaattttgtaggaagtctgtgcttttgttcagagaatcatgtaggtagagaggacctacgggatctagatttgcatttgcaatagagttacagcttttagcagcattatttagtcacttaacatttcaatttaaatatacaataagacaaattatatgtaacccacaaggttaatatggaaaacaaataaaataatttatataagagatttttttcacactttaagcattttcacatgtgctttcattattattatctaacttaatcgcattcttgcaactgagcaaacttagatttcttgattccaacaatctttctagtaagctaaagcttcctcagctgtaattcaaaaatatatatggggcattaatatgaatattataatattcattttggaaaataagagttttctgtgtgaatgaaaaagcaatgatttctgacacctatccatggatctccttttagagttttttttacatttatataactaaagcctttcaaaattgtagcagcagatacaattgactgctagaacatgagcaaatactttattaaatatttatgacaatttcttattgaattttaacatttatattaactttaatcatggtacaattaagtttaacttacatagaatactaacgcaaatggagaaatacgggaaagctttgcagggcatctcaagggtgggtctatgtataatgaataaatcctattcaataaaatatacagttttactttttgtattatttaggccaggaaactcttagaagattattatggattttcccctacatattaacttgctgtcttggtgtaatatttgttggtcctgaatacttttttttattgagttatctttgagtttgtagaatcatcaaaatcctcttaatagatttaattaaattgctttcacaaagttagacttcctgagatagagattcaaagtttggtgagactggtaatggaacagaagagaatccatggaaatacaatcctgggtcttcagaccccctaagaatgtcagctcttcaggcagtactgtctgtattcaacagtaaccatccgccacgggataggacagcattaagtatgtgtgcattccccgtgacagtgagcacagtgctggcacatagtgtttgcgtaataaatggttttggttgactcactgtctgtacttgagtttgtgccaatcaatcaaggtatcttacatttcttagtaaaaggcagcttacatatgttttagataaaaagatagggttcttaatgttgatctcaccatgacagtaagcaaaatgaatggtgtgtaggtgattcaagctcatgacctggacatcatgaggaagggcaagatgaatttatcagccacgttttagattcctgcaatatgttattccattcagccattccacaaacctttactgagtatccaatttttgtgactggcccacattaggcattggggataaaaagaggagtacgaattcacagcttagagaagggataggcatgtaaaccaaagattatgcacctctatgtgtgttaattgtaaatatgggctctgtgctgtgtgagcacagtgggtggggaaataaacagagacttggaaaggcatggcatgtttaagaagcatcaggttctatctgacttatgtttatggtgtgcacatgtaagtggtagagggttgatgggaggtgagtcaagaaagagagcttggagacaggagaaatgctaaatcatgtgggcataattttgcaagaaggagccaatgggcctttttgattatggactgctattatccaatttaacttttagtacaatcactaactctagaataaagcttgtattgtagtgaaggagagggggcagggaagcagatgtggagaagatattatctcctggactggcagagcctaaagtccctgcctgaataattagccaggtacccctccagcagcatactttaaagaagtgtctggccccctatctccagtctagatctgtcaaagctgaataaataaagaaaagttgctttaattacttttctgaaatttctccttcctgaaaacttgtctgtgggttagagaaaacaagttgaaattgcatgaaatgctttctctgagttcctctgccaagatcaatttcttgtagcacgatggaggtagtaaaatacgaattctgctagagaaaacatcatgagattgtaaaactgacctgattttcatgaaaagaaaatctatctaccataaattcagatctgagcacatatttcattttatttttatcaaccgtgagtaggtttggcaagccttatgacaaaatgatatctgggcatatatgttaagtttttaaaggaaattatcaaaaactaaggtctcaggttaatgatttacatggaaaattgctatcacattacattatcttctacagtatttgcaggagaactggtgagagaattacaaccaagatgatataatgaaatgaaaatttacaagttgaggtgtgggaaagggtaaaaggataacactgagcgatcactaagaaaaatgactcaggttactcagtaagcaatgtgtgtgtgtgtgtgtgtgtgtgtgtgtgtgtgtgtgcgcgcgcaaagaaaacgagagggagaaggaaagagaaatttaaagacagagatagaataaaatgtcttgagttttatgataagaaatagccacttaatattggaggcaaatgaggtctaaaaagattggaggcattaataaaattaataacaccagttcctcgcccttctttgtgttaagcagataggagcagtgagaggttgaaggccaaggtgatagcaagggtttggtagcagcaattatgtcatatcctagggccagggcctaggaccacacaatgggatgagacagactggaagaggccaagactggaactcaacccgcccactggagtagtgcaggtagtaggatatcagggagtctgtacaaagccaccaaagatggaaggtccattccgaagaaacaaaacacagaacccagaaaatatggaaatctagattatacagaagccaggtaaaccactgggtgagatgggcaagaaagcatggagctgagtgatgtagaatggaggataaaacaggacagatggctgctcatagcatcatgtagcagagttctgtcattatctgttctccaaagggactgatcacaagaagaatgtgccttcatttaggatgaactgaagtcttgaaatcaacacagggaagcaaaaaccagttagaaagtcaaatatgactttcaggcagatttcaggaatctagtagtttactgcttttgtttctgagtatctggaagaacacatgtgatatgcagaaatttgatagtaaagtatctggtaaatgaaagactggacttttggaactggagaatagttcagagaccgatgatcaacaagcttattgggatgctgaggctcagaggagagctaggctcaggcttgtgaagttcctcctgcttaaggtcacggtggagtggggctgagaaaattggttgggatcagtccagacttgtggagaactggaggaaaggaatgaagctgagaaagaatttggagaaaaattgaaactttctacctgcttcctctcaaatctcttctgtatgactatatctttatgattatctataacttctattaattatttaagtaaatagtgtttgcaagggtccgaacatgggagaaagataataatatgggaggttaaggaatcttgtggggagaagataataaattcttatcttgatatatttaatccaagtcatgatgggaaatgtcttatagaatgtatattaacagcgtatttgtacataacagatctggagtgaagacgaagtatctggatggcaagactctctgtatatttgtcatgcattctgaagtggtaattgaaggcactgatgtgagctaatagacttttttccaaaggagtgaccttaaaagaaaaatcaaagaaatgtgaaatccaatattgtaataatatcactggtaagagtgtaaaagagtaaagggaggcggggagaaagggagaccgagaggggtgagttacaggaaggctgagaaatgctagggtccttgaagcttagggtaggatgtctttcaacttgaaggaggaagtgctaatatttaaaaatcaggagactaacaactttatgggggtggggggaagggtcacagtttgggctgagaggaggctattaaaaataaaaccaaatagctgacttgtgttgtgatttgaggaaggacaaggaaaaattttcaagttgtaatgttggtggtggtacgctcaaagagttttaatacaaaagaggagttgaatgaaatgacacatggtaggggcagttgtagtgagtggtgactttccagagaagttgtcctgagaaaactcaagcatgcattaaaacttaagaagtgaattctcagtaaatacaaggctcatttcaccttgagaaatgagcctctgaccttgtgaggtcctcagttttatggaaggaacataatattagaccagtgggtcctgagatccagctggctacttgcatttcctgtgaagctttagaaacgaagattccttgtcgttatcatcaaatcagagcctctgcatgcgtagatgaaaggtgagcatggggaatctatagtgctgaaaagctcccctaatatatctaatgcaatgatccatcaattggtgttagggaaatattctactagacctgcacctactcccaggttaagaggcttaacagcaaatatcattaagggccttaaaaaataacccttttctttcattatctgtctcactccccacatttaaaccgctcatgaaatttacacttttccatgacgctttcttagattgatcaggtgtcatattcaggggatgaaagcaaaaggtagttctttgtggctcttgtggattcttcacactgtattttaagagagaaattttctatcaagtctactctcagtgcattgattagtggtaaaagtccatttattatctcacagaattactaagtctgtagcatattctgcagagggggtgttctttatggtagatcgatttgttctgtaacttgtataattttccattagaagatgtcatggaagtgctcctgttcatatcccacacatcagtggctgcaaatcaaatgaagcctgttacttgttactgtagaattggaccaggtttgtctgatactattccatgccaagccatttgccccagttcccatttgggggccagatgaaattattttgagtgcatttcgatagtgatatccctcctgataaatttagcatttactgagggatccactttctacgcatgcatgtaactgctattttccctgagctcagagatcgttggcagaagtgacagctggtgcctcgggatggagctataattttatggtgcagtgtctacggctggaaatgcaactagcaaaccacaaatgccaaacacatcataaaggaaaatgttccttaggaagtacttgccaatttctgagcaattaattagtccctaacatacacactgacttgtatgaataaaacagcctaggaaattaatttaattaagcagacagttacgataaaattaggtgctttccccctttagcaaaagatctctctttcatacccacttctggcttgcatcctcactctctggtaggtctgcttccattttccaaactcttataaggactctaaaggaaattcagtattcttagaatgagaggaaactgactggttattccaagtgaaactgcttgtctcccagacattttcctgttgaaattttccccagcttgctacaccttttctccactttctatggaaccaagagagtggtagtatctgtgaggttcaagataggatctattgacaaagctccagagtggtagtatctgtgaggttcaagacaggatctattgacaaagctccagggaagaatgactgtccagaaatgctccttgggaatagcttttgtggaaagaaagcagtgcctccaccccacatctttagttctggcagctccctatagcgacaaagtgaatatagatcagaaggacaggagtgcatatcagaatggaccagatgaggaacagcagaggaacataagattcagggcagctccaaacttctagaaggacttgccaactctggtcagttgaaaaagtcattatatgaatatcttatttttctaaaatgaatgtgtgttagattaaatgaaagatataggaagggaacatgtgaacattggtaaaatatagggattagaagtaaaggagggattagtgttttggaagataacggtagcaaaaaacctcaaaacaattgtgtttgaaatcacatacacactggcctaattgactggacattcttacatggaatgctactaaccagagttcttgtttgcatttcccaagcctagaaagatgatatataattatcaccattatatatttatttagtgtgctctctgagatgcccaaaacacttggtgacatatttaattaattcatatcacttctataaaatatttcaggtatttaatttcagttgctataagaaaaatatttattgatttcttttttaaaaaagactgcagttggtaaaactgacccagagtataaatacagaatgaaacctgcagtgagaaatgaattccacagtaatacagataacaaggagaataaaacccaaagtcagagaccttgatatttgattatcttcagttgtttggaatgcatggtttgagcatgctcatgagaacactggcatgatactgggtaggttccctctttaaggcactaactactctggagagtgactccaaaatgtggtttcccactcctcattactatgacaaatttcacattaactcaattgtcagaccctttccctgctgatacagggttgaagggttggcttggtgatcaattctttgagctttcagagagattttgcagcttaatggaaagctaatttaaggaaaaaaaaaaaaagaagttgaactaggatttgctctagggaccataacatgaatgttctattgtaagcttcttgatggaaggcattatattttaaaatcctatagtaatacaattaataaatacagaaaatgccagctgatataatagaaaattgttcaagactccaaaaattaatctgatcccatttcaaagtgaagctaaaaagatgtccatgtttttagttgtggaatttagagtatgtgatggggcctacttggaatcctagtagacagaggaattaaataataaaatttgcattactcagatctatcatagtggtggaaatggacactgctcaccttgtgagccttgaatgaatcaatgttggatcactggcttgcaatggatgaagcttggcaggcgtggtcttcctgaagtggcactcctctagaccaacacatgatactcttattccatcataatcatactacagagaatagacccccataaggaccataaatattgtttgtctgtactgtactgcaggtgatcaaaactctggcaaccaataggatttattttctagaggacagatactactccaaaacaatactagatcaaaaaggaaggctttaaaaattacacagaagtgtttgtggcaaagatccctctttgtatgtgtaggactataggtattaagattcggaagcaagcagaacaagttctgctatactatttgccaggaatctatgtcctcaaaattcctctcctcatttagaaaaacacaattacaaaaactcagccatagagtttgcagtttgacatgttgctgattctacatgataattgatcacttcaaaactgacaggacttacattaggctcttgttcttagttttagttttaacaggggaaccaggaaagaaagaaagattgctcatcagtggccatatttggcaaaggcaagactctcttcccccaattcattcatcctgatagagattgacacagaccagatgttattccaatgttaaaattacattgttttcataacaaagtcagcttatattactcttcaagagatcacactaatgctcctttgtatactgttatgaggagggtgagttagatctttccagaggacttgccaagcacaaactataagaagagttaagattttctcaaggcattcactagctggcttacaatctacatatctatgtgtctctgcagcacatagaggatttcaagtcattgatatatatatatatatatttatatatatatataaatatatatatatttttttatatatatatataaatatatatatatatatatatatatatataacctcttttagtaatttctgatacttagaagaaattacaggtacttgttcttcaggtaggttgagagctagcgatttcattggctagagcttttttgttgcttattttctttgtcctttcctctcaggtcatggtgaccttaaattatgattccaatgcttaagagttttatgtgtgctatttttcccatgtaacatctggaacttggaaggtaaaaattccaaatcaagggccagaatccatatgggctcagcacatgtaaaccataattttggaagcttagtccctcttagcccccttatcattgctgcattcccacttactatatcacctctgtggccttgatggcaagtttgggaactgagaactcctgaaaatgccaacaagcagtcatcttcaggggattctaatagtaaaaggccaaatgaagacattccttgctgaccaagtcaccataactcttaaactattgccgtgagccagaagaaggaatttttttcttttagctttagagactttgtccttaattgacttcatgcttcttattactcacaatattcatttttatatagtcggtttatattgtagaaaacaacccacttaaatatttatatatgataaaactggtgagtatgagtgagattataaaacaagttaatatatttaatattacaaagaatgctaacatttctttatttccacacaacactctcttctcttcttttattctcttctctttttgcctttaagcaaaataaaaaagactcaaagtaagggcgagaattataatgccaaaatactcaggaatatcattcaaatcttgaacggagacccccactccctcaaaaaaaaaagaaaagaaaaaagttatccataaataatgtacttctccttcaagattactaggttatgtaagataaatgccaccattttctcctcatgctacttaatctaagaagtcttatgattttctgtttttcaatttcttatgttttcaatttcttgtgacttgtcaaaggtatgactggttgggttctaatcaatatttttctactcattcaacactatttggctctaaaaccaaaacaaaattcaatttacaaatatattatttttgtggtaaattttagattgtctattactccaaaccagagattttaatgctaatgtttgttttgaggagaaatgagaattaagcttgatcttgatgatcaaccacagcaaaattatctccagttaggaaacaccagtctaaattgaaggtatagtatgtctccactttccctgaatgactacatggtattttactaagctttgcctttgtaagtacacacagaagggttcttgactattctggcttgaagaacttatgctgaaatgagtcatgtaaaccatggcagagagtcacaaaactggaaacatggaaggctgtatggtcatagaaacaccttaccagtagagtaccctgaagaagacttcttgttagcatttgcatgagttcttggtccccaaacttaccatcaaggccacagaggtaataaagtcaatgggaaagcagcaatgataagggggtcaggaggtcataacacaaactattggaggagttaagattttctcagagcattctctagctggcttacaacctacatatctatgtgcctctttgcagcacatggaggatttcaacactgaacatttgaacattagatatataaaagcatgtgtatatgcatgcatgctggtgtgtgtacacatgctggtgtgtgtacacgtggaggtgtgtgcaccctagaccttttttgctatactatccttagaggatgtgtttccaaagattagatcagcaccatggagcaaagtgcaaggaatgaaaattaatccagtgttaacagctttatacagtaagaagagtaggtcaaaatgtttaaaattctcattgggatctatgaacaattttttatgctatcctctccacctcaaatgtcctacttccacatccttgcacgtccaaatcttgctcaatccttttagatatagctgttaggacaccccttcacaaagctatctgtgatttatcactcagaattacctcttttctgaatttaccatcagatttttttctgtaaattcacatggtatagatcacttcctgacttgtatggtgattatgtttctacctgattgttaatagtgaactataaacatcttcagaacaaaatccctgtctgcttcaactttgcatttctgaatagaaggggaaacaatcaagaaatatttactgaatcaaaatatataatggtggccatatattttatcctttttttctaagctaatagcatttctcccactcttaaaaggcatatgcagaaatcaccaagggtgatgtgacagcataacattagcaaagtttaaaagtacacaagagctaaactgtggatacccacacaaacagggagagacctacttcctggtgtcaatgaaattacagctctaaagagccaatatgtcatttaatttaaaagtcactgttcatgaattgcaattaccctctggcctgcaagcatgtgttcatagctaagaaattttctctatgcccaggtagaatatattgctggcttttccaggggaacctaatgccaaatagaatggcacctacataaccaacttgaggcatgctttaaaaagtgtccctgtgataagccacaagaaatgacagactatgttgaggaactcagtgactctacagccatgctaggcttggagcccactcagacaacaacatgggattgttgtttttaagccaattgctcacagtcgataaaacaaaaggattaaacttttgacagactttccctattctcaccaactggctaatgctagtgctgctttgctcaggcctccttaagcatgtttacttgcaattccttccaaatgtcacttactagaaactgcattcctgattctggaggtaataatcctggagacacagctttcatcagctaatgggtagtgactcagagtatatccagagacaaacaaattaaagagcatggaagattggagcaaacagctaaagaactttgttgtgatatatttagaaagcaggcattctgttccccaataacattgtgctaatattggtgctttccatttactggatttgattgccagcaaaacctaaacagaaatgttttacatccataaactactcccaaatcattggtctgaaaaaatgccattctgtaatatgcctactgctaacacttccattagttgctcaagagaaatgcaagaatagcttagaggagtcttagccaaaaatatataattctgacatatggagaaaaccaatgcaataatttacaaaagattaactgttaaagtgctgctaaaggttggggggattactttaatcaaatgcctgcattctaatatggtgagggttattttattttgagacagggtcttgttttgtcacccatgctagagtgcagtgacatgaccatggctcactgcagcctcaaccttctgggctcaaatgatcctctacctcatcctctggagtagctgggactacatgcatgaactaccacacctggctaattttttaattaaaaattttttttttgtagagatgaggtttcactatgttactcaagctggtctcaaactcttgggctcaagtgatcctctagccttggcctcccaaagtgctgggattataggtgtgagccaccgtgcccagctggtgaaggttgaaaacaattttacaaaccacatttaagtgaggaagaaaaacatgtagaaagatccctgtgttctttagatgacatttgaaaaatgcacacatgcttttaaaagccatttgttgcacttactcttcaggaggtatgcttaaatgtctgttcagaaaacatcttaaatttgggatacattgttctgtcttttaagattgctttagactgctacttactttaaaagaattgtgagattactctaggtgtatgtttataaaaaattcaaagttcagaaaattcctgtaagccccttaagagcattttaattgtagcatttttcctatgatcctttaagaaaatccgctacgggttttcagattatgtttccaccccagttgagagtaaccacaatgacaactatgtactgcaatttgcagcagaaatgactacacatttctgcccttagctgaaagaaaaacaaccatatggaccttgttcttagccagcgctccattagctaattaaatttacaaagcccaaccagtaagagaacatggattagccccattctaatgactctatccctttggcggagctaatgttgtcttgtttcagagcagactagagaaacttgacttactttgaataggtcagacaggttagtccaacagaaatacaatgcaagtcacatatatatgcaaaaagataaaggtgaaaatttaataataacttttatttactcaatatatccaacatatcataatcttaacatataattaatataaattttaagatttttatattctttttttcatactaaatctttgaaatctggtatttatggttactgcacttcttaatgtgggttagccacatgtcagtgatttaatagctacgtatgactagtggctaccatattgaatggtacaggattgagtggtgagatgtgccattccatcttctttccattgttcacactcataatctatttcaggagtacagtgcttcacttttcatacgtgcatatcagctgggcatatagtcattttaaattctgaattaacctgaagatgaaagaacagtggccaacttatttccttttaagaaaaactgtctctagttaaaaatacaacatgcataagtatgtgaggtaatgtataattattaatagctcaatttagcctttccataaggtatacctatttgaaaacatgttgtacatcataaatatatagttttcatcaatttaaaaataaataaaaacatcgtttataagtctaaaaagtgctaggggcaaaataaggccctctctctagcctattgacccattttgaagtaaatgattacagctgtggaatgcttcaaggaacttaaggtatgatgtgacagcttgagtttgaaagtcttctctcgttcttttttatgactgcatagtattccatggtgtatatgtaccacattttctttatccagtctatcactgactttgcagggacatggatggagctggaggccattatccatagcggactaacaaaggaacagaaaaccaaacaccgcaggttctcacttacaagagggagctaattgatgagaacacatggacacacagaggggaacaacacacactggggcctttcaaatggtggaaggtgggaggagagagaggatgaggaaaaataactaatgggtactaggcttaataactggatgatgagataatctgtacaataaatctccatgacacaagtttacctatgtagcaaacctgcgcttgtacatctgaacttagaagttgaaaaaatatcttgaaaaaaaaaaaaaaaagaaaaagtcttctcctaaatttaggcaacattctatttcagttgagctgtgtataactggcccatgggtgcagggatcacgttttcctacctagaaagggaaacatgatcttacaaaggaattatttgtccttgtatgatttggtgacacaaaaattctcattggggcatgaaaataaaatatatttaatgaaaagatttgattggaaaaagtaaagttacagaaaactaggttgttttcagagaattcaacaaacttagggtgaataaacactaaagttctacttcacaattataattgaatcaacaaatggatagaagctatgaagaaccaattaggttgtgtccttacctaatttctggaatgctagtgtgaataagcctgtgccatgacaaatatcagaactgtggacaattattgaattttagtcttaaaatcagggtactttcctcaacttctagaatcaaaagatgtcacttcatcatcttggaacatttattttaatctgtcctgaatgtaattatttgatcaagctattgtcacaaaatcctattaactcaaagagtgattgcattattcactccttactcatttcttgatttcagtgcttattaaatgaaagttttcaggcagccaaaatgaaggataaccttaaggattcttccttctttttaattttaggaattgtatactgtagtttatcataacaacatatctaggctgcagaaattcagggaaggcctgaaggttttaataaaaattaaaaacaagacccatcaaatgatccaaacacttcctttgcttatcttaaaacacaagaatcagaaccagcagaatgagctttaggcctgggaacaaaatgtcagagataaaattggtatactattttcacccctacgatctacatggttgagggggtttgaaggaagtgaagaatcagatatgtttctgaaccaggactcaaaaacaagttttataattgcaatatcttcttaagagctcggcgaaaatggttttcattttcttcttagattcttttaagaggtgccacattgtaaatgatcataatggcacaaaatgtgaattcatgtggaaaaaacaggcattaatgattctgaatacagaaaagctggattctgaagggaagaagtcttaactaatttacttcaaagtattttccttatgatgtatgaaaaagaatgataagataaaaatctatttaattaagaccaaaaacatctctgtaggtttaaaataaaatttgtacgtggtaagaaagcattgtgtcatggttacttatgggcattttttcttggttagtgatacataaaataatggtatatacaatcaatgctgtcttaggttcaattaaagatgatgtgactcctacatctactttatttcctagggcctttttttccaagtgatatgttccatccactgggagcaattttcagctggccagacaccttcccattatccccgaagcagtgtgattttatccttttacatgaacaatgcccttagggagaatgacaaagatactggctttctgaatggcaatatattggatggtcttatctataactttctcatttttcctatacaaatgttgggttctatttcttgaataagttctacagaactcatgattacagtttcataaaaaaaaagtgatccaaggtataataaaatatttttttaaccttgggttttcaatataactactcgaaatgactttaaatgctacacaaaatatatttttatattaaacaaatccacattaagaagatgaaaataatataaaatgattgcttaaaaaatatgggcataatgtccccatattacagattctggctccaagtttctaagtcatataatgggaatcatgtcttctggaatatttggtttaacggtgtgtagtgccagggctagaaaatgtgttaagttggtgaaacaactaccctttccctttttttagtatttctagagtgttaccctttggggctcccaccagtttggaacctgttttacttagagtgttttctaaaataaggcaccaaaatatgtgctagggctgcacatattcaaagtatgctgcagctctgggaagttgggcagattgaagtaaccttagggtccgtgaaccagacctccttcacagccacagcactgcaagagcttcctctcttcttgtaaaccaagctatcaaagataactgttacatacatgtatattcacctctgacacctacagccaaggaatgagatgagaacatgaaggaagaagttaggcgcaggaaaaataaagggtgttagtagtgtccagcttgtagaaagaactcaaattatgcctcagtccagtgagcactgaagaaaattcctcaagtttctctctgggcctcttgctttctagttccagctctctttccatagtcaaggttccaaaggcccacctcctctcctcatcaaatgctttttgcaaaaacagatctaaaatctcagatatacacatgacagataactgcttgaatttctcttaggaatcactaggtacttctaaatcactggagagtcaatctgaagtcagatgcatactccctgaatattagtctttcaggtatcactgggcaggaaggggagggaatggagagagattctgggccatgtgtgtaagagggagggcagcttgtctgagaatccaacaggaactcccttttttctaggcatcgtccagagattttggttacaatacttggaggtaaaattatatagagggtaatggttttctctttggcacatcaatcaactctgctctatgatcctataaacaggaaagagttgccaaatttgggcaccagaggaatccttggggctctcagcagtctcctcttcttaccacaatgcaaagcaaacaagagttgaaatgagaaaccagagggcaattagtgtcctttttttccttctcctctcatgtatccatttaggctttaatgcactttaaagaattcagaacactgagcaccaataaatgcttacttttcaagggaaaagaatccaagaatgtcaaatttggaggcctttgagatggtttagtccagatgtcagacatcattcatttagtaattatttacaaattcagtaattatttacaaataccaattatatgccagacactgttctgagaactagctacagatcagtgaaacaaaagaagaaaaaaaaaatccttgtcctgtccttgagatgagacaggtgcatgtaatatataataattaaagtatttagtatgctagatgtgctatggaaagagtacaggaaagctagggagatgaggagtaatgaggtgagagatggcagttgaaatctgaaataggatcatcaaggtaggcctttctgagaatgtgacatttgagaaaagagtgtgaggaaatgagcaagttagccatctggattatttgaaggggaggcaggggcaaagacagtccagacagtacacatatgtgctaagacaggagcgcctcacctgtgtaaggtttaaggacatttctatggctggagaaaaatgatcctggaggaaaggtgagagttaagagtagagtgaggggaagtggttggtggggccagatcacatgggccatgtagactcttgaaaggacttctgagggaaatagggagccactggaggattttgagcagagaagggatataacttgacttatactttacaggatcactctagctactctgtggagaacagattgtagagataagggtgctaccagggaggctactgtggttcccggcaaaggatgatggtgcctcaggacaggatagtaacacttaggaagacagagtatagagtgatagacgctggcccatgggtagatgtggtcatgggagtctgcggagagtctcttctgattgcttctattttctcagggagacaggaagcaaagcaagatcatcagctgacagtaagacacaggaggggaggcactggacatctgaatggggagaagaaggcttgactgaagtagctaagacagtggcagaggaaatggactagggaaatacagattgacttatgacatcatcaagtgcctactacttaatattgcctctgtatccacagctctcaaatctccaggcagcctctattgattgatctgagttggcagatgagttggcaggtgagagaatgtatatttgctagttctaatctaatctaattctgctttagtaaactgaggcctagacagtgccttttaaacatctatctatctttggggagggtttaaattatgaattaccaatcagctatggctccagtaaggaaaacatatacagtacctatttaaatatcatgtagcaagagggcctgacaactaatgctcttgggaattgatgctataagagaagggtatgaagagctgcagatgagtgcctgaaacaagagctttattaacacagcaggaagaagatacctgctggctggattttcactgaactcatagctctttgcatttgggctcaaggtcttaatcttctacaagtagtgacttcagtttctaaaggtttcaaggggatcatccagtgcttgtcttttgaatagactggcatgacttttaaacaggacccaaccaaatcacatttgatttcaagaaattgaagggataattaagaaagtgttagtcactactgaatgtagtgtatatgctttcttcggaattttaaggggggagaaaggcccattaagtcatcttaaaagggctcttgctgtaaaatgaaaggtggagaaggggtaaatctgaaatgcaaatgaatttcctgtttcaccagaaattcagtattatctaatgaatgctgagtaattgaagcacttattgtcatttctgcacccacactgggaaatggtttctgacctttagattccctactcttctgaattgcttctcatcagctctctctttattctcactcccactcagtttacttcttggaaggcctgttgacctttacctttttgtcatgtacagaatacagaatggttatgtatataaggtatcattaacatcataaggctacatgcaattataaaagaagatgagggataacttacacaggacatagtccttgctagattttatcaagaccctcattttctagtggtatatcacctttggaaaagccaggccattctgaagtaggtctttgtctttccagtctagaaataattgttatgtcaagttcagtgataaaatgaatggctgccattggctgaggacccactgtggggcatggagctagtgggcatctctccagtcatctcacaacaaccttgctcatctcttccttttaattattttactgtgcatactcatgagatctgaaactcatgtacgttggcacctttaacataactacactagttcttcctataaagttttctaatgatagtggaacttttaaattcagtttagtttttgacattttatttgtctttttgagaagccagtaggacttcaaaatgttgggcttttccaatagacagctaaaaatgtagacctgaagtttacaaaaatgattagagctaaaggtatagatgggaaagtcatcaatgctgaagtgatagtcattatgtggaaatttagcaaaggaaagatacttggaggcatgctaagtggttgaaaaaggcatcttggaagattttcatgtttaggtggtgggaagagaaacacaagccagaaaagaatccctcagggacaatgagaaaagcagagcagcagaccctgtgaagttatggaagtgaaatgaatggatcctgaaggtatttcaaatggtttggactatcagggccaaaaaagaacttctggaaatctggacttggacaaaatcagtcatccttaaggggctggattcagcaaagaggtagatgaaaaacccaggttctagggtcctcttttatttcatgggagtgatacagaatccggatcactttagaaataaagcaaaataatttttctgaagatgtgaacagtgaagtgatgtgtctgtcacacactaaaaacataaaagatgatgcatgaataaaatagggaacagcatcactagttaatgcccacataatatcataattctatacctaatccaaatttgatgaacaaaatatatttagagcataaataaaacattttcaattgttcataatatattctccaatgcactgtatttgtcttggtttgaaaaatccataaagattttatgtaatttaaataagcaatgaagagaggaagaggaggaaaaggatttcaatatggcccagagagagagacagagaaagagacataaatcccagttaatctaagggaagacttttaagtcatagttcctcattctggcgacttatctgttacttatttccaggtgctaaacagaagagatgcaatatcttttttttttttttttttcctgagacaagtctcgctttgtcgacaggctggaatgcagtggtgcgatcttggctcactgcaacctctgcctcccgggttcaagcgattctcctgcctcagcctcccatgtagctgggactacaggtgtatgccaccatacccagctaatttttgtatttttagtagagacggggcttcgccatgttggccaggatggtctgtatctcctgaccttgcaacgtgtctgtgtggtcctcccaaactcctgggattacagatgtgagccaccatgcctggccgagatgcaatatcttgaaggcatcagggatcctgttgtttctcttcagatctataaatctgctgccttctgaaggcattaggagcacctcaaagaaagcaagatggagcattaacaagtgaagactcttcttcttttcttttctttcttcttgcttgctcttttctctttctgcatcaacaatttcaaattcttgggcagagtattgcttgaactcagagttcctgtttgtgcaacagtgctgccttctgctatcagccacatgtagacttagttgaggagtcctatgtgtagattcataaatttagggcaacaaagcatgtgtgtgtaggggggttgggcaagagagctaaggctaagtcagggccagaagttgcctgtaagtagctctgtaaagcacccatgtctgatttgtggaggtgacatcatcattagctgcagatcaatactgaccagaatttaaggtactatgccatagctttaagtcttcataatttaaagatgactaagttgtctcttctctgtaggtctctactttgagttagatgacttcagaaatgatcacacatttcatgtcaaatttccaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggtgaatgtcatgtgtgacagttgctcatggatgaatgaataaccgaaaggggcaccagcagtagcaaagtactaagatactgaggaaacttggggtacttaaccaaagtcccttcatttcttcacaattatgcttaacaccaaccagcccagcatctgacaaacaatcccaaggacattttttcccccgtcatctcaaatattttttcaaaagtgatcattttactctgtgttttggtagaaggggcgaagtccactttgcagctggtacaacagaaactagagctgcatcaattctctcacactgccaagcctttcttctggcagaagcgctggggatattacactggggataattcatcaagcttgctttgggtgttccaaatttgcaagctgtggctaatttccagagacttcagggcaataatctctgctttcctaaaagaaaaacagtaaccacaccacctttcaattaaatgggtcatggaaaatgaatagccacagatgatcacagatattcagaaatcctcagaaaacctaagtgtgtagccagtggtagaaatgatgactgtgtggctgaagaagtcccatttgatgagggctaggaatctggcatctgcgtctgcctccacatttgtttctccccatacattttccatgtatgaatatgcacacacatgcacatgtgaagcctcacatgttcaagaccaaaacatattgctggatattaacaaaaggaattatagcctcttcagctatgaatcaggtgaagttttcctcacagtctctggagtctgctttgcccacagaaaagcagacttccttcccaggtcagtaagccatgctggagagttgccctcaaccccgcaactctccccaaatatatctgctgtcttttatgctttccaggccccgtgttcagaagttgtttagcagatcatttctttgtacactatctttttttttttttttcctcttttctgagatggagtcttacactgtctcctgggctggagtgcaatggcgcaatcttggctcactgcaacctccgcctcctaggttcaagtattctcctgcctccgcctcccgagtagctgggattacaggtgcccaacaccacacctggctaattttttttttttgtatttttagtagacacggggtttcgccaggctggtctcgaactcctgacttcctgatccgcctgccttggcctcccaaagtgctgggattacaggcgtgagccactgcatccggcctgtttgtttgtatattatcttaactcatataatggatcagtatttttttgagaatttccaggccaacattcagaagaataacatatggtaggcattttaagcaattaatggataaaggaagggatatttgagggctgtctcatcccaaactaccttagttttttactctggattttcctttctatggatatgtcaatgattttaccggatcaattctcatggagcagtggactagtttgggatggtccctactttcaatttcaggaacactgtaaagtcaaacagaaccttatgagttttatatttgctagttctttttgtgctatgtatttattatatgtgtaatttaatagtttcaattcttttctctgctaaagtatttatgagttgtagcacagagaaagagctcaatatatgctaattattattattaatattattatctttagagataggatcttactctgtctcaggctggggtgaagtggtgtgttcatggctcactgcaaccttgaactcctggactcaagctatcttcctgcttcagctttcctagtagccgggtctaaaggtacacactgctatgcccaactaattttttaaaaaatgttatgtagaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgtgccactgcagtccgcagtccggcctgggcgacaaagcgagactccgtctcaaaaaaaaaaaaaaaaaaaaaaaaaaaagttatgtaaagacaaggtcttgctttgttgcccaggctggtcttgaactcctggcttcaagcaatcctcctgtatcaatgtagtgttggcattacaggtctgagccactgtgcttggcctatgttagctactattattattattaccttataattgctaaagccatctacctgaaaatctattccaatcattccatagttctcagctccaaaaccagtggagatttgttttttcataatcctaccaaactcctctgcactggtgtcatatctgacaaaatacccagaattaattgccaatgggtgatcatgggttgacatataagccttcccagtgtatgcttttttttttttacaattttttaaaaattttactttaaactctgggatacatgtgcagaacgtgcaagtttgttacataggtatacgtgtgccatggtggtttgctgcacctgttgacccatcctctaagtttcctcccctcaacacccacccaccgacaggccctggtgtgtggtgttccccctccctgtgtccatgtgttctcaatgttcaactcccccttatgagtgagaacatgtggtgtttggttttctgttcctgagttagtttgctgaagatgatggcttccagcttcatccatgtccttgcaaaggacatgatctcattcttttcatggttgcagagtattccatggtgtatatgtaccacattttctttatctagtctatcattgatgggcatttgtattggctccatgactgctattggaaatagtacttcaataaacatacatgtgcatgtgtctttatagtagaatgatttatattcctttgagtgtataccctgtaatgggattgcttgatcaaatggtatttctgattctagatccttgaggaatcgccacactgtcttccacaatggctgaactaatttaaattcccatcaacagtgtaaatgcattcctatttctccattgtgtcgccagtctctattgtttcttgactttttaataattgccactctgaatggcatgagatggaatctcactgtggttttgatttgcatttctctaatgaccagtgatgttgggcttcttttcatatttttgttggctgcatgaatgtcttctttaggaagtgtctgttcagatccttcgcccactttttgatggggttatttttttcttgtaaatttgtttacaatctttgtagattctggatattagatctttgtcagatggatggatcgcaaaaattttctcccattctgtaggttgcctgttcactctgaggatagtttcttttgctatgccgaagctttttagtttaattggatcccatttctcaattttgacttttgttgccattgcttttggtgttttcgtcatgaagtctttgcccatgcctagatattgcctaggttttcttttagggtttttatggtttggggttttacattaaagtcttgaatccatcttgagttgatttttgtataaggtgtaaggaagtggtccagtttcagttttctgcatatggctaaccagtttttctaccaccatttattgaataggatatcatttccccattgcttgtttctgtcaggtttgtcaaagatctgatggttgtagatgtgtggtgttatttctgaggtctctgttttgttccattggtttatatatctgttttggtaccagtaccatgctgttttgattactgtaggcttgtagtataatttgaagtcaggtgcatgttatttcttgacctgaatctttcctttgggcttcagtttttattaggcttttcctttgtcctgtatagtttcttggatgcttctcttctctacactcaaggttttctttctgttgttgttgtgtaggcaacacaatagatgtcatcttttgggaggcttcctaatgctgcttttggtgttcttgtgagctcagaggattcctactttagagtgaactgtaatgtcaacctctaccctagacaatgagtaggaaccatattcaatagaataagaaggtgaggctttgctaaaattatcccatctgtcagtctgtgaaaccagtagtttgaagattgtaatcacaacattgacacacataatgttaatttcaagcagttacataacttaattgataagtcaatctaaatcatacctgcatggcaacagaactagggttagaaagtgaaaaatattgttaagtaaccatatacttctcttagatttgatctggcagcagacatttctgtattctgagataaaatagctgtggtaaacagattgtgtgaaggcatgcatttgcatccaggcctacaggaccaatattaagagaaagggaacaattaatttgtctcagtggggtagtaaagagacacagccttcagagtactatgggaggttatatttcaacttcttacagttagtttgtaaatctaactgtaagactggcattgttattaatgaaagtttcagctaagaatgaattagatctaagttacactttatcagtatttattcttcctgctacctattaagggcacctgaactgctaggcttacataaaaatgtcccatttcctgttgctagctgtgctttcctttgataaactcattacaaattgcatgtaattactgtattgtgaagaagggagtggcaataaattaggcacagaatttttgaataaaactaggcagctagaaagactgtttctaaataacaaaaaatttgatatgaccaagtaggttaaaattaccattacatatttgattggtacaaaattaattgtggtttttacaattactttttaacattttgccgctacttttactattttgccattacttttaatatggcccatttttaatggcaaaatctgcaattaattttgcaccaacctaatattatcgtatatggaattttctgtatataaagcaaagggaaaaaaaaggaggcatatagaccttagcttatgtactttatgattataaatgattacatttatctagtgaccataatgctttatgaaagatgaaaacattcttctgggggaaaaaaaaaaaactaattaacatccttgcttgcagagattggtagacctgtttcttctattttagatttcagcaggacacctctatcgttggatgaaaaatgctgacttgcatgttctgggaatctgggctcaccccgaggctaatagcacagtgccctggctgtgtgcccaacgtttgtggcagggagttacccctgagtgctttttttaacttacactaaagttttgacttagaaagcaatattagctagtgcttcacaggaaactgggctttccctctgtaacactcaaagtcaaatcctatttcttggtctgatataatctccataatcataaagatctttgttggagaagttaagcagggaagactacatgtaggattctcctaatcttggggaacccaagttttgtgcccctttcaattgggatgctggagcggagttgggtcatggagattaatctttagaggtgtgtgttcatagaggagaaaccattgagaacaaggaaaaaggaaaagtggagaagcacagctcttgtttgaccttggaggctttttacatggaattaaaattcagaaactggctgaggttacaaggagtaattgtggcaattgcctcatccctactgtcagcacatggcaaagtttgctatggacagaattgcagggagttctttcaaaacagttcaaaatattgtcaagattttcttcaatttctcatcaacctttaagagctcattgaagacattagatattttgtgcccaactcaatgttgcagagaatttcagggcaagagaaatagaaatgaagttgaaatatacccatgtagtttccttcagcgatactatctggtatataagaaaacttacaaacattttttaagaggcctcaggcattacaattataagtttttttcttctcttcagacttttattctaataagttgttagccaatcaaacaagcaaaggtgttttaaaatacttcagtttatagcaataatgatttttaagtttgagaaatagaaaagaatcaaatcagtatcttaattagcaaaacctagttgatgagagagatgtgctttgtttgctatgcatgagattgcttgaaaaatgtgatttagctccaacagagcctccctactataggattttttttttttttttttttttttttttagaaaatcaatacatctttctgtcaaaatttggttagggcaaaatttgactaaaattgtgccaaataaataagatttttttcttatctgagattgatacatctctatttcttatgtataattttttatctcaggccaatgagcccaaagtttcttggctcttgttatatctttgaacctgtgacctttcaactggctagcaatgggcatgaaaaggagaataattgttgctgaaacaaaataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagtgagtcatgtttaagctcaatgcttagccatcatcgccatttgggtgcttgttgggaaggtcctaaattgagcggcctttgggcacagatctctgtgcactttgtttgccacttgctggctagctgatctggagactagttgaattttgcagtttttctgttttattttcctgacaaagcagtcgttccattaagaaaaaagcactcagctattaatttctgctaactcctaacctggtcaatgaattataagaatgtgcagttttatgtctattttagggcatggatgtgggggtggtgaaaagtcttcttggcttggagctctctctatttgtctcgctctttctagttcttttttgttcatccttttcctgacaggctgcttgatgcttacagaatgatgcaagattgtaacagattcagactagatgaggaagagaaagagcttagtaaaagcccacttcttaatagttgaatttttttttcttcaaaaaaaaagtcctatcaaccaaaaaaaagctcaggaccagacagattcatagccaaattctgccagaggtacaaagaggagctggtaccatcacttctgaaactcttccaaacaacagaaaaagagggacttctccctaactcattttatgaggccagcatcatcctgataccaaaacctggcagagacacaacaacaacaaaaaagaaaatttcaggccaatatccctgatgaacatcgatgtgaaaatcctcaataaaatactggcaacctgaatccagcagcacatcaaaaaccttatccaccatgatcaagtgagcttcatccctgggatgcaagggtggttcaacatatgcaaatcaataaacataatacaacacataaacagaaccaatggcaaaaaccacatgattatctcaatagatgcagaaaaggccttcagtaaaattcaacaccccttcatgctaaaacctctcaataaactaggtattgatagaacgtatttcaaaataataagagctatctatgacaaacccacagccactatcatactgaatgggcaaaacctggaagcattccctttgaaaactggcacaagacaaggatgccctctctcaccactcctattcaacatagtattggaagttctggccagggcagtcaggcaagagaaagaaataaagggtatttgaataggaagagaggaagtcaatttgtctctgtttgcagatgacatgattgtatatttagaaaaccccaacgtttcatctccttaagctgataagcaacttcagcaaagtctctggatacaaaatcaatgtgcaaaaatcacaagtcttcctatacagcaataatagacaatcagagagccaaatcatgagtgaactcccattcacaattgctacaaagagaataaaatacctagaaatacagcttacaagggatgtgaaggacctcttcaaggagaactccactgctcaaggaaataagagaggacacaaacaaatggaaaagcattccatgctcatggataggaagaatcaatatcatttaaatggccatactgcccaaagtaatttatagattcaatgctatccccatcaagctaccattgactttcatcacagaattagaaaaagctactgtaaatttcatatggaactaaaaaagagcctgtgtagccaagacaatcctaagcagaaagaacaaagctggaggcatcacactacctgatttcaaactatagtacaaggctacagtaacaaaaacagcatggtactggtaccaaattagatatatatatatataccagtggaacagaacagaggcctcagaaataataccacatatctacaaccatctgatctttgacaaacctgaccaaaacaagcaatggggaaacgactccctacttaataaatggtgttgggaaaactggctagccatacgcagaaaactgaaactggaccacttccttataccttatacaaaaattaactcaagatggattaaagacttcagcataagacctaaaaccataaaaaccctagaagaaaacctaggcaataccattcaggacataggcatgggcaaagacttcatgactaaaacactaaaagcaatggcaacaaaagccaaaattgacaaatgggatctgattaaactgaaaagcttctgcacagcaaaagaaactatcagagtgaacaggcaacctagagaatgggaaaaataactgcaatctatccatctgacaaagggctaatatccagaatctacaaagaactttaacaaatttacaagaaaaaaacagccccatcaaaaagtgggcaaaggatatgaacagacacctcttaaagaaaacatttatgtggccaataaacatatgaaaaaaagctcatcatcacttgtcattagagaaatgcaaatcaaagccacaatgagataccatctcatgccagttagaatggtgatcattaaaaagtcagggaacaacagatgctagagaggatgtgaagaaataggaacccttttacacttttgttgggagtataaattagttcaaccattgtggaaaaaagtgtggcgattcctcaaggatctagaactagaaatgtcatttgacctagcaatcccattactggttatatatccaaaggattataaatcatgctactagaaagacacatgtacatgtatgtttattgcagcagtattcacaacagcagagttggaacgaacccaaatgcccatcaatgatagactggataaagaaaatgtggcacatatacaccatggaatactatgcagccataaaaaaggatgagttcatgttctttgcagggacatggatgaagttggaaaccaccattctcagcaaactaacacaggaacagaaaaccaaacaccacatgttctcactcataagtgggagttgaacaatgagaacacatggacacagggaggggaacatcacacaccagggcctgtcagggggtggggagctaaaggagggatagcagtaggaggcatacctaatgcagatgacgggttgatgggtacagcaaaccgtcatggcacgtgtattcctatgtaatgaacttgcactttctgcacatgtatcccagaacttaaagtatatattaaaaaaaagtctgagtgtcttaagtattagtcattgctatttggatggtttcttttccagggaaaatattaaaactgtcttgtacctctctattccttttctttctccctaggttttggaaatcactagtgggtaaaaaagaccaatttgcaactaggctctcatgctctgttgaaaactatgtcacaatatcacaatactagatgctgggctcaagacagcaaacagaaagcagtaagttacacatataaatgacaaatatctgattcacttcaattaagtaactatttttttttaatcacaagaactgctttttcccgaatctgttggattgtcagtgtattagaagtgagcatgttctaatttataataggagaagttggagaggatgagcaagaggtttgccccatttctgtaaccatcagagacaaagcaggaggagcctccaaaaattagagcagaccttgccctaaaatgacataagtagctatttaagtgatgtgggcccagcatggtatagccataaatacatccaccacaactgtattaaaaggcctggaatgttcgcttcgtagggactcatacatgatgttgctcggcagtgaaatgatagctaattgtctagtgcggtggattactgtagccaatcacttagcaccatactcttttaattgaatagcaaacgtataggcttgggatgagatgaggctgtctagtatgggttggcatcctggggaggtctgaaaagacagaggcccgattaaaaggcttcaggaggcagagtcagagaggccaacagtgtactttgtctctcataagatttgcttggaatctgctcaacgctaaaagcccctatttagaactggaggttcccaagagatacatttccatcattttgtgagaaaagaggcagaatacgagggagataacacagacgtcatagctggagaataagaatgatttaatgtgttcttggcactgtgctaagtggcttgaggttcacacacctcatctgatccatggttaccatggctgtgcagctccatcatccacggaaatgaaaaaaatacataattgcctacctgtttcaacccatcacccactagacaaactgattgcttaggctttgagttagagctaggcaagtgatatttttaaagctgcacaagtgattctgaattattatcaggcataaaatttgcttattttttacaactcctcaaacaggaatattgcctcatcttctgcagaagatgagttgcaatctatccatctgacaaaggtctaatatccagaatctacaaacaacttaaacaaatttacaaggaaaaaacaaccccatcaaaaagtgagtgaaggatatgaacagaaacttattaccaggcttgagatgtgcttaatttttacaactcctgaagtaggaatactgactcatcttctgcagaaggcgagagtaaagttcatgtttgactgatggagagctagaacctgggcctatcatttctggtttcttggtttttccatttaagacaacagcttccctgaaggtttgaagtcttaggttttgagtaggtaactataggacttccaactgtatcccactttatcctctgagtgattggtccaaaagaaaacaaggaatctacttactgtcagcaggatatacagaaaacagcataggaattcacataccagtggctttaattatggctagttgtgtgactgtgggcatacgaccttgctaagctttcatttccctatttgtatagtggaaatgataaaatgataaacagtatctcaaatttaatttgaatattcaataaggaagtatacataaggtatttaaaatagtatttggcacacagtgggtacccatctatgtgctagttcttgttaccatattaatggctactaatagttttctcttggctagacaatggcatttgtcctattctcttctttttttctttaaacaaaagaatgtggtgactggagagaaggcactagaggtgggacggagttaaagactataatgaatcttgcagaatctctcttgcacccagtaaaaggtgcctaatttctgtgtaaagggctcacgatggaaatcaggttaaaacaaggaacttaatcttaaagccgcgcttgcctatgtctgttaaatcctttattttttcttagacagtgttccagtgggagttggggtggctgatggagacagatggggaggtgaaagcccctcccaaagttgccttttggtgacaccacaacttaagcatcacactttaccttggcctcacttggataaacagattcctctggtgtaattttgtgagctgccagacacagacaagtatgtttatcacttgaatggcaagcttcagcgttagagttgctctatttatacactgctttgcagacaatcctgatgcttttacataattggtgagctccactagcttagcaggcaagtaaataagatggtaaacaatactcttttttctgcacaggcttgtgatgaattctcaagccagctttgcttgcaattagtctggataacttacatattttacattacatgagatgacagttggttttattgcttttcccctaaaagtcgggccttgctgtgacagctacttcacaagcacaggggagcctgctgggcaatgggaagggcaaaggatggcaaattggtctggttccattattgcaatgtaattactcaaacttagccttgctggatttgtgcaacttctctgtaattacataatgatccaaggctcaagagaggctggaggtttggatgcattgcatggcatgtatattcattgtgctgcaaacttccatgacttctagggtaggcattgtggtccgtaagaaattataatgaaggcttggaaatgtatagactgcatgcaggaatcatgcatctgccaaggcacagggaaagtctagaatgccaaggcacttgagaataatctggtttctgtacacagatcttgcctctaaatccttgctctacaaaggagtcaactacagtcactcaggattctggaaagggtctagattcttccaccttgcttccctccactctagaggcagaagagaagagccaacagtgtaggtattaagacagacttacattttgtttccttcagagatgaagtggaagcatctttgactaatgtgtacacacttgaatgtccataagagaagcaaatgcaggcatccaactgctaatgaatgatctaaaagattacttggtagcttttagtataatcctgaaattagttaatggaagtgccactaatgagcatctattaatagaaggcaagtgtagtaacactgctaatgtaatggcctggagctataataaaacatgtgaacaaaacacatctaatactgttctatgttaaaatagctctcttgaaaaacacagagctagaaaatgatcacaactaagagacattttaacaacagggacattacttgatgggactcaccatcaagttttaaatggggtagtggacagtaatacttccagaccctctttccccaggggattttcttgattattctggctgggtatcaaaagttctgatcttttcttagaactctttatataacaaggaactaatatttaaaattcaacatttaagtttgtacttctttatggttctttgttttgtgagttaatatagtctccacagcaaaattatttccaacctgaaaacaggggacctatctatctgtaatagaatatcttccctactgtttttctttctcaccactccagcttgagattgaatgagtaccacactctgtgatctcacagagtgttctgttttcctttctttataccctagtcatagcatatgcaaataaccacatcctttgcagggacacgggatagctggaggccattatccttagcaaactgacacaggaaccgaaaaccaaatacgacgtgttctgacttacaagtgggagctaaatgatgagaacacatgaacacagagggaaacaacacatactggggtcttttggagggtgggaagagggagagcatcaggaaaaaaattgatactaggcttaatacctaggtgatgaaataatctgtacaacaaacccccatgacacaagtttatctatgtaacaaacctgcatttgtacccctaaacttaaaagtttaataataataataataaatctccttgatgaggttctttggaattaggggttctgcctttttgtctctagtcatatgcccaggactaaggcactgaacaatgacagcacggtgctatatatgaccaacaagttagttgtgttgtttagattcagtttgttcctgtatcttaggagaaactcagagaataatgagctactccctgtcttcaaagggcttcaagtctagaaatggttattacccatgttttacatacgtaaaattcagatcatgctgatgaatgaatacccacaagtggaaatgtaatgagaatattcataacgtgggcttaaatttacttttctcttttctaatgcaattatttatttaattaaaaaaccatttgtcttgaggactgcctttcatcagtgcaagtgttgacaaattcctgttcactgctatggaatacagaatgatgaaagtcagtcatcccatatattttcattgcagtgtaaaggttacccaagctttgacatcatatacataatatttttccctgcctgcagcagacattagctgtaagtatgcctatgcaaagatcacatacacaccacaagaatcaaatatgcttatgtaagaattcttatacttaaagcagtatagatagatttagtcttcatgtttatggctacatgatgtggaaaaggctgcggaaatgctgctgtctacattggcatgacattggaattaaagccaactggaggcagctgcagctgtctacgaaacaaatctggggaattcaacagtagaagccaacggctgcagccaaaatcccacagtggaaaaagccctgctgtgggacctggcattggcagtcatgtgttggcatcactgaacttcatttaatgaaagacccccaggtcttcactgtgggccaactccattactgccatattctagtcctcattaaaggtttgggtggcagggagcttttctatgcagatatctgctgccatctatgttgaacgcagaaatggtaggcgagcctcaaagcagtttaaaatccacctgttttgatgcataaatagtcaagtaactagacttgatcaccaatccaaggtgaggtgtcaggggtggaggagggtggaaaaaagctatacctattgttagagaaatttgcagaatgttttgattatatggaagttattcactttacagttccttttgcaaattacatattttactaaattgtctccttttattaaccataagaaaggaaaagcaagcataatcttttcatatactcaagccatcattatggttaatttcataatggtttacatgcagtgccaaaatgttcacatgctagcaaattatttttattttatacataatctaataaccataaccataaagctgaaatgatttctagctttcattttgaccatgtccctaaaagctgtttacctggctgctgatcacatgtaaactgaattggttccttaacaaagggatgaaaattgagtggaagaggtatcaattagagaaactgaatggctcatgaccctactaagttgcaagaatactattttcacaattgtaatgataaaaaataaaaaaatgaaaatgccactgttcaacagaaatatattttcctataaataaatatatttgtaattacagataccaatcacaacttgggcattaattaaacagagaaaacacttaaaaaaaatctgttgttagagaatctccttaatttttttcaaagctgaatagaacttgtccttgcattaaactctcttctgtgttatctgtgcagctgcaaaactttattcattcagtcagtcaaaagttgatattgtttgcaagactctccaatggcaaatctcctaaataagtccttacagctcttcatattttcacaacaccacatcagtgtcattaatgtgcatcatctccacgttccatcctttcctggaaaggttcattatgatcctccaaacataacctaacaactatacttttctagagtgcttctggaactagccaggcaaaattcgtgtgctgtatcttatatcttactttttgccttcctgtattgtgtgcttggttctttaaaaaacagttatgcacatgtaaaaaaagtattaggcaaaagtatgcaggttaaagatatgtacacctaagtctagttactgatgattatagcaatagcaaaagataaataagttcatatcttttttgatggaatcacatatcttttatgttgttattgttctatgaaaaatcttagagatcaactaaaccaaaactcttattattcaaatttgaaactgtagtccagaaagaagaactgattggttacaagttccagagctggcatcatcagagctagggctgcaatccatctctagatccccacttgggagctttttcttaggctccacgctgaaagacaagccatcctatgataagtactgaattataggaaggtctcgctagtccagaaacattacaggttactctaaagattctagttttgctagatgtgtcttgtcttcccctacttttgtttatagaaatccttggctccaaataaagcctgtgacacataagcttcttgctgttatcacttttttcatccctttaacacttcctggaatgctgttaccttcactacctcattctaattccatcagtgcttctttataagcagcccacaggatggctttcattataacagccacacattgcaccttggctcaagtgagaaatgctgcttagatccacaaggtaaaacaaaataaacagttgccttcacctgtttcacaatcttcattctacatcaactcttaatcactataaaggatacacatgataggcgtgtgcaaattagaaatggttcaaagaataaaaatgctactatgtgatcagtttttctttaaaattataattaattatcatttagaattaatgaacatatatggatattcatgtaaaatttaatgcaaaatgttgtaagcaaatccagttctgctctataccatatttacttacagcttacaagaacaaaaaataaatgtactttcataaacagattactatgatggttctgttcactctacatttaaaacagccactttgtcattttttgaaaacttgcctcatatgggagggagttctccacatgcagatgtctgctgccatctatgtggaaagcagaaatagtgggtgtggtttgaaacaagtctcttttgtgtgatgcacaaatactcaagtgtccagactttatcatcaaaccgagtggtaagttggaaatgaagcccaatttttagtgacctgccacctctcctaggccttgcttgattctctgaacgggactcatagcttctacattctccctggcctgctttgccttagggcataagataaggaatgctcagtttccagaagactgagaaatgccacttctacaagagaggtgctggttcttggcacagttgctttctgagctgaaaaaaagtgccatgacatgtacagaactacaatggagttaaattctgaagagtgtaatatatgtatgcacatatattagacacgggaaatgtgcatatgtaagaaatggaaaatgttcattggacttatggcattcacatctaattggggatatacctgatccacatctacaggtctttagggttgctcaggatttcaaatcttcccatttaatctttataggtgatactttggagggtggctgcccatttctctctaaatggctatatctagtcccccacttttcacactcttttttttattttctttgagtctcagttgaactattcattcttgtcttccagaactcacttcaaatgggttttccatctatcatgagtctagtgttctcacctttgtcttacaattaattcttctgcagatcccctcacactgatctcctcccctgagctttggacaattatattctctcatctctttcacataaatcgcacttggaagacaaactcctcaggttaagctgccatctggtgtgtgtatttttcatcaagaactagcaacacccacatcaatagcatccacctttaccatcacctatataagcaacttactttgggaacctatttccttatttcagcattctcatttgaatcaatctagcctaggttagggacactggaaccaaacttggctgtccctggactggcctgggatacctataatataggagggactcgacgaggaactggaggtgtgagagcaaataggaataagatacagtttctgagatgaagaatctaataaaatccaatagaatggggctgtgtcctaagatgaagcaggccaggaagattttagcaggaaatgggtccagttcaaaaaatcaagcaaggcttgggagaggtggtagatcactgaaggtcaaagcacaaaggatcaggatctagtaaacgggctttggaaacggaaaaccttaggagaccctgaacatttcaaaaagacatttgtgctctaccttctttcaaactcttaactctgggcacctacactgtagagatgtaacagaaggcagaagaaatcaggggcatacaggtaggtgtgtcatcttttggttggcacatagatgttctgattacagacagattgtattattttaagagagatggggcatgtgaatatggtgcaagttattttttttttgtcttcagtttttttttcaagggatagcaaggtttatatagagtggtgtgcctttcgaatggcctctatttacacaaagagattggggattaggggaggatagggaagggaatttaaccttacatcctcacattgaatggcctttgtggaagcagtcctaataattttccattactgtccaactttgtattctgtttttttttttttttatatactttaagttttagggtacatgtgcacattgtgcaggttagttacatacgtatacatgtgccatgctggtgtgctgcacccactaactcgtcatctagcattaggtatatctcccagtgctatccctccccccccgccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgctgcagtaaacatacgtgtgcatgtgtctttatagcagcatgatttatagtcctttgggtatatacccagtaatgggatggctgggtcaaatggtgtttccagttctagatccctgaggaatggccacactgacttccacaatggttgaactagtttacagtcccaccaacagtgtaaaagtgttcctatttctccacatcctctccagctcctgttgtttcctgactttttaatgatcaccattctaactggtgtgagatggtatctcatggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttctctctgacggtagtttcttttcctgtgcagaagctctttattttaattagttcccatttgtcaattttggcttttgttgtcattgcttttggtgttttagacatgaagtctttgcccatgcctatgtcctgaatggtaatgcctaggttttcttctagggtttttatggttttaggtctaacgtttaagtctttaatccatcttgaactgatttttgtataaggtgtcaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtatcagtaccatgctgttttggttactgtagccttgtagtatatagtttgaagtcaggtagcgtgatgcctccagctttgttcttttggcttaggactgacttggtgatgcaggctcttttttggttccatatgaactttaaagtacttttttccaattctgtgaagagaggcattggtggcttgatggggatggcattgaatctgtaaattaccttgggcagtatggccattttcatgatattgattcttcctacccatgagcatggaatgttcttccatttgtttgtttcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgattttggtacattgattttgtatcctgagactttgctgaagttgcttatcagcttaaggagattttgggctgagacaatggggttttctagatatacaatcatgtcttctgcaaaaagggacaatttgacttcctcttttcctaattgaataccctttatttccttctcctgcctaattgccctggccagaacttccaacaatatgttgaataggagtggtgagagagggcatccctgtcttgtgccagttttcaaagggaatgcttccagtttttgcccattcagtatgatagtggctgtgggtttgtcatagatagctcttattattttgaaatacgtcccatcaatacctaatttattgagagttcttagcatgaagggttgttgaattttgtcaaaggctttttctgcatctattgagataatcatgtggtttttgtctttggctctgtttatatgctggattatatttattgatttgcgtatattgaaccagccttgcatcccagggatgaagcccacttgatcatggtggataagctttttgatgtgctgctggattcgttttgccagtattttattgaggatttttcatcaatgttcatcaaggatattggtctaaaattctcttttttggttgtgtctctgcttggctttggtatcagaatgatgctggcttcataaaatgagttagggaggattccctctttttctattgattggaatagtttcagaaggaatggtaccagttcctccttgtacctctggtagaatttggctgtgaatccatctggtcctggactctttttggttggtaagctattaattattgccacaatttcagatcctgttgttggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgagtcttctctctttttttctttattagtcttgctagtggtctatcaattttgttgatcctttcaaaaaaccagctcctggattcattaattttttgaagggtttttggtgtctctatttccttcagttctgctctgattttagttatttcttgccttctgctagcttttgaatgtgtttgctcttgcttttctagttcttttaatggtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagagctttacttccaagtatgtggtcaattttggaagaggtgtggtgtggtgctgaaaaaaatgtatattctgttgatttggggtggacagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgaaggtcactcaggacttgctttatgaatctgggtgctcctgtattgggtgcatatatatttaggatagttagctcttcttgttgaattgatctctttaccattatgtaatggccttctttgtctcttttgatctttgttggtttaaggtctgttttatcagagactaggattgcaaaccctgcctttttttgttttccatttgtttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacaatttggcatgattttgcagccgctggtactggttgttccttcccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaacattggcccccactctcttctggcttgtagggtttctgccgagagatccgctgttagtctgatgggcttccctttgagggtaacccgacctttctctctggttgcccttaacattttttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagcttgttttccaacttggttccattgtccccatcgctttcaggtacaccaatcagacgtagatttggtcttttcacatagtcccatatttcttggaggctttgctcatttctttttattcttttttctctaaacttcccttctcacttcatttcattcatttcatcttccattgctgacaccctttcttccagttgattgcatcagctcctgaggcttctgcattcttcacgtagttcttgagccttggttttcagctccatcagctactttaagcatttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggacgtcctttctgtttgttagttttccttctaacagacaggaccctcagctgcaggtctgttggaataccctgccatgggaggtgtcagtgtgcccctgctggggggtgcctcccagttaggctgctcgggggtcaggggtcagggacccacttggggaggcagtctgcccgttctcagatctccagctgcgtgctgggagaaccactgctctcttcaaagctgtcagacagggacatttaagtctgcaaaagttactgctgtctttttgtttgtctgtgccctgcccccagaggtggagcctacagaggcaggcaggcctccttgagctgtggtggactccacccagttcgagcttcccggctgctttgtttacctaatcaagcctgggcaatggcgggcgcccctcccccagcctcgctgccgccttgcagtttgatctcagactgctgtgctagcaatcagtgagactccgtgggcgtaggaccctcccagccaggtgcgggatataatctcgtggtgggccgttttttaagcccgttggaaaagcgcagtattcgggtgggagtgacccgattttccaggtgctgtccgtcacccctttctttgactcggaagggaaactccctgaccccttgcacttcccaagtgaggcaatgctcgccctgcttcggctcgcacacggtgcgcgcacccactgacctgtgcccactgtctggcactccctagtgagatgaacccagtacctcagatggaaatgcagaaatcgcccgtcttctgcgtcgctcacgctgggagctgtagaccggagctgttcctattcggccatcttggctcctcgatcgtcttctgtttcttactggcaatattccccaagctagagctatgcaatcagtcttctatattccttaaatctgtatagtctattgtaaagttaagtatgagtttctattatataaattaactcaagtattgttcagagattttacttatataaattttttttcatctggaggaaattaatgtatatcattatatatagaagccattttctcctgaaagtaacaatgtaggtactttgatgttatttgcagtgaaatttacctttacagggataactgcagtaaccttttaaatgaacatatgtatatatgtgaacttgcacctgttattgttgtcatggaaacagttccaaaacataagatacaattctattattgaggcagtatagttccccaaatgaattttaatgaaattgcagcagaaaaaaaaaaaagaattttatggaggcttctaaattatttagtaaagtttgccaactagaatctgactacatcataccatagtaatcttcacctaaaaaggaaacaacagtcagcaaatgtcaatcatgcaaaaaggggcataaagtaggtttatttaaaaagtgaacacagtaccccaattctagctttttagtgtctatctttaatattgcccaatcactactcctattgttgatggaagtatatttgaccattagctgtctgagtggcacacaccaagatcactgagttatctggatttttttcctagtttctgtcatctttgggctttctattgacatgaggtgaatagatttagggctagaatgttttaaatgctgagagacctaaaggacctctatttcaacccattgcattacagattagggaaccaatgcctaaaaaagttaggtgatttgtctgaggtacacaagtaaatgtggcagggctgcattaggggttgggtttctgactctcctcctcccatgcacagtcactgtgctgcctcgtgaaatacagccctctctgctgccagttacaactggtgcattctactccagcctgggcaacagagcaagactctgtctcaaaaaaacaaaaacaaaaacaaaaaaactggtgcattctttcataaaggaaagaaatcaaattctgaatgtgaatacctgaattttcattccccacttacattgttacaggagtgaagtacaatttgcttaatgaaataaaatttcagtatcctccttagtgtatgtatctcctcactaaatatgttgattgcatgtagattacttcttttacccatggaaaccgaacgaatatcttaatgtaagaagagtagttttctcaatttgtaaccactgcttcacctcttctgtaatccgaagtcatgtgaatgaaatgtcccaggctcataatgaagccaactgtgaaaccagcgcttacctccaagtcaagagcctgggaaacatctatggagcttagcttaaaactatctgatgatgaattgggactccagtatatcattttgtgcacacagttatggcataatatttgggggaaaggaagccttcacagttataaaatatgagtgggaaatgattatccctagatacagagagtacttattatgtaactgttgttaagggctgacgacatggcaggctctgtgccaagtcaagtctccgacggagcggaggactccccaggctctagaaggcccctgagacagtgtgtcatacagtgatgaggggtagaaaatactctaaccattcaggatgtgattgttttggcttcctctcggctgagcttttggcacttgaactggacccaatgcaacaccacagctgggaaatgacattatttggattggttaagaggagtttttgaagcaaaccccactgtagtattagagaaataaaaaaattcctgctatatccaacaagtcccagagaggctgtctctctattgttcacatgtttggacatgaatgtgcatttatgaacacttttttgtataaatacacagatatataagctatgcaaagccatataaatctgtactactagaataattcattccataaatatttcttgagcattcactacataccaagcacatttttctagtttaaaagtgaagtcgggcatggcagctcctgcctgtactcccagctacttaggagactgaggcaggaggattgcatgaacctaggagttcaaggctgcagtgaaccatgatcattgccattgcactactgcctggatgacagaatgataccccgactcaaaaaaaagtgacccacatgtgtatttgtcacttttaaaatagagacaataaatttcttccgtgatttttaaagaacttaaaacagaggtactattcaacccagcaatcccattattgggtatatacccaaaggaaaataaatcattctaccaaaaaggcacatggacttgcacgttcatcactatgccattcacaatagcaaaggcatggaatcaagtcaggtgcccatcaacagtggattggataaagctaatacggtatatatacaccatggaatattacacagccataaaaaagaacaaaatcatggtttttgcagtgatatggatgcaagtggaggccataatcctcagcgaattaacacagcaacagaaaaccaaataccacgtgttctcacttacaaatgggagataatcactgagcatacacggacataaacgtgggtataatagacactctggactacctggaatagggggcatgggttgaaaaactactttatcagtactgtactcagtacctgaatgacgagatccacaccccaaacttcagcatcacacaataaacccgcacatgtaccccctccgtcaaaaataaaagttgaaatttaaataataaattccttcctcacaggtattaaaaagcacaatgtgagtaaagtacctgatatgtgaccataaatacctgtccccctttgacctcttctttgccctcccctaaccttgaggtgtgattaaccttcctgccttttcaaattctgaagaccacaacagagtagggaaagaagagtgtgaaggtggtccatctaatcccaattcagagcctgggacagacacccatactgaatcctctactttagaaaagaactccacaggctttgagagtgacctgtcacttgtcatagcccctaaggactatgagctttttcaccataagcattgcctatttgttccaatctagtaagatcagatttatcaacagacagaaaaatagatatcagtttttttcttattctaaaaacaatatgtttatgttgttgaatactgggataaaatatagaaaatattaattattcataattcctaatccaagcagtgttccactcaataatttgatctatttcctatagtttgctactaacttcggggcagatctccagaaaataaatattgatggggctatgatgtctccattttgactaaatatattgttatataaagtggtaacgccttacaatttaagtgtgagaaggatgtgtgtgtgtgtgcgtgtgtgtgtgtgagagagagacagagaatatgaatatgaatatgacaatactttggagaaatgtgtccattagaattttaccacaagccagactgaaaacatcaaagatgtttaagtaaagcctgtttagttctttgtgaatgtaattttggaaaacaaactaaaacataaagataaaaggtccacatttcctttcatatttgcaaataaggcttatttcatgaatggtgaaatcgctttgtgtaatttgtaacctcattgttgtcctggattgcctgccatgctgcctgtgtttatgttgcttctccctatggcatgtgctctgagcagacaagggtataattataaatctccatccactaacaagaacaatggttgcatccagcaactcgactctccctttgtgaagctctacagggataccgtcttgaatgtcaaaggtctacaaatgtcatagaaacagctgccaccacttctttgcattaggcatctctttcaacatttactcatggtattgccttacccatctaggcagaagcaaaccaaaatccagagattttaaaatatggtatctataattacaagaaacaacaagaaaccaaagaggaatacaaatacaaccatgccttgtgtttcaagactttctagacttgcttagaaaaaaagagactaaatttttgtctctgggcaaagttagtcagacgagaaagacaaacttcacatgcaaggtatactttttgctgtctccatttttataaaagcaaagttaatgaggctttgatctttattccatagttattaagattattttcctaaatctgagatcattgcagagatatacaaggtagttctgccaaatcattcattcattccttcaccaaacgtggatacgagtgtctactgaatgtccagtaaaagcaggaatacagacattgaaggctcatttcattgcccttagtttctacatatcatagctgtgatgcatggaatattaaggaaacccctaaatctttaactgagttaattcacaacttaccagagctattttcaattcatgaaaataaaggccaggcgtgtaatcccagcactctgggaggccaaagtgggtggattgcttgagcctcaggagttcaagaccagcctgggcaacatgataaaaccctgcctctaccaaaaatacaaataaataaataaactgggcatggtagtgtctgcggtcccacctacttgagagctgagatgggaggatcacttgagcctaggaggtagatgttatagtgaccaagatcaccccactgtactccaaccttggtgacaaagtgagaccctgtctcaaaaaagagaaaaagaaaagaaagatttctcaagtctaagttcagtatttaagaaaaaataaaaagtaacatcatggctttgagcttgattttacctctgttttagactaagaagtctattcaaatggagcctatggccctgtaacctggctctgggaaaatgaacaaaggaatgcaacatcacatcagcactgtgtatttttggaagggtattgcatttttcctttgtggtggattggtccgtgcacttgaaaatacattcacagtgggaaggcaccaactctgctgcacatttatagttgaatctattttttttcctgacaaatattcaagtgggggaggaattccatgtgaatgctctagtgcctccttccctctgatgagtctaagtgctagataaacaaacattatttctaaaacctcaaggggaatacttgaaactggagcaacgtaagaggaaaagtgggcagaatggatagcttctagggagactgtgacatttctgagtaattactgaggggtctagggtctgggggacaacgctcccatcagcagcccttttgttattaaaaaaaatgaacatctgagcaatttaatggaaagtgctgtgaaaacacagctgcaagccttacattcttaccagatcacctcctctaagctttcctatgtagaaattttgaagctttcctggtatctcctcactagggggttaggaagtaagtaaatacactgcactcttggtttagtggtgggagatacattaggaaagcgtcagtgcacatgaagagacccacaggctaacagccatcatttactgagcatctactacgtgagtctccttctgagcgtttccacatctattatctctttaaatttcccaacaacactaaggtaatgacagcctttcctgctgacctatgaaggccaggctgggagttgtccgatgacttttcctgtataatgtcaccccaggggaagacgttactctgatttttccacctcatgtttttccctggcagttgctgtgagagaatgttgtttttggagctgagtaggcaagtggtgtgcatgatatgaaaaaccaaaaaaaaaaaaaaaaaaaaaatgcaccaaaccccacaaactttctgacagaaagcactcgtcaattttagcctgtctatgcaatgatcgaggccttttcctactgctggatatttctaagtgagaagatcctacctcagttttcagctgggctttagctctgcaagaagtgctgccccagtcagccttggggagatcagtagaggattagttagcagagcagccactggagggcactcctgaaatctagaggcttcttcctcccgaggaaagggttgctggagtccctgcctgagactgtgggtttaacaaagagaaggaatgtctgggggataagtcccagtgcactcattctctggaaaaggtctgctgtacatatttgccaagtgataaggaacctaggaaatcaaaaaccatttgacaatttacagtgttcaaaggtagcttcctgactcttgagttacataaatggctatgttaaaaataggcagccaatataattgagcaaccttaaatggcctaggatatgtaccatatgtgatagccatgaaaataatcaaaagaataattcagtataaattaggaatcattcccactccagtggactcagtcttatggaagtggcacataggagaaacttgggattctgtgatttgtgctgttcatgtacaggtctctctctccctagtgaaactcagctctttagtttgggagcctataccggatctctctgatatccctctccagctctaaacatatactacgtagtcacactgattgtccgttaaatacattcaagtcgttattttccttatgacaaaattcacagtgaaaggccacgtgtccaccagaagaataaggtgcaaatctaaagtgggttagtggcattttctcaggacagagtgcatgggaggacaacatagcaatcctggaagttgacagggtaaaacttttggacactctgactctgtgctgtatgtacctgtttgcttctgctttgaaaataactagtaatatacaagatccacttgaaccactgaatttagcaaaatcaggccaaaccagacgtctttgcattaatattgtcattttgttttatattacttaaaaagtcaaacttttttttttttaatcattccttctcttgactatctgctgctctcctgtgatgtatattgtgaaaaacacattttaaaaccaagacagatatctcaagatagacatcatgttcagtttctaagctacaattaaatctcgtagaatggtaagaggtttatatcagactgttgactgctttatatacattactttcattcgagactcatttcatggatgaggaaactgatgtttacataagtcaaggaacttgaccaaggttacatagttataagaagctgagctaggaccctacaggtccatctcagagacctatgatgttaatcattatgccatatgacctgtcttagactagtttaagaaatagcttctcaattaacctctcttcttttaaaagtgttcataggttttaattccttttttttctgcttaggcaatacttaatttttaaactgtgcacatagaagatgaaatggaaaaatgtattccagatgtaggttttatagttgcacatcttggatatggttggttacacatacactacaagcatgtggtacacatctatctcatttttactttagaaatacattctcaacaggggaaacttgaaatacgcaaactgtggtcctgattccacttcaaaacgtctgcttttattgggtttaccctgcaatcatgcaacttttggccagagtcaaatagggcaactaaatttttttcttgagttttacttggtatggttcactgtaaatgcttccaactagtcctaaagacagactttgttcatttgttcttctatgagttttattcagcagaaccttggataacagcagcttagccaaacactgtggggtaatcactctgctcaggactgattcctgtgcagtcagttcttctgcacatcttgccttcaaggtctgccagctgaatgcactgtgtttccaacattgccctccaaacagacctttcataaggaaaagtcactgctacttcattaattccagaagatggatggtgaagtcatattgctttgatatgctttcagactcaggctgttcatgggaagctagaactctctgaaacagaaaagtttttaaattctggctactttttcataggattctattatgacacctcagaggaattttttttatttaagtctgtcattttaaaggaaaatggttagatgtgactagggctgtgaaaacacagtagctaccagtgcctggcaaagtttgtactctaacatatttctgctaaaaaaaaaaagaatattttccattattgccttggattctttcatcttttcttacatgttaagaaacttaatatctgaagagtgagaaatagccattttagtgtgaaatcatgctggggtggaaaggccagcatatttcttatagattagtattataggagagtttggccattttcctgggcagaagcaaggagttggcaccttggaatcaactcttagccatctgaaggctttgagccttggtgagttttccaaccacagggcattagctttctgcagcctggaatggagcgatcactatccccagagagctgtcatgggtgcaggcagtgctcagcttggcttagttctaccatggtcctgaacagccaggctctaggttaagccaaatccagaagtatcttgttttatttcacttgccacgtgtttgagaaggattaatctcagaatatggcagaagccttagcaaagcaactttagaaaacagcatatatatgtgtgtgtgtgtgtgtgtgtggagagagagagacagatctgaggcatgggttttactaatgttattatttaaataaacccttccttatgctagagcaccagatggtgttacaaaaatgaggaaaaaaggctcagggcatataagtcacgtgtcacattagctgtattggcctatgttcaaataataaacattttaatcactgcagtttataactctattttaaattttttgttaatacattaacagtaactgcttacgtatacatagaattctaataaaaatgcataaataacttacaagaggaaagggacttagggattatccctggaagccctcatttcaaaggtgagacccagtagaaacccaatatgcacagaagttaagtgactttctgaaaggtcttgcaggtaattaattatagaacaggactccacgttcaatgctatgttcactattacctgaaatagacttggaggcaaaaataaacttatgtcagctatactcaatgctcagtaaagtggcagagcaatattttataagcgtgtgttccgtgaactcaaatgtgatgttaggtagtgattctgagtcccttaaaacagattgcttgatttatttaaggtatgttctctattacaccaaaaattgtttatggattttttaaaaactgcactccatggagtaagtaccaatttctacacttttgatgacattaagatatgttaagaggcctgaatgttctcaactatggattaaaaataaagtaccaattagttgggtcagttttctacagtgatttgaaattgatttctaagtttccctattgctaatggctgaatgtttatgttttcccaactccaaactcagaggttgaaatcctaactcccagggtgatgggatgagaaggtgggtacctttgggaagtgattaggtcactcttaagagtgaggttagtgcccttataaaagaggccctggacatctcccttgccctaccatcacaccacctgcaggcacagcgaaaagatggctgtctatgaatcaggaaattgtacttcaccagacactgactctgccagagcctagaccttggactttctagcctctggaactgtgggaaatacatttctgttgttataagccacctagtctatggttctttgttatagcagtccaaatgaactaagatatctattgaggctttattgggggaggtaataaaatatgtcatttttttctaggtttaacaacctatattcaattcccctttccgtgatctatagtatgggcataaatagactgtcatgtgtatccaaattaagatgatggtagccaggagaaagattgaaggtgggactactggctgttgatagccaagatctaattctgatctttagggatttaggttcgtttctggttggacggagttgtattatttatctatgcatagtgaagtaaccttgtgatcataatttcagaacaaacaaaaagtcttcacctcgtgatgtcttttaatttgattccacatcaccaggggcagaataagttttatttctagggacattcattgagaacaggatgacgtgctgagtttcagatgtgatcagcttgccaactgtccctgggtcctttgtgtcctgctgcaatatcttctaggaaacaaacacaatgacgtttgaagttcatcaagttcattgattaagctaagatctgcactactttgtcgaaatcttaaatagaacaaaaaatgtttgatgttatatctctcagagctgaaattaactgattaaagagtctctgttatgatgtctatcaatcaagtaaaaaaatagggttttgatctagaaatgcctatccgtttttgaggtatatactttcaaaaccttttgaaataaagagaacagtggttgcaaaacttttaagtatttttactttaaaaaaaggatagaaacaaagcaatgtgtcccattacatcagcatttttcaaaatttagtctctgtactttcatttgcataattttccactttctgtaatattttcataacccttagtgcttaaatgggtggagaggcctgtgccacagtctccaacaaggtgtcaagggagaggaggtgtttctcttctcccaattcacaccatatttagaagcactattctagatgattcctctaaaaatattcaagcttttaggatcttggctttgttttttgtaaattgtacttaaagtcagtgtgactattaccatcaatttgaataagtgcaatgtatttctcatgttgcaggtagtaaaaattgccaacgaatcacttaaatactgagaggactgacaagctataatttattacttggctcaaaatatgtctctactctgtattatctgcctagatcttacttaacacaggaagggtgtagacttcactgaaatgactaattgatgttcaatttgcagattttaattgaaaaaaatatattttgataagtagcagtacttgtttcaaaggaagataccgttatattaaaaagtaaacatccaaatctattggtctaggtctatactcaaaaccttccgggtgtatgtatgtgtgagatattttaaagtaattctaaccaagccattgttctgtaacctgacttaacaagctacagaacaattccttagcttaaattgttaaaggggacattgtgatgacaaataaataaaacgtgttagcagaataaaagttgtctggaaataagtaaatactattttataatttgggggaaagaaattcaatacagggtaaagagaacaggattttggaattaagctgagttaaaattcttgctctggacaacagacaaattacttaacatgtttgaatttcagttttttatctacaagttgggaataatatatgcattacgaagagattacaagtactaactggagaaaacaatctgagaccttggcaaataatagattatccaacttaattccaatattattaaaattagtgatcattagctggcactttacaacagaaatgatctgaataaattttcaacatatacatgctctgataccatgacaggaaaatgtaagtgcaagcgtgggggggcggtgtcaggagactcgtgtgtttataattctgatgcctatctctctgaagagtgactcttcgagttattcttttcaatagatgtacttatggaacataatttggtcatattgtagtgatctgctactaaagaaactttcgcctaactttctcctagccaaggatgtgagtctctcaataacccacatttacccatgagttatgttaaatgtgccttgtgttccactggtttagaatttggggtttggggaaaggcaaatgggatgttttcccagtgtactttagcacaatataggtgaaatcatacatgtatatgcaaaaaaagtacctgtaactgttctgtagttccaatgattgattggatcacaatactaaggagggtcagaatttgatgattattctggctttttgggtggccccaaactcccaccagctatcaaatgaaggcgtcgggggagaatatatacagtctacagaactcgggagagttaaagagtagcaagttccaatcaagaagaaatgttttattcagtaattactttgaagaatttttttaagagcccctgaaaatactggatttctgcaggggatattgcgaaaatactaaaatactaaggtgtgaaaatgattctcttttttgaattaaaaaaaaaatcaatagaaataattcagtgtgtgaggtagataagcttcagacaaagggaaaaaccaaacctgctagtcagagatagatataaaaaagagaaaaatcaacctctacgttatgttgccaaggagactgtgtaaacagacttacacaaagagaagtggctggctggcaatactgctaatgtggaaaatctcttcattgttgtgtggcatgcttcatctcagaagagcaggaaaaggtggcaggcagagagggagaaataacaagaatggaagagtcgttcttccaaaaagggccatctgtgaccctgagagataaacctggcagaccagggctcacatcttagtaaatcacctgtaaataaagcttgtaaggcctgtgcattgtctcatgattattttattaataatactttaacccttgcaatttgatacgctgtgcaaggtagtcttacaggggatcttttcattgagacgctcaacttgtttgttttgtgcttctcaggcaagggcagtgactggaagctgggagagagggtcaacagctgaatctcagcctgatggaggccaccatttaataagtaaatacatgcacggtaagcctcatatgactttcgtctctctattcttttagaagttggtctaatccaaccatatatacaaatgcaattatttctccttcaatattttcattcattcaatatacatcgggtattatgaataaagtccgtgtagatacaagtagtctcagttccccaaaatgtttagagtgtataataccaaaaaatgctattataaagtttagtgagaaaaaagtttgtttttatataaccatatatgcaatatgattacaaatctgctaaattgttgagcaaacaataaatggttaatcagtgttgatggatgagcaaactatgaattattttccctcttttaattttcatctccaaattttctataatgtggttgtatgaatttattcatatagagagaatttacaggtggctgaagtgaatctgggttcagatgttggacttcgcggtttattcttttacagagtttgagataagccagtgaagtctgacaaaatataaagcagctctttctgcatttgcaaatatgtgtgcagtttttttttttagatagtacatttgtattttgattgattgattgagatggagtcttgctctgtcacccaggctggagtgcagtggcatgatctcggctcactgcaacctctgcctactgagttcaactgattctcctgccccagcctcccaagtaactgggatgacaggcgcccgccaccaagcccaactaattttttgtgcctttagtagagacagggtttcaccatgttggccaggagggactcaaactcctgacctcaagtgatccacctgccttggcctcccaaagtgctgggatgacaggtgcacaggtgtgagcaatcacgcccggccaagatagtgcatttttaaatgtttctctccagacctgtcatcataaaagttgcttgcttagaagggggataaaataagatgcaaaccagctcttcttttattggagagtttcaatttaatcagaagctgaatgttagcacatatatatatgtgtgtgtatatatgtacatatacatatatatgtatatacatgtgtatacatatatgtatatatacacatttgattccaataatatatattttgagccaaattttatatgtatgtatatgtgtatatatacatacatgtatatgtatgtacatatatacatatgtgtgtatatgtatgtacatatatgtatctgtatatatgtatatacatatatatgtatctgtatatatgtatatacatatgtatcagtatatgtatatatgtacatgtatatactatatatgtgtataaatgtatatagtatatatacatatatacgtgtatacatatatacacgtatatatgtatatgtatatacatacatatatatgtatatacacacaaatatacatatatacacgtatatgtatacacatctatacatatttacatatacatacatgtgcgtatatacacatatgtatacatatatacatgtacatatgacgtatatatgtgtatatacacatatatacacatatatacacacacatatatgtgtatatatatacacacacaatggaatattgtccagccatagaaaataaaatcctgtcatttgcagcaacatggatggaactggaggacatatgctaatttgaaataagcaaggcacagaaagacaagtattatatgttctcactcatatgtgggagataaaaaagtggatttcatggaggtacagtagaatggtacttaaaagaggctaaagggcctggcgcggtggctcatgcctgtaatcccagcattttgggaggccgaggcaggcggatcacctgaggtcaggagttcgaggccagcctgaccaacatggtgaaaccctatctctactaaaaaatacaaaaagtagccaggcatggtggtgggcacttgtaatcccagctactcgggaggctgaggcaggagaatcacttaaacccaggaggtggaggttgcagtgagccgagatcatgccattgcactccagcctgtgcaacagagccaaactctgtctgtctccaaaaaaaaaaaaaaaaaaaaaaaaaggctaggaaggacagcaggagtgggggataaagaaacaaacgttggtttatggtacaagaatacagttagctaaaaagaataagttccagtgtttgatagcacaacagggtgactacagttaataataactgattttatatttcaaaatagctagaagaaaacttctgcatattcccaacacaaagaaatggtaaatgtttgtttgagatgacggatattctaattaccctgatttgatcattacacattttatgcatgtatcaaagcatcacacatactctactctagaaatatttataatcattatgtcaacaaaaaattaatataaaaaaagaaaataaaagctaattccaactgctaagtcattgataaattaaaaatagaaatgagattggggtcttaagtaatttccttacattaacggtcaaaatgaatgccacaccttgtgagacagcatgcaaaactcagtttcagagctggcatattgaattaataacatatcctttttctatcaaaatgctcttaagttgtaaatcatgcttttttgttttttttttttcaggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtcacatcaattagtcaagaaaatgtgattaccctgagcccaagaaacttccactaaaaagatggaaggaaagactacgtctggtgttctctggcaccatccttgagtccacatgtatttagaagtgaataactgaatttagggccatggtacagaggtgtcagtctgcaaactagaagagcaatgctgacaggccctgggactgttcctagtgctgtatgggaactcagaaatctaaccgaagccacaggatgggtaacgacaatgagactgtgacctggcaatatctgcataatcttgcaagaaatttctaaaaccataagacacacggcatttttacttgagtcctaaaatgaacatccggtgatattggaccttcccactcctaaccaaatgacgtcaacacactcttaaggacacatcacacactctgtggaagagggtaggagaggtgtggaatataaaattccttttttgagacggctgcctggattctaatggggttactctaatgtgttttaagaccaaggctcactggccaagatatactttcatgaattcaagaatgtatgatcattatgatgtatacatatacacatatatgcatttacatgacaaaaaaaatgccagaaggcatgtaaaagacagacagtcctcttttcaaagggtgcataatgggagtgattctatctttacgtctaaagtgttctactggacgcatttaatgttcttgtttcctctgtcttaaattattcgttcccttttggacacattattgctccataataatgctaagtagcttcattttgttgttgttgttttttaaatcacccaacctttcctaatgctaagccaggcaatggagggcaggaaaaaaaaatgtctttagagaaggctgtaggcctatcaccagattttgagctgggctttccccagaacacactttaggcctgcaggatgcctgaggccaagggtacttcctgcatccacagggttggggatgctgagtgcaatccctctattctgccacctgggacagccttttgcattactctctggctgccttcccttttctgaaacttgagaggggagaatgttgcttccctttagaacagtaggtgagcccatcagcaactcagccccaaaagtctctgcagtctcatctgacaaattataagattgagcctatcaagtaagtaaataaataaataaataaataaataaataaatgaataaaatgaatcataacaaatatacatatctgtgtatttattacatcttatcataattctcagcctgaatctaaatatacggtctactacaatctttttaattgggctttagctaaatgcatgatgaaaatcattttcagatcttagctcattggaaaaaagtaaagataaaaaataaataaataaaaagatcttagctcactgtcgtactctagtgccttcctaacacgcaagcatacttcccatgtcccattcacttgcaatcagctactggtggaaaattagatggtcccaaatcagaggaaaccgaagacatgataatgaaactcctgaaaaaatcaatgacgattatggaaattagctgtttaccaccttttttttttttgacctttcctttttttgaccctctaggcagcctagtttatggaaggaacatcatcagtgaggtcccagagaaaggaaaatgactgattacagagatagctattatttccagccactatatccaagagcgtatcagatcactcaaagcacattttatcaacactccccctgtgacaatctagtctttactggagttaattaaagcaattaattcccttccctttcaaagcagtgtgattacataaatagataatttcccaatccaaacccataaagcaagtgatttctctgcatgttcctcagtgtgcaaagcacctaactgaaccaaattgtcctttttctaaatttgaccttcatgaaattctccagtaactttttctgctctgtcttcctatctggttggatggcagaaccacatctccacatggacacaggactgcaagattaataaagcatttcccgcagcaaagatagataatgcctaaactgtaatcacaacgacaggagtagagtgaggaggaaaggagaatggcgggtgcctgctctgacaggcactacagttcccttcaacaatataccagcgtgggtgatgctgacaataattaagcaaacagaatgccaaacaattgtaagaaaagctgtcaaacattttgtgttattatcccctgcacaggcctgtaatttatcatcacagaaaaagcacataaagaaaaatctctaaacagtgacattttgttcaaattacaacccttggcttccctgactgcctacagactgacatctccaaggtcggatgtagtgctcagcaatttgttccttcattaagtgagcatgtctctgggatgggttctagccactgtgagtgctggcatgccaagagcaagaacaaagtacttcccaacgtgtgggaagccacttaccttcagacgtcaaaatgaaagaaagtaactgacattcgtatttccttctcagattggtcctaaagcttgaaatatgatctcctgcaccaaggctcctacctgtcatttcttcctccctctccacccaaaaccctgcttggggttctggacttggctaaagtgtaagggctttgatcttgttggtataaactcagtctttactggccgggcactggtggctcacacctgcaatcccagcattttgggaggctgaagacagtggatcacttgaagccaggagtttgagaccagcctggccaacatggtgaaacccccgtctctactaaaaatacaaaaattagccaggtgtggcggcaggcacctgtaaccctagctacatgaaaggatgacgcaggagaatcacttgaaccctggaggcagaggttgcagtgaggcaacattgcgccactgcacaccagcctgggcaacagagtgagactccatctcaaaaaaacaaaaaacaaacaaaaaacaacaaaaaacccaatcttcctgatgatatcccccaatggttgtaattgaaccagaaagaaaataaaaaaaaaaaaaggaaatacttttctcatccagtttctttagagtttagcacagttctatagattaattactataaattgtgagacataaagagacctcagagatgctgagccagtgagacaggtgtgagggtgtgaggtgttactattagtactttggagaaagtccataggcagtctccaacgtagatttctggatggctcagagttgaaatggaccctagaggtaatagaatcaatcttttcaagtaatgagagaaattctgtctgtgatattcctagctgatgttctgagctggaccacttccaaggatggagataatagaagccttccattacaaatacttggctgctgaaagacctaaacatttgagtcttcactgttttcaacagctccttccacacctgtccaacatagagatccacttaacagaagtcctaccctctagatattgccttatttgaaaaggtaatatcttttaatcccatttctttctatcccattgccagagctctttcccattgctttcttcactttcttcacaatcttttttcttttttaatttttaaaaatagggtctcattctgtgcccaggctggagcacagtgatgcaaccaagctcaccacaaccttgagctcttgggctcgaataatcctctggcctcagctaggactacaagcatgtgccaccatgccctgctaaccccatctcaatctttatacccataagagaaccttttcttagaagcctcttttcttagggtttggaggttgatttactattgccaatatagcaaatctttattttccttaggtttattttgattttttaaaacaatagtctttttactcaaactttggcaaagagtttgggctagtataccaagtaaataagctttaattttctcttggccatgtatcttctattagtttctgcataagaccctcagtgcttccatgtttactgctcgctgcacaggcacctctcactagatggcacttaggatatttttcaaccatctttctgaccaaaattgtatgtgttctatgtctcatccctaagaaagttgatagtgaactcaattggctgattacaagtacagtgtgaacaacttatacctgaacactttaaatatattgcaacctaacaaacacatttacatatcaacaatgactcatttccttagtccaagaaagtgaacacaggcttgattctctctcccaacaccctcccctccttttttctctctctttcattccttataatagacaaatgtgaattatcttcacaacctgttcatttaactctgtcaagctattcctcaaggacaaaccacaaaagggaaccagggaagggctgttcagagctcactgaaaatccagatcagctacagaggtccttagcccatagaagataggtctgtggtctcaacttggaatataaataacagcttctttaccaacctcaccaaatcgacttttaatacctttttttcccataggcttccaacctactctgattgacttaggctgatcagaaacaaaactttaacagtaacgtctaaaataagtgaactttgttttataagtcttccttcttgccaaagctgatgactaaataagttcaaagacatttaaattaatgtcagttatacccacagtcactggaggagaggtaataggaattcaagcttccagtaaagaaaaagaggaaatgagaaagaaaaagaggtgtctttcaactctagttgtgatatagtctgctgaattattgacctttcctttcaaagataagaaaatgtgtatgtggttttttttttttttaatttagacttcctacgtgtaactaaaatctctaaaacaaggtggcttattttacatatctgaagaaagtgaggcatgcaattttcccttcctcatagtccgacctaagagtgtgtggcaaactttgtagaattctaagtttccttcaagaacttttcatcttatttccatccacaaattaaaagggatggaattactcaatgtagccatagctaggaatacagtttagtgaagaacaggaagggagagagacagaaggactcctacagtttttctttacaatctaaatatgttaaatgcatgatggaagcaatggagccaggtcaaaatggcacttgctgtgttgtgaaaaatcctgactatgagaatcttctgtagtagaaaggcaggtcattctatcacaccaactggaaggccagtctggggcgtgcttgctggatgtgtggagatcaattacccacaagtccctgtggagtctcttccataagaaactggggaagcccaggccatcagtattctgcacacacactaacagcttgtgcttgcagaggcaatcatttttcagctcttttcagattctctttcttggttatttttccatcttggctaaaagggtttctcttttgtaccaagcaggggcaccaatctaacagaatttattagaaactgctcgattgggattttgctggagttctactgaggttgaaaatctcaaacaatatgtgatgaaaattttaggctgttttgggtgacttcaatcccaaggtctttcttggctgatttgagttccttctttcagagatttaggcaatgttagtttcagatgggaggtctggtagatcctaaaaatgaggtagctctatgtcagccattcagtggagaaagagcccatgctactctgtatgacaaaatactatgcctttatttgcatacaggtgtgaatgaattatttaaagagaaaaatgtgcgagtgggtactgcgtaagtgccacagtcgttgcactgtgcttttcagtaagtgtgaacattttccttcgcatgtctttttaagagaaagagaaaatgatgatgggaaggattttgggtaagacaagattacttttctactattcttatcaaaatttactattttgtcttcctttgtgtagtacctgtgtaatatttgctccacaattgtaagctccttgaagacatgaaatgtgtcttttcactttttttttttttttgagacagaatctcactctgtggccaggccggagtgcagtggtgtgatcttggctcactgcagccactgcctcctgggttcaagcaattctcctgtctcagcctccttagtagctgggactacaggcacgcgccatcacgcccagctaatttttgtgtttttagtagagacggggtttcaccatgttggccaggatggtctcgatctcctgaccttgtgatccgcccacctcagcctcccaaagtgctgggattacaggcatgagccaccgcacccggccctctcttcactattatattgccaatatttatgatagcttttggtttactgcaagaaacaatgagtaagtagtttgtctctttaaaccaatgctttccattcttctccaggtgagaggttggtatagatttttatgaggctttatcataactaaacccagtggtggactgaataagatcagctggtaaatatagtctttgatccactggaaaatccagcaatatctaacttaaacaacaaatgagcgaaattctaacatttctagtatatttgatctattggtttgtaaaccatcttgaagccatgatatagaaacactaactctgtatttttataaaaataaaacataagggtatgcatttattcattcaagaaacatttcttgagtccctaattgcactaggaactgttcttgattcatgatagaatgtgacagacaggttgttcatggagattttgctcgagtaatgcatatatggttggaactggtgggcacggagtccaaaatagcaattctaggccagcttgccctaaacaaatgatacagatattatatgagagagttgctaaaatttggatcatatttagctctcctcccacctctttcaaacacttactaagtttagggagaaatgtgggaacataggatgaagtggccacagaggtacccaagaatcagtacagtaacaatgtccttagcaaatggccctcccgtaattcctaagaaggtaaaatattttagcattgaaataacttcatgacatggctatgccaactctaaaatggtttcatcatgtaaacagtccttcagcgaatgacttacattttgaaaaacctacagagcagagtgaaaagcatgggctgagcagtcagctgatgaggatgactgaagccatgctccaccatttgctggttgattcaagaggaagtcacttaacctttccaagcctcagcttcacctgcagaatggcaataataatggccaacttgtagagttgttgtgaatacaaaaataatgcagtgcatttttagcatgatacataacatataatagcaacacagtgctagctgtaattcaattggaaaaaactactttaaagttcatatggaaccaaaaaagagcccacattgccaagtcaaccccaagccaaaagaacaaagctggaggcatcacgctacatgacttcaaactatgctacaaggctacagcaaccaaaacagcatggtactggtaccaaaacagagatatagaccaatggaacagaacagagccctcagaaataatgccacagatctacaaccatctgatctttgacaaacctgacaaaaacaagaaaaggggaaaggactccctgtttcataaatggtgctagccatttatggaaaactggctagccatatgtagaaagctgaaactggatcccttcctgacaccttatacaaaaattaattcaagatggattaaagacctaaaaccataaaaaccctaggagaaaacctaggcaataccattcaggacataggcatgggcaaggacttcatgtctaaaacacaaaaagcaatgataacaaaagccaaaattgacaaatgggatctaattaaactaaagagcttgtgcacagcaaaagaaactaccatcagagtgaacaggcaacctacagaatggcagaaaattttcacaacctactcatctgacaaagggctaatatccagaatctacaatgaactcaaacaaatttacaagaaaaaaacaaacaaccccatcaaaaagtaggtgaaggacatcaacagacacttcttgcaagaagacatttatgcagccagaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccgttactgggtatatacccaaaggattataaatcatgctgctataaagacacatgcacacgtatgtttattgcggcactattcacaatagcaaagacttggaaccaacccaaatgtccaacaatgatagactggattaagaagatgtggcacatatacaccatggaatactatgcagccataaaaaatgatgagttcatgtcctttgtagggacacggatgaagctggaaaccatcattctcagcaaactatcacaaggacaaaaaaccaaacaccgcgtgttctcactcataggtgggaattgaacaatgagaacacacggacacaggaaggggaacatcacactctgaggactgttgtggggtggggtgagggagagggatagcattaggagatatacctaatgttaaatgacgagttaatgggtgcagcacaccaacatggcacatgtatacatatgtaacaaacctgcacgttgtgcacatgtaccctaaaacttaaagtataaaaaaaaaatagagcacacatgtcattaatgaccattaattatagcaacacccagaggacagcagtactgtatcattttgcaggtaagaaaactgaggcttagagggtgtttatgagcacaggggaagatacacttcacctttctcttgaagttattatgttgccatgacttgctttggctaatgaaatgtaaatgacagaggaatgtgttgcttcttggtgaaaatcttcaagtcatcttctcttcactgtgccacaatgaattatgtttcagaaggcggattgtccaggatcctgtatcctgaattaaggacaatgtagagtagacgatgggcatgcagcatgagtaagaaatagatctttattattttaggtcactgcaatgtttacagttgtccattacagcaggataacatagcttattctaactttccaaagatgagaaactattaagatctagcattcaaactcaggtcttatggtattaaggccaatgcttttgtactaccttacagtacactgcttattagaaataaaacaccctgtgaatgtaccttccacttcgaagaaaatggacttttctgttgctctttgacttaaaaaaaattaaaaattctctgagcaaaggtcaatggaaaggtagcgaaaaagttggtagaggtgggcagataataaaactgatgagaaagatccattagtttagcagaaccctttatttcccataggttcatgacctgaagattacataggatggagggaggcccttatcataagcctgcaattctgtggctaacaaaatcaatttttaaatgatttatgtgatgtttttcaggaccaaaagagcagtaattcatttcccatgtggtacttggagctgctgcttagatgttgaaaaatgattaatctttatttacagcatggctcccttcatatattactggaaacaagatttgagagtgcaacacttctatagcatgcaattatttgctgaaggaagttccaggcataaagaaaaaaaaaatctactagcagccaaggatatctggacatgcactgaagtaaccactgtgaaaaccttccaaggccaaatgcttccaatctattcagtttgacccacttaacataaaaaagccacattaatttcccaaggggagccactcttctatcaaatcatactaactcctaacttcaacaatgggagaatgaagaattcagaattcttaggtttttgttcccccagaagactgagtttaaaaattttctagaaattggtgcacatagcttacttcaacttaagttgaaatatgtgtgcatttttaaaaattgctataaggatgccttttctgggccaccatatgtagacattcctttcttttaaaactacagaagtaccatattctcaggtctcctattctccatcttgccagcctgagcctaacaggtccaatcacatctaaggaacagtttcacctagggtaaagttcacatttttatgactagctatatcactctgaagcccctagtttagggcccacaataatttgataaggacaggtaaatttccatgtcccttgcatcttgtgatcattaaggttggggtaaagaccttggatatcaaggagatagagtagagactattcttagaccattggaatgagctctgcccattgcttctggacactagaatgttagagggctgtggagaatgatgcgtaatgatgcctgctgttttctctcctatcattttctaggacagattttcccaaggaaacagttaagagagccagactagtcagttacgcactccatactggagaccactcatatgcacattgtgtacctcatccttctccatggatcattgctcactttctctttattgggctaatggtattggttaaactgtaggctgatgactatggaccactattttctgtatcattaaacatggccatatcccttcaagtgggttgtgaataaaattggcactctgcttccaccccaagttggattatttaacaggcatgactggcttattaggaaatagcttgaactggtatgactgaggatgaaacatcttgtcaatacaggttatttgttaggtcccatagaactggatgtacaggtaaatgagggggtgagggctttccctcctgtttgtagtttgtatgtggggttcatcagcaaacttatgaagcccagtttattaagtttcttgggcaaaagagtaggcaaagctgttctaaatagagtaggaataaaagagggctggtaccacaataatggtgaggcaatttcattaactagagtataaacaagaaaacaaagtaacaaggagtttgttgatgtattagcaggatcctggatctttacttgcctgagttatctggatgagtcttttgtctctgggtaacttcagtcataacccttatcatttataagtaacacagggacctgtgctgggaaaatatggaccaatatcctagaaagttagtaacatatacttagtgagtaagcttgtaacacatacgagtgaccaatgttttcattaatattttcctgtcatgccaccattctgtgtactatgcttttcttcttgagtcctgtagttgcctctaagaatgacagtcctgggaaagatgctaattactcaacagagtatttaattgcttgtttgcctcaactcagttgtaagctttgtgaaagcaggaaatatgtgtattgactgtctatcccagcaataattgccatgcctggtatgcagtaactatttgtggaatgaatgaatgaatgggaaaaaattatagattctgtcatttattaatcccctactacagagtatgacaggttgagtgttgtgctacgtgtttcactaaccgtatttttgaatcctcataattctacaaggtagatattattttcctgatattataggagaataaagagcttcagtgagtttcaggtgtgcatcgagcacacaaggaactgttttgcagagagtcccttctctgtgacagtcagggcccctcccacatatttccttgagtagctccctcactgggtatgcaggatgacatgagggagatttgctgacagccacccttttctgttgagcacttatctctcggacagtgggatgagaagaagaaggaaaacacaattgttgaattacgatgggcattttacacattttatcacatttaatcctgaaaagaaatctctcatgctgacacaattcttttaataaaatgagtaatcaaaagttaggagatataaagtgactttctccacagtgaagagccagaattccaattccactccattgtgtgtgtgtttgtgtgtttctttcccctccagtgtcctttgagtgtagtaccattaaaaacttagaatgcttgataatggcagggaccaggtgattcctggtccctacaccatactcactaaagtgaaattcctgaaaatggctctaggaatctccattttcaacaattcactaagtgggtctaatgcaaagtaaagtttgagaaacattgaactaggtagagttgcctctaacatttttcatgcacttggataatactaggagccagaaggtctacaaatggaagaaatcaccctgtaccaagcactggtggtgcatttgcagctcaggatatggggaatgccttggtaccccccattaatgttaataggaatcatgtggataattctctatattccacgctgaaaagtgttccctttaggaccaggagaggctatatttaatcaaaccatctgaaatcctatgtacgtgtataagggcagaaaataggtcacagttggtaggctactttctgggaattattccattgtatcagcaaactccaaagtcctcaaagggctcctgctctcctggctctcagtgagtgacagcccaagaactaagagaggtcagagaaagtccaacacttaaggaaaaaaagttccaatcacaataaaacacataaaacaaattatccccaaaggacaaagtgtggaataaacttgttaaaagctattaacctctcaaaataacacatttctactccagagtaacctcagttgcagcttggagagcagcatgaaattaaggaacacaattcagagaacataaggactccaaatatgaactcatgatgtccaagggttttacaggcactcatgctcctatgaaaaccacgaagatgatgggtctatgagacctgagagagtcagataatctggtgttaaaaagtagtgagtgttcataaggcttccagaactcaactctattatagactaagaactttacttcgtcaatcaatccaggtttttgtctttattatagaaattataggactgttagcttattttaactttataataacatagcttattctaactttccaaagatgaacaactattaagatctagcattcaaactcaggtcttatggtattaaggccaatgcttttgtactatcttacagtacactgcttattagaaataaaacaccgtgtgaatgtaccttccacttcgaagaaaatggatttttctgttgctctttgacttagaaaaaaattaaaaattctctgagcaaaggtcaatggaaaggtagcgaaaaagttagtagaggtgggcagacaataaaactgatcagaaagatccattagtttagcagaaccctttatttcccataggttcatgacctgaagattacataggatggaacattacatgatgaatcttaaagcaagaagaggatatatttgggttaatctggatttgaaccttggtcacgtcttggaggaggaagccactgattgtaagggagcatgaagtgaccacacagaggtggtcactgtgctcagcagcatttcaccttgttactccccaccgctgtgttgcctttctcatggatcactgtgactgttgctgttttttttttctattttattattattatactttaagttttagggtacacgtgcacaatgtgcaggttagttacatatgtatatagcacaaagtaagcagagatatagaaaggtggagaactaaagtcttcaagggcatatggcatgcagggtgaatggcatattttacactatttgctttttggtatgtctgagatcctgatagctccttaattaagataatcaaaatccctagtctagagtgggcaactgtacaaaattcttacaataaatggtcagtaggtcttcaagctagctctcatgtaagctatgctatccctgaggcataaggaagggcataaagccccagaatgactaccactgtgtctatgagacaattcaaaagtccagttttttatgccaggatactttcaatttctccatcataggatcagggaccttccagccctagcttcagatccacagtggtgccagaagcactaccaaggaggatggtgtaggaaggtatattccttttctaatgctgctgtaacaaattttcacaattggtgcaaaacaatgcaaatttatcatcttctagtttgtatgtcagaagtctgacacaggtcttactaggctaacattgaggtgccagcagggctgtgttccttttcggacaatctagaggagaatctgtttccttgccttttccaccttctacagatcacctgcattccctggcctttggccctttcctctatcttcacagtcagcaacattgcatctctctgactgtccttccatagttgcatttccctctgactctacccaggaaaagcattctgcttttaaggacccatgtgattagattggaaccactgaaaaatccagaacaatctcctcatctcaaggacttaatcacaccttaaaagtccccttcgccaagtcaggtgacagatacacaggttctgggaattagaacatggacatcttgggtgggagcattacattattccacttaccacaggtggtaagaggtggtgaggagggaggtttccagagactgaaaagatctaagataagaagctggcagcaggagggagtgaggcttcaggctagagctgtctttccaggacccttgagggagttccggctggttttcctaacgccctctttcattttatcaccttcactgccaccatcgtcatcctggcctatgccctctctcctgaggtataccctaatcttcctcactggtccactgtggtctcatgtactaaactgcttctcctcaggctattttccacacagtagccagagttatccttaaaaacacaatcacagtatgccactcccgtattcaaaactctctaatggctttctgtcacttagaacaagacccccaagcccccctcatatggctgacagagcgtgacatgatctggctcactactcctctctcacgtcccctcccactcctctcccacctcccctcccactcctctcccaggtgttatcaggctccagccacatggcccccttgctgtttctcaaactctccaaaccagcttgtgtctcggctcctgtttctccctctgcatggaagggttgaccccggatctttgcatggttaatttcttcccttcttttcaggcccagatgaaataccacctcctcagagaatttctctgaccacgctcactaaaataccaaccctttctttcactctctaccccctcactgaacctatttttcacagtccttaccacgacctgacattacattatacattgatttgtttgcctattttccacgttgattatttgtctctgccactagaatgcagaagaaaaagtttctttagggcaaggaactccctgggagccaagaacagtgacttgcacattggaggtattcaaataactgttgaatgaataaattcaatgtatatttgatgagcccttttaagtgaaagacaccgtgatataaacagtgaaaagacagacatggtctacccttctttccccagtgtcccacggattgactcattttctttccggagtcaacttttactgatgaccaaagtttatttttattattttatttatttatttttttttagagtcagggtctcactctgttgcccgggctggaatgcagtggaaccgtcatagctcactgcagcctcgatgtcttgggctcaagcaatcctcccaccttagcctgctgagtagctgggactacaggcatgtaccaccatgcctggctatttttttggtattatttatagagatggggtctcactgtattgccctggctggcccggaacgcctggtcgcaaatgctcctcccacctcagcctcccaaagtgctgagattacaacatgagccactgcacctggccaaaacttattttttaattcccaattccatctcatgtctctcctttgttcttattcatttattcattaatccattcaacacatgcttattgagaacttaagctaggtccataatagatcgcagtccctaaaacaagaacatgatcagtttgggagggttcttttcctgatggccattatgtgaagggagataaggagggagaaaggttctacccacactcccactactctctccctcctaccctacagacctcctcttttttccatctgaattcatttgcagacaaggatgaaagccccttagagtaataacagaagctccttaggtaaacaaaatatttcagtaatctaggagtccatagggggctaacactgcagagcctgtgctctgaggactgggtcaggtccctgcacctgtgcagagcctgccttatctgttgagaagctcgcatgagctcaccactaaccaagtcacaacaagcacacagttcgagttcccaggcaggctgagctggcagtgcatcaggcaatgcccttttaacatttttcacttcttgttcaccgctgttcttgcaattctatgttttacttaaagaagatatgctaaataaatggttctaaattagcctgagctaatttcagccttgagctcactctgctgccacagactctggcaagtacgatttggagcactgacacatggcctgtgtacatgacaagatgtcttatgcaaagttagtttgggctatatgtagggacatgcacacactccaaatattcttttgttttgtttttgagatggagtctcactctgtcacccaggctggagtgcattggcaggatctaggctcactgcaacctccacctcccaggttcaagtgattctcctgcctcagcctcctgagtagctgggattacaggcgcgcgccaccaagtccggctaatttttggatttttagtagagacggggtttcaccatgttggtcaggctggtctcgaactcctgacctcatgatccgcctgtcttggcctcccaaagtgctgggattacaggcatgaaccaccatgcctggccctccaaatactcttttttttttttgtatttttagtagagacggggtttcttcatgttggtcaggctggtctccaactcctgaccttaggtgatccacccgcctcggcttcccaaagcgctgggattacaggcactagccaccatgcccagccccaaatactcttaataaactttaataaactaagaagtctaagatgaagcttcctacgaatggatgagtcaagaaaaagctacacaaagttcacatatcctagtgctgctcattaatttgggagaaaaaagcttgatgtgaggagcttgatttgaaggacaaccagtatggaaagccccaaggtactttataggatgtccaagattagatgctatttattaggtataatagggcttttttaaaacaaactcatacctctccacgttttaaaagtgtggcccattaatcagcaattaactaaaataaggttgttaaatgacactacagtaattctaggtcagtctgattttatcctctttctggcttaatgcctcagatagagtgaaactcccgataaggcactcactaaggggcacttgcacaataaagaggagaagcaggaacgaggaaaacatagttaatatgccaagtcctttttttttttttttttccattttagttgagatgtgctgtcagcctctctcttgaccagggagaggtgcttctacttcaccagggggctctgtcccccaaggctgcggcatgtcggtgtttatgcaagggactgtgcccctctctccacagccccagctgcagcctgtctgtcgccttataaaaaaggcatcgagcactgcttttagatcatttcatcatatttgctcatttccttggctgaagagtctggagtcagagggccctcagaagatgtggaacagcccttgtggatggaatagactgggcactgttgctttctagctgtttgttctccatgatcacatttgcatactagatttctaccaaggaaacctgggtacagcatcttatcatatttgtagccccacataaatgtattgagtaatccgaacttgcttattttgtaaataaacacataatttctgggattaaaaataatctaataacagcaaaactaggctgtccagccccacactgaagggcaatggaagttgtgctctaaaattttccagcagtatcagatgaaaagccatggaatggggctgtctctggaaaatgagcatgccagagaaaccgtttaacgcttgtgtgtaggatggggatctgcctgtgtacacttatgcaactcttttgatcatttgctctaaatgctcattaacagacattttgcaaaagatcagatgatgatacaagcatatcaacaggcttccgtttttactgtagggaacccagaaatgaggattgttgttattttctttagaaaattcatttaactgctgatagtaaatcaaaattctacattgccacttctgtaaatataagtgacaagaagttatatatctcccctagagaaagaacagtaaacatttctaaaatttccaagtgctcctacatataatctggttgttacaagtggaggcggcttgtcagaaggtctctctctgtaaatggataaggattgaagctgtgtcgtgtatcactcatgttgtttatcctttatattaaatggaagctatatatagatacaaaattataatggcacagactgcccatttcctaccagcagtaggttgactaggaaaatataagtaatttactgcaaaagtgcatcaaagttgaagcatttttagctaaaatgcaaagctaatcaaattagtattaaaacaattgacaaatggttaaattttcctattcaatttgaagtgaatagaattgtatgctcacattttataattgagttgaagctgttgtattgcagtttttattattatggaacaagcaacagaagtatagacagatgactgagtaatctgtatatacctttgcaggtaagtaactaattatgaccatgaggcacctacaggacagagaggccataagactcaaatttttgttattatctgaccaaaggagagaacttatgttcttaacttatccttaacttatgttaaggatccaaagagttagctgttaactacaagtgtcacttgaaccttaaatgagtatattacttttttcaaacaaactgctctacctatgaagaacaactctgaggtttatctccaaaagcaaagagcaacatattgtgtggtccttagggtagagcctgcgctcatcacattagcaggttgtccgggaggaacgctgggttgaaagctgaaagggctgggtctgatgatgtttttttctttacgtgggttttacatgagcttgagtaacccacaggcctctctgtagtctgagtttccctggctttaaaatgaaggtcatttaaaaatgatcctcgtcctgtctacctggcagagctgttgtgaacatcacatgggataattatgtgaaaggtgctttgtaaactgaaaaatactataatgaggcagggcacaaggcagcactgactcttgaggctgaatgctctgctggaggtcaggctggatggatgttgttggtgaagtggggcatggtggtttcctattccaggcttgagggctgactctcctgcaagtgggacccccgtacccacagacttcacttagtctccttgaaggattcatttgccacagctcctgagtactccatcagtagagttgactaaacaccaaagatgtttatattctaactttcaaaaagtggtatgcagctacttgtaaaaatgaaacatgtgaaatctacttgtctatctaaattttgccagtttgattggcatatttggcaagcttttgagaagactgggaaattgggcaatcatttgggaaaactggaatttgagatctaatgatcagctgctttgccttcttctttcccctgttacaaagccagggcaagaagacaagacagaggaccttctgatgtgctgcctgatctccactggcttcttttggtgaccacatgttccttaactgagtgtctttataagggaggtattgttgaagtatgtggtgacggactgagaaaacaagcagtgagattgttagcattcatatctcacaggcttaatgagaacaacaagcaagccccaaagggtgttaaatagatttggtatattttcctcatttcagagaatgtctattcctaatgcattattctctagccaacagaagaaaagtgcccagcttattccttcttcatggaaactacaggtttaaaggacagagactctcatctatcaaagcaactgagtgacttctacttaaatcaaggccagcaaagtagatgatagaaatattaagggaggttgcagtcaagggcagtactcttctttccttgacttatttggtgtgtttatggtttcaggaaactatcacctctttaatctttcaaaatacatttttaaagaggccattctttttattggacatttttattttaggttgcaagaattctttatttctctgcttttaaaaatctatacttgacattatccatggccaaaatgatttacatttgttgtggacgctgacaaggcccaacttacattctatgagaattttgtggaaaaaacttcaccttttgtgatggttcaacttagaaaggcttgagtcgaatgaccaaggttagaaagtctaaacagaaggacaatgagattctatgtatcagcctaaagatattcatctgaaaaatatgccatatgtaaattaaaaacaatgatggaatcctgctgcatgaatatcacagttcaaggtgcaagaatagaggaagagaaagttactataataaaaaccataatatatggtttatacttataataacacatatttacatggtatggttataacacttgctttgtcagtttgtcactctgacaagttacttgccctctctatgcctgttttttttttatttttaaaacagagatagtgctgggcacggtagctcacgcctataatcccagcactttgggaggccaaggcgggcgatcacttgaggccaggagtttgagaccagcctggccaacctggtgaaaaaccgtctccactaaaaacacaaaaattagccaggcgtggtggtgggtgcctgtaatcccagctattcaggaggctgaggcaggagaatcacttgaacctcggaggcagaggttgcagtgagctgagatacgaccactgccctccagcctgggcaacagagtgagactctgtctcaagaaaaaaaaccaaaacagataataataaaataatagcaaaagtagctaccttataaggttttcataaaaattaggtggaataatcactgcaaagaccttagcccagcatctgaaatgtcataaacagtcaacaaataatggctgtaataaaatcaataatacttatcatttgactacataaataaaccaaaaactaggaacaaaagcaatatacgtacatataaacatatgtataaatatatatatatgtgtgtatatatatatatatatatatatatatatatatatatttgtaacatatggttgcttactatgtgcagggcactgtcctaaggatataaaagctttacatctaaaatgtatttaattttaacaccaacatcataacataaatatgttgttatccccattttacatacagagaaaccaaggcaaagtaacttatgtaagtctacatgatagaactaggatttgaccaggttatctgtaggtatctcagtatttcctgaagtgactgaataatttttttgtttttataaccttgtttatcacatcactggtttttacacttttaatatacaatggttatttttgtagacattaactctataatttatttacctgtatctctaaaaaagggcatcacaggctgggtgcaggggctcacacctgtaatcccagcactttgggaggccgaggcgtgtggatcatgaggtcaagagatagagaccatcctggccaacatggtggaaccccatctctactaaaaatacaaaaattagctgggcatggtggtgcgcacctgtaatcccagctacttgggaggctgaggaggaagaattgcttgaacctgggaagcggaggtggcagtgagccaagatcgcgccactgcactccagcctggcgacagagcgagactctgtctcaaacaaaacaaaacaaaacaaaacaaaacaaaacaaaaagaaagaaaagccatcacaaaatgataaggggagagtagagtaactttgcatattattcattcacatgtgcaaataaaaggatctaatgccaaatgtgggcaaagcgacatacctcagtgtgagagagtaagtgctggaggctaagggcattgtggtctctccttcattttctcttatgaggcacactgatggggtacgtggacttaggacaagatggcacttcatctcgcttttctttctgcataccttgctcttagtcttctactaatgccacaatgaaaaaaacagaaacccccacttgacatctaaactctttaaaaacatgtaaaatttaaatcagtattatttattaaaaggttttttttaaattattatttggtaatgatttaccctaaaattttttgacttctcttcaaagcccagatgcttaaatattgcttactttgggtcttaatggttattccagagccatggaattttaaatttgatctcagatttttaagatgtgacagcttgattattttacaaggccaaaaccctgattcaagcctgcaattttaagaatcaaaactgttttcccattgatgaagacattttgaaatgtgtggtccatagctatttatgagtagtttacagctgttgtctctttgtgcccaagaccatggagaatccaggagccgatctgatcctcctgggactgctattaatatcactttcactttagacagctttgccttcaactagcaattttctggctcccttatactacattgtagcctcacagcattcaagcaggcacagggcacttggacaatttagcaataatctataatacagatttttgaaagaagcgatttgttcaaatgctgctaaaacagaaagtggctcttgaataccaaagtgggtgccagaaactgagaaaaaattccttaaactaggatctttagtataaggagaagtgattagaataatatcaatttggggcactgtgacatctgaaacataatggaacaattcctaattgttattgaggaagaaagcaagacctattaaggcaaaccaaccaactttcattgcacagggacataatttcggagatgctatatttgattccatgtttgatagggtctggcatatctcttcccaagtgtgctctggaaatcctatttcagtccttcttttaggggaagaagtcattacatcagccttgtaaagtacactggcatgcaaagtaaaatctgttactagggtgaaaagttggtacattctgtttttttgaggggaggtgagctctcacgtgcccccaacatgcacagttcactaaaaatctgtagctcaccaatctcctattgtatgcatttgttatttagtcttcagctctcctacattttctttgtttctttatctattaaacttttaaaaattgttccctgcctcttttccattctgattttaaaaattctgattaatatacaattgcatctgtattggcagaccatgtagatacagcatttgtaaattgcaagctatggagtacactgaataccatattaaggagttagtgaaaatgaaaagaactttaaaccctagccttttagatagatttctgcttttaaagattatctctggattgcaaaaacagacatgaatattgatagtgtaaacctgactaaaatatgactctaaaatatgaatgtctgccattataaaagaatctaatgataaaacctgaggaaataaacactaaaaaaaaaaaaaaaaaaaaaaggttgttttctcttccttaaaagtcctgaaatttaattttaccattctgtcacaggataaaacatctgtcctaatggaaaagtaacaaaaacccattttctgaaaagccccacagataatttttcacatgagtacatggaaatatctattccatttttggataactattctttcttgatgtaaaacactggtggtcaaaatatacaaatatcacatttgccttcaatcataaaactctgataagcacacaaattgcaataccatcatgctaaattaactaattcatttattaatcattttctttgaaagcagagtgacattcaggcactgggaatgctgaaataaaagattgaatccctgccttctggggtcttacacttcagcaaagaggtcacacatcaataattaatatatgatgtcacagatataaatacagaaatgaagtaaaaagagacaatgaatccagaccaaaagtttcaagaaaggctcctaagaagaggtgacatctgaatggagtctttgaagaccctgtaacaatagccaggcaaaggtgctctaggcaggaagaatgttttgtgcaaaagcagaggtgggtaaaacatgacttcagttctctcaaatagaattaatcaatctctttatacagtaactcagcacgttgtctgtacttctgttagcatgaatagaatgaatttttattgcttatctttcctggtggactgtagcctactagaagcaggctgatacatctttgtacctcccatttgtcttgcacttataacttgcctgcttagttttgatggaatgagccaatgaatgacagtaagatttcacaagagtcacctgtgaaacatacttcaccaaagcacccatggtagcacttattaacaaacggagtttaccagggatggggcagaagaaagtcttagcttttcaaagaatttcattcctgagacatttttgtggtcatgtatttaaaaaaaaagggttgggggggtgctctgagaaatgtgctctcagatggcacagctggaatgagagaaatgggaactgttttccattttacatagtttctggaaagggcaataagaacaaaaaaagcaacactgttggtcagcattctcagtgcctgagttgaaaggtgctataaacagagaaaagtctcataggccaactctatgcaggctatgtgccaagaatagctacaaagtggcaagttaaatcagccagggcttgtgagctgtctcaggacttgagtcccaacttgcactcgtgaaagttatgctgcaaagggagctacctttccccagcactgcctggggccttggcaagtctaatggagaatgagtttgatttcaagccctgctcccttcaggcaacttacaaagaaaagctgttaagtctgtggagctgggaatgtctggaaagagtgaagacccatcatttaaaactgatttctttttaaggaagtagagcagagagcagtgattacttcaacacccattctcaggggaatttctgtaagccggaatcagctaatgatggttaataaaggtaaatgttccctgattctcaggaagtgattcttcatcctggggctttttgaagactctgtcttcacttgaattttgggtggaataaagccctcctggatttatcctaatctaatactcaaagttggtagttcacaggagtctgtttattcttctagaaaagtataacagtggattagctactggcttctatcccttcagcacagctcccccacacaagagcgtacctttaatgactgatgctggtgtatcaaattgtgtcctctccttctaataacaaaataatgaaatacagtaaaatgccactttttctgactttttttttcttctaggacatgtatgtttcttacctcattcagaggcatgctgggaaatttaactaaatctgaaagaaaaacattctgtaaatccttaagactggattagtaataaggagtaatttctgatctggaataaaatccagaattcagcttgctcaccccagacacaaaacacaataaaaagaatggttgttacagttactaaacgaaggatcttttcacactcagcaagggtaaagactgtctcttctgtatctctgtattacccaagacattgagcatccatcttactgatacaaaggatgtctagtttgaaagtttgcctatgtacatttgtttacgcactcaggcatatacagactgccaactttattattacccaagattaaaaataaaaaatagaccttgctctcaagagatttcctttccgttaactgcaatgctaagtgagatgcatcagtttcatttttgcacgctcctttgctccgtttagtaccgaaataaaaacatgacgtagcttttggggccggggaggaatctcattcttgcaggaaataattgccaggaattttaaagagtgtcatcattttctctgtgtccagtcctgcccagtaacagagaacagctattaaaagtatccaaatgctggctgcaaggagaagttgaactctgaaccactataaacccaatcagatgcagacattcttcccatcccataccccggactcccagtgaatcttgaagaccctggggttagccttatcatttattcgtctgtatagtgatggcctgtgctaatgcccaaatgatcctgacttattaaaggttcttcctgaaaagacatgatttttattagttcaccacaacttattctcaaaaaagcatttattctttatcaagccacaaattttacttaattaactattctactagattccaagacgatttagaagctattgaggttgtaacaggataagagaacaactagtccactctgttaaaataaaataaaatccaaaaacattaaatgttttcctttttgttctctaatgagaggtagaggatgtgaaagtgaagatacagtaaggctagtgtttccaatgatttcatgacttctcttccagctatgctggtgtcatagtaagagcctgatgctattattatctctgattatttgataaacctgaaaaacaagttcaacaaatggtaaaacatctggatctttgacagacaatggcttataaaagagaataacgaacagttatttggagagtattaagacccagatggttcatcagggatcactttaaaggtgtttgttagatcctccctctcaaagacacctacacaagagtcatcagctgccaatagcactgagaagattttcacatacccagcactgtttttgtgacaaccctttccaaaattacgaaagaaaacaaaaacaaaggcaaagcacaaagaggaaaaatgaacattgcttaattttttcttgcacccagtgcttgaaacgcatcaaagtcagagctccatgctctttatctcagctcactgcagctgtcctttctgccaaaagcaaaacaactcattctctagaagaatctgaatgcccactatatccttgacagcgttcctaacaatagacgccgaagatagaacacggttagactttcattgacaagaaaggctggagaatagagaattgtgatcaggcagaagaaaaataaaaactggaacagtcagtggtctggcatatctactaccccccaccttttatttttctgaaaagcaaagctgtattttggcagagtccagaaaaactaggcttgtaattgttaatgtagttctagtggtttaggagaagcagtgggcttggccgtattatggaatgactctgcaaatatagctcagaccctaaggaggttaatttaaaaaacctatttcttatctgtataaagtcttgcacacgaattacattgtttccattttctccaaaagtgtgctttctctctctctagatatctgtatctatagatatagctatctataccaatatatctctataagttgtttatatctatatgccaatatctataacatatttctctctatatataaatatatagagacatctctgatctcgctatatatttagagaaatgttatagatattgacatatatatagatctctctatataaatatatatagatatatacatatatttatgtatgatatatgatatatacatacacatatatttatatagagagatctatatatctatatatctatatataaatgtatatctatagatatatatctatagatatgtatgtatacatacatatctagccaacaatatatatagacaacaatatctataacatctctatttatatatatgttgttatatatattgttatatatctatatatagatattttgttattacattatatatataaattaaattgaaagcttttggggaaaaacatatataaatataaatataaatatatatatacacacacacaatttctcattttttgttgcttggtcttattctaaattcctaagtgtagtctgccactctaatctcttttcccatgaagtttgtcttagaaatgtcatccgtgcaaacaacggctcaccaaggacaagtgctggtttatgcaattgagcagtagaggatgctgtatccacttcttcaagaggtaaaaggagctgatttctgcactcccagggatgagcaagcttcatattcatctgatggttatctgagcaggcactctcatgcattttgatactctagttttataaccagagaatgtcagagtcaataacatgattataagccttataagtcatagaatacagcctctcacacaatcatctttgaaaaatggtcagctggactccaggaacagagagatggcagcattgcttccttcaagagacatttattaagcttctggtagcaactctgtgaattgggtattattgtcctcattttacagatgaggaaatagaaacctgagaagatcgcagttagagacagacaaagtgggatttttaacctagggctgattccaaagcctttattttttgatcactacaatatacatctgacagacgttctctttaaccctttcaagactataagataagggttctttgtaaggacagacccatgctttcagtagtaaacactgtgtaaaagacaagagcatcataaactatggggctgatttaggcagccaatttctagtgttttctttttttgttgtttgtctggttctttcacattctctctctctttctcccatagtatagcaacaattggtctaaatattaagctttatctatgtcaccccacaaatgctgagtgtgattcatccaagtctataacaatggtagagtggcccattaccacagacagacaagaagaagatagcagtgtttacacatgagataatttggcttttctgctaagccttgtgtgccaagttaattactctcttggtgaaacaaggtattttgctcatataaggtagggaaacttgcagtgcttttggttttgttcatttctcttcactagtcattcataatgtggtttttaacaacaaaataattagttaactgagatagaaatgaaaatcacactggtccctgtgcataaaaaatatatattatagatagaactttgtgcttgccatttctttctttcatgttgtttaataacagagtattttgcctgaagttccttatatgatcttctgattagagaataactgccaaaatgatgtttgaaatgcaagtagtatggcagaaaactcttaagaggaaaatgttaggaccagggcaagtgctccctaggagccagagttcagaactctgggctggttctctgtgctagttactgctcagtacccagtgcctagaatagtgtctagtacacgacagacagtagtagctaatagatgtctgtccagtcaatgaatataattccctactctggtgcctgctgcagcttccagaggtggactctttcattcaaactatttttactccattttatcttcaagagaagaggcttcactatagggataaccccaggttcacaggaaggcatcttctgttcagctgttccttattcaagcttccatactgtcatctatacaacaaatcagaccaggatatgaaagacagagggcacctcctctaggttgccattgccttaagaccatttattttgagaggtaaccatgcttgagacatgcttatgttaagactactacatgaattttatttaaaatgcaatccctgattgtagaagacagttttgtgaccagtgaactccgtggatcagcctttgatggacaaagagaaaagacttggcttcaccttaacgactggtctgtaagataggaagtttaagttctaaggcaactggactaaaggccagcttaagaaacaaagcaaaccccttacactggtgtttctgttccactgatgactttctccatggtccggagctgatggacagctatattcacacacactcttcacaaccattctgaaagtaattttcagctgcaaccaaacaaccagggacctactgtgtgacacatggagcaattgataataccagtgctctatggatcatgttgtcttatacatcacatgtgcttgattggtctgatcaaagttatgattgaaccagctctgcacctgtattcgtccttgcacgttcaagtgaaagatgatgcaaccacgacaggctggaatcaggcctttgggccatctgagtgcaatttgagacatggagttaggctttaagaatgactttgagggttctcaagtaatatccaccctctttcacaggagtaacaggtcacctacctcccatgaaaggaatttaaaacaatttggaactcagtaagcaatgttacactcagcttgtctgtctggcagagaacactaaaaaaatatgtaagactcatcatgttaccagtctgtcagtaaatatttaccaccttgagacaaaagtataatattcagcatttgatgtctaaattagtagaaaagacaaacacaaatataataattagagaacaatacaagcaagtttaggtgtagaattcagtggctggttgagatgtcagtgaatcaacagcttagaaaacagctgtgtttccaaaatatgttggcagcagtctatacgtgttctcagtgatgtaataggagtcaggcactcacagaagctgacattatccataatgaccctgaatcatagacttcagcatgcaaactcatgatgttctattgttccaataagaataatatctgggatgccagacatacacctgcccaaagctccctgcagaaggcaatccaattcctcattctttcagcggacttggcagaggaatgatgtgtgtgtgtgtgtgtgtgtgtgtgtgtgtgtgtgtgcatgcagggacaagggggcatcttagctcaagcttaccatactgggaggacagggccatgaaggctggagtgaggaacaggggaggatgagggatagggactcagggatgggaaactggcatggggctctgcaagcagtgataatgaagagacatcctggtcctagagggcagagaggaagcgtgggaactgaaggcatttttccctttgctctgctgcttgtcactcacaacaccctgcctcaccaaaccccagctctgatcagggctcctgcagggattctggaaagaggaagaacacgcacgttatgagactttgatgggtattgtcctgaagcaaccaggaaaataaaaagaagtaaattttagtgtgaaagcagctcctggtcctttggcttggaaaccacttctgctttccccttctgctgtcctgatcctcactgcttccctgcagactctgcaaaccttgcatactgcttcaggcaagagggtctgttctggtaatacaagtgccttggggtttgcattcatgatagtgttttcatgaattttcatctaaaaacaaataatagaccccctcaagaattgttcctaggatttcacacatatgacctgaaactttaaaatcaacttttcacctgctgtttttatttagcagaatcacattttaggaaagctaatcatttgctatttaaaaatctgaaatagagataaggttttacaataggcttcagagggaatacttgctcaactaaaggaaaagagaaatggcaggagttccaccagggatgatctggcttcagtgcaacctcatcagtgtgagatattcttgctggtcatggcttggctaatattctccccagcccctactcctctcccctccacttctacctcagctgaaacacccaagttgaggaaaacttcacagggagaataacccctgtgttgtgctgcagccagttcatcctgggagtcagttatgtatacctctccccagttctgtgtttagtgacttcatgttggtggctagaaatcatccgcatagtatttacatcatgggtataggcaagtgctacaaatcaggacttttccttggggatggatgtttggagctagtttaccagcacaccagtgggtaaaagtgaacaaatacttttttgatcccacagaatcttaaaaaatactttacttcgaaaatgtctctactaagtaatcatatatatatatatatatgtatatatatgatttttttttttttttggtagagatgggatctcataatgttgcctgggctggtctcaatctcctagcctcaagtgatcctcccaacttggcctcccaaaatgtcagtatgttgggattaggcgtgagccactgggccaaaatgaccatatcttttgactggacaatattatcctatgttctataaaccatattagtttcagaactaaatgtaatgctaaaatacgatgactgattcttttttttttcagtcaaatgtattataaaacttttacgcaatatcattttccccctttggggaaagtagagggatataagctacaaaagaataaaaaagtaggtagattaaccaaatcctgttttttttaaaaaataagttactttgacagagtctgctgaaaaatattgttaaactatttgtaataatatttctggtctggttagaaaatttattagtttatagtacaatgcaaagggaaaaaatccaacttctctattcaggttacaaatgtgatttcacatttgggagttgtgagagaaacgaaaagaaaccttaacaactttcttgccagattgctttgaatccctaaatgccttattttgtagccagccattggaattgagctactgtctccagacaatcccattaaatatatattggttccctagaaaggtaacaaaaaaaagttattaaaaaaagaggaaacagcccagtgcagtggctcatggctgtaatcccaacactttgggaggctgaggcgggcagatcacttgaggtcaggagttggagaccagcctggccaacatggtgaaaccctgtctctactaaaattataaaaattagaggggcttggtggtgcttggtggtgcatgcctgtaatcccagctactcaggaggggaggaagggagaattgcttgaacttaggaggtggaggttgcagtgagccgagatcgtgccactgcattccagcttaggcgacagagcgagactcagtctcaaaaattaaattaaattaaattaaattaaattaaaaaataaggaggaaaaaatgatgagattagcagacaggaatgggagatgaggaagtagattagaagacaaacatattttttaggtagttggtgctaggagaagtcttgagcaagtgtttcattggataattaaaaggcctgtaatagtgaacttaaaatgacataagtcaatttggcagggaaaggaaggaggaggagtttttgcttattatttagtctcaggttggactgccacctaaactgttggttccattaagtcaaggagaccccatatcctcttcattactgtgccttgcaaggtgcctggatgaaatgaaagtgaaagaatgggaaacgcagtacgaaaggcaaataactgcagctgaaaaaaaaaaaaggtttctttgtttctttgtttttatcttggtttagtagtttcaggcaaattctgtatcttctagttgacccatatatagcactgattctcacaaagttcggagatagcattagattttaaacttcattttctttgcacaacaatttattcatccccttctatagaatatatgcttctagagaagcaggtgcattgtctcaaagaaaaagacggcagcagagtctgggccagatttaccataatgtgcgtcctgggagatcttgctgctgtcacatttgcctggttaactatccataagtccatgttaaatactcaaaaagagaattacagtgaagaaaaatggatattttaaaaacagtggtatctttttttggatccagaaaacaaaaagtattttatttgccagaggtaattttatgtgttagtcaacaggatttgaaggatcctaaaatacccattactacagctataataatgagtaataacaactttcttctctttatttcttagatgtttggaagtcctatatgcatatcccatatggatatttcagtctatataggtatatccctgtcttcccttttgatacataccagttaaaaaactgaacagaaagtttcaagcaaattggttaaactctaatggattcctctggcaactttgatgaaaaggtttatgcctatgacagaaaagtcccatcagtgggcaaactttctagacataaaaattcaatgtaatctacagcaggtaaattttatgtcaattgaacatcaggattggaatttctggtaggtgtctagtgatcatagtacaaactatagttttatttataagggaactggatgtaggcgacttctttcagtcttcttatcacaatctttctaagaagacccttcttttcagtcatgaagaagctttgtgctgttgattattaggagtattttctcaaacaaactttccagtctaaaatgtcaagccacagatgaatattgagaaggcttgtccaaagtgttcaatcagtgattttgagtttatggaagtcactggtatgatgacacagctttatagctgagtttctcactgtgttcataaaataaacaatttaaaaagtaaatcaatgctttgcatcaacaatagaaagataagttcccctgctcatattccgaaagtttcctaggtttcaagctgggagttccttgaaaaagcccagggcgccaacagcatgatgtgatccgctcccatttttagatgagtcactaggacagttttactcaaagaggcaggggtttgtggaaagaggagtggacctctataaatggcataatttgaatgtgcattttgaaaatgccacatgagcaaacttgcccacctgccagtccagagaagtactgctaaaatcacctctgaaagaaccacatgatctcaaatatttaaagaataacttccaatgtctctcaatgcaccttttgttattttatgttagtgcatttatccattggatttttcagttaatataaacatttttatcatattttcattagatgagctaaaatggatgtactcttaaatttcactgcgaggttgaagtcatattcagtcacaacaccctgagtgctggacaagacatctttactttttttttttttttttaacaccacgagctctaaatccttccaagatacaaaccattaaaagcacctttataatcaacgtatgtcagagatctaacatcatattaacttctagcacatgcaggtagctaattattattttatttctagtctttacaagtacatggtcagttaaatagaaaccacataaagagtattacaagtggtacagtggaaagaaattttaaaaagagggaggaaaaactaaaccatgagaccaatatacagggttcttctctttctatgacatatgtgctctcattagggcattgacaaaagaaaatatatttttcagaacttttgtacccctgatgctaatgtacacaagagaagccatcaaaagcctactgctgacaagtcagactattgatccatcctgtctctcatgatttcccctgcctcataatttgatggccttttggaggcgtggacaatgaaactgccaaacaaacagggactctcacatagagctttgggctttgtctccagtgtctaagctagatttttgggttatgctgctgtggaacagctgcttccagagtcacccctctagagacatacttggtcacctgccaggatttacatgattatccatcatggggacaaatctatcccaggaaggctcatttcagaatataatacagtgtggattgaagacctaatggagagaagtgcacccacaggagtgactgtgatctattaaatcagtaagaccttggaagccttctgtcaactgacttcagaaaataatggttcccctctcaacacaccactgtacttttttatttgtcttttgttaagtcatcctgaggaaaaggctgctggactgggagatttaagactttgaatagtgctaacagaatagaaaaggaaagttaaattacgctgcctattctcttaccaaactctgtaataacaacatctattccttcatctagtgaactgtcaggtagggcatagagaatacgcatttggaaattgatctcaactgcctttgagaaaccatagatcatgggaaaagaggacctgtgtgcctttccatcttaactctggatcactctgctcctcatttcagaggccttctttcccttcttagagtagatcttattttgttgttgttgttttctgccagaaaatctttacacatgctgtttcttcttccttggaatgcttttcctccactgttcatttgcctgaacacctaagttaactcaggatcctcctattcaatgtctattgacctcgttaatttttatagcattttctcacaatctgcatttgtacttttggttcatctaaaagtctcacaaaggcatgaaagcctcacaaaggcagggaacatggatgctaacatgaagtaggagttacataaatatttgtcatattaaagaattttaaaaaataaaagtaaataaatgaagactgcaaaaaattgacagccataactctggattgtaaataaagttgtatattgatgctgctgtgtccagttaaataaaccttaatctaaacttggagctttagagtttgtatactagtcactggaagtttcaatcattcatgttttaaatcacatttttctcaataggagcatatcctttaggtaaaatttaaacattgctctcttcccttaatatgagggacttaatatctagctttacagggctttttaagagcaaggaaaatcactctattgatgctaagtgaagggcagagaaagcaactctattaagcttttgacctagtttctctctggttacttcaaggcaattgaaaagtcctcgattaggtgcaatttgctagtgactattctactgctatcagtgcagaggcatatagatggaatagggtatgtagacttatctatggtatattcatttacataattttatgtcataaaaaacaaaaaaaatcaaacttgtaacattactgagtcagtcgtaaaacagagtatccagatgttattttagaaacagcattgattgggcgcaaagatcaaggtgtatatggcagctttagtgagtttggagtatagaaagtgttgggatcaacagaatccatagcaatcagtttaaagttttcaataaagctatgaatggtaagagggaaaccaactagaatttgctgctcattcacctcaaactgcactgagatatctttatgctcaaaatggacaaggagactattatgtgtattctttgatgcagcaatgctacttctaagagtttatcttacagataaagtttcacaagtgcataaagatttttaatgcagcatcatttttttaagttggaaacaacttaatgtccatcatttgaggttccttttttcctatcatattgattatttgctatctgccaggaactgttctaaagcacttttcacataataactcaatttgtcttcaaaacaacaacaatcttcagttactttccctactttaaagataaggtaaagtaagttgtaggggaccacagaggtatttagtggctaagctagggtttgaattcagacagccattaaaaaatgaagtagacccaaacttactgataaaacacctagggcatatttttaggttgaataaaaaagcaagttgcatatatatatatggggagagagagggagagagagagggatacattccttacaaaggtctagaagaatctgttcaaccaagcgtagtcacctcttgcttataagcagatgcttgaagagaactttccccttttactctttaaaaaacatctcaatcattttaattttatatccttaaatgttaaaaagttatgtatgcctggttttataaaataaagttaaatgcaatttcacccccactttaaaaacaataactaaaaaggtatagcgcttactgttcataattttgtttcctaacaattaaaacatgttattaaggaattcaatttaatatggtctatagtcacatgtacgtataatctgtatgtagcacatataaagttctgaatagatggcttccaccggggtgacaaaaggaacagaaaaaagttatactatgttaagttcagaactttacccaaatatctttagacacacagcataatacatgagaaaaatgataactacagataatccataaagttgtttaataaagaatggattgaaaagttatttaagaaacaattattattttttttttttgatgcaaggtctcactctgtcactcaggctagagtgcagtggtgcaatcatggctcactgcagtctcaaactcttgggctcaagtgatcctccagcctcagcctctggagtagctgggactacaggcataagccaccatgcccagctaattttaaaaaattattttgtagagcctgggtcttgctatgtttcccaggctagtttcaaactcctgggctcaacagatccttccgcctcagcctcccacagtgttgagattataggagtgagccaccatgccctgccaaaaaagtaacatattgaatgtaaaaatcataataaaagttataatgatttggtgtatactatgtcattctaaaataatttgtgcatttccttctaaatatctatctataaacattagtaaagaagtgggaaatttttttgtcctgaaattcattttacttaattagcatcatacagaaagtcatttatgtgccagatgctaaaagggaggattacgatccagcagatattgatcataagaatgaaatgaggcacaagaaacacctgtgaatcatgaagtattgacgctggattttattaactcctatatagtgataatgtgattgaaagattatgaatcctataaaggaaatatatttaacaagtccctactaacaccaactcttgactctcagaccatccacaaataatctacaattagaattcattatgtctaaagacagctatcattaaaactgaaggccaaaatcgccctttctgcgtacttctgaaagagcttgcctttgtgagcaggaggagaagggaagagagacagtgtacccaaggaaaggagggtgttggtggtatagagagaaaggcatttctagcgcccaggcaccacaatgagaatttgagaattgtgtttattgtctatagagcttgttattgctcttgggtttttggctacaaaacctaataatttactcagttttgcaaggaaataagaaatgggcctcaattcactctccttaattcatttagttggatctgatttgcaatgtatgttagtactccttctgtagcaactgaaacatattaaaaatgactctagaaaaaatacatgctagaaagtgcttcggttactttttccttaactaggagaccccaagagggaaatgactaggtctcaaaatttctaggaatgacatttccttcttctgagcaacttgaaggtgctacagaccaatggaatataagggattcattatttaatgtacaaaattcaggctgctgctttagggcaaacagaaaaaagtcaaaatttgcctctatatagaaggctaaaaacacttttaagaaataaagtaagtcatagggaactgggcataattgaagttcccaaagccaaaattttcccttttttatttgtaatccaatttgtggtacaattttcctaaatcctacttctgattatttttaaatttttctttataccaaataaaacaaagttaaagacagaactctgctaaaattttcaatgtaaataaaaattaaatcatttaataaattatattagttgtcatgctatattttatgtttactcttgttatgttttatttattttatgtttgactaatcccccatcctgtgggaaacgtttgttgatgctgaaattgccatgagctatctttgctctatttcctttacttatgtcatcatcaagttcaccaattaacctatattttcacccaggtagttgacaaagcattggatgcacctagccaaggactgttctatggctctccactagaaactccctctagaccaggctgatgtcaagccatacacattaatgataatggtaatgagctacataatccagccctccttgacctcatatttctacatctgggtcatgtgactataattaattttttttttcttacatgtcttggtgaactgaaggcacatgatactcatggtattctcctgatcttaccactaggcactgtgtcaaaagacatagaaattgaaactgggttccttgagagcagacattatatcctattcatcccttaattctgtttcaaaaccagtgactgcaagacacagaaatacatgttcaataataaatatgtaatacataaatacatgttcataaactattgggagagtctcaggattttgaaaaagttgttttgtagtcctagctatgccactttcttgctctgtgactctggacacatttcatagtctccaagaacctgagttctaaatctgaaacaaaaatgtactgacacattttaagattctctttcaggcataaaatcctacctagatttatcatttccactgtgtaacaaagtgggacgatgacccattttttgtaactcagtagttttctggaaaaaatttaaaatgcattttttcagtacatcaatacatcttgagataaaacattgtatagtctctactttgtgtaaagcaaacattttcattacttatctaaagacttaaccttctttataccaatcatctgtaagtttggaaaaacaatgcaattgaatttttcatccagctgtttaccatacataacttagaaatcctaaaatgccttattgaaagtgcagtgattttagcattggtagagtaacagtctcaagaaatgaatgaagctttaatgactcatcttcaattcaagaggaggggctactattataaaatgttaagctgaaaaattccaaacacaactgagatgaagttacatgatttaacaatctgttttttgtttttttgaaataaagtctcactgtgtcgcccaggctggagtgcagtggtgcgatctcggctcactgcaacctccatctcctgcgttcaaaccgttcttctgcctcagactcctgagtagctaggattacaggtgtgcaccaccactcctggcaattttttttgtgattttagtagagacagaatttcaccatcttggccaggctggtctcgaactcctgaactcagatgattcacccacctcagcctcccaaagtgttgggattacaggtgtgagccaccatgcctggtctgtacatcctaaaaaaccccagtgttctttctgctgactgaggctaattagtgtgggtgataaaaattgggcacacatatcaaacacaaattggctactttgtccagcaaactgcttccaccaaaactccggctagcaatcacattacaatgactacttggctcttttctttccctaaatggatttggttatagaattggaaaaccgggtatactttgttttcaacagattaaatgtaatgggttttatgaagacagtctttatattttcctataaaaaaggtaattagttaagggattttgggggtaggagaatgaggcacacaggggagtactcatttcaggaaaaataatacgtaacaaaatattcacaaatattctgctgtccctcaagctgatgaattaatcttctcgattagttccagataaatcctaccatttaatctattttgaaagaaattagaaggctatggttttaacactatgttcaagttttcgctaacttgtaaaatggtaacatacgtgctgtaaggatgacataagagatggtaaaggaaagcatgcagaaaactgtaaaagcttataggattttaaatataattgtacagtaactaatgatggtgaaataaaatagatgttccttgatttagaacttatggatgtttctgaagactacatagaataaacaatttagatgttcacactctggccttggccttatcaattcgccttcccctccttgctgaccccacccctttaatctaactccccccaaaagtggccacatactgggagtaaagagagtggcaatgaacctggatctacttggggaggaggcctcggctattcaaagagtaagaaaaacacaatgttccaggctcctgattctcaagcaacacagttacttggggtatttctcaccaagtgacctggatttgaggttggcaagtgtcgcacaccccacctttctgggtggcagagccatgtgaggctgttgggctgcacctaccagctaatggctctgtgactctgtgtcacaaaccatttgtttctacatctcctggcatcaggatccaggaaagatgtccacactcattatccataaagggagttgattgcctaagtgatctgcctgcattctacagagtggagaaaaacttattaaagataggtttagtcacaagattgcactgtcagcagtcagactctcctcctttcttgacttttctttccctcatgctctaatagaattgtggctgaactcatctcctacttggattatttgtcttgagttgaaggagccctggaagatctgttctgaaactggatgtgacgttaggaaggcaaaggagatttaaagtgacaaattgctggctcaattctcaggaagaggtgctgcagaggtgatgtgcaaacatttggacttgtaagggtgatgatccaggaatctggggactgggttctttgcctaaatcctcccccaccttcaatgccattgctctatgctacacctgcaacagcttcccatctgcctctgcccaaatagcctccaaagtggaaatgcagttcggtgaaagagagtttcagcataataatccctgggcctttttctatacttaggacagaaacaaagtgaattgccaaggagcagacctctctccctactaatcggtttagagttgtgttgacaaaatagtggcaaaatctccagaagaatctccctatgagcctccctgagcctcccaaactcctgcatcccatgcatgcatagatatctctatcacattcctggcttttgggaaaggaattgcgcatacagcaccaatacttccaaagtatttagaccttcaggctatcactgtcctcaaagtttcaggttccttatccataaaattctgaaactgggccacaggatcttctaagtctgccaacccagccctgagggcccatgaagatctatgctgcttgctttggtgacaaaaataaaaataaaaaacaacagttggggcttgattccccatattaaatatatgccaagtatatactaagtatatgttaagtacaatgctaagtattatcttgttccattcttactgcaatcctataaagtcattcttgttatcacacccatctgacagatgagaaagcagatctagacaggtcacatacctaatacaaggtcatgtgactagcaaactgtggagccaggatgtgcttcactgctttagaagttcgagtgtttaaaatccagaatgttccattccataaaaaaaaagacattctacatttcttatttgtttcgtaggctggcccacaaaaacaaagtattgtttcgtgcctcagcgtaagtctgaaacaagacatgcatggtaaactagtttcttgagccccactgtgcccttctgaccccaggaattctccacagttcaaacctcagactcatgctctgaggcttcaatttcaccacagactagaacttgagctcagattttggagaccagaaacctagcccttctggccctaagaatgacaagcctctccaggagcaaagtcaggaaaaggctgaagacaccagcagccgttgagaaattaatcgagctgcagcagtcattttgctttatagggtatcttttttggcagaatgatcttaaaaatccaggacaaagtatttaaccaaatatgtagagcaaagaactgtgatgagttaccaacacatttctcacactagtaggttaagatgatttacttgatatttagtaataatctatacgtaattgtcctttttatgaggatagggatatttcaaggtgaaaagaggtaagaaaatgtggttgatccctacaattttttggatatagaggaagaaaaacgttcaaggaagttcagagggctgaagataggtggtcttcagctttgcatcttgatttttgcactaactagctccatgacctgggataaaaacaatgataaaaatagtgataataaccttcattcactgaattctatgtgctgagaatttgctaagtgctctatatgtattatttcctttaagatttaaaacaacactataaactggatgttataagtcccatcttagacataaagaaactgaagttgaagttgtgataacttgtccaaggccacaaagctgttagtggctaagttagtattagaacataaatatgaatccaaaacttatcccaactgaatctgaactgattaccttcaggctataactgtcttcaaagtttcaggtttggaaaagcctggagggaactggagactattattctaagggaagtaactcaggaatagaaaaccaaagatcatatgttctcactcataaatgggagctaagctatgaggatgcaaaggcataaaaatgatacaatggattttggggacttggagggaagggtgggagggaagtgagggataaaagactacaaattggggctgggtgcggtggcttacgcctataatcccagcacattgggaggctaaggcaggtggatcacttgaggtccagatatggaaagttccttatccataaaattcttttttaaatttttcatttccataggttttggggaaaacaggtggtacttggtttcatgagtaagttctttagtggtgatttgtgagattttggtgtgcccatcacccaagcagtatatatactgaaccccaatttttttttgagatggagtcttgctctattgcccacgctggagtgcagtggcacaatcgcagctcactgcaacctctgactcctgggttcaagcaattctcctgcctcagcctgcaaagtagctggtattacaggcacctgccaccacaccgggctaatctgtgtgtgtgtgtgtgtgtgtgtgtgtgtgtgtgtgtgtgtgtttagtagagaaggggtttcgccgtgatggccaggctagtcttgaactcctgatctcaagtgatccacctgccttagcctcccagtgtgctgggattacaggtgtgagccactgcacccagccccaatttgtagtcttttatccctcacttccctcctacccttccctccaagtccctaaaatccattgtatcatttttatgcctttgcatcctcatagcttagctcccatttatgagtgagaacatatgatctttggttttctattcctgagttacttcccttagaataatagtctccagttccctccaggttgctgcaaatgccattaattcattcctttttatggctgggtagtattccattgtgtgtgtgtgtgtgtgtgtgtgtgtgtatacacacatatatatgatacatatatatcatatatgtgtgtgtatacatatataacatatatatttacacacatatcatatatatgtatatatatctgtataacatatatatcatatatatacatatgtatgatatatatatatataaaacaatttctttatgcacttgttgactgagggcatttgggctgattctatgtttttgcagttgcaaattgtgctgctataaacatgcatgtgcaagtatcttttttctgtaatgacttcttttcctctgggaaaatacccaggagtggaattactggatcaaatggtagttccacttttagttatttaaggaatctccacactgttttccacagtggttgtactcatacattccccccagcagtgaagaagtgttcccttccaaaccacaatgtgataccaccttactcctgcaagaatggccttatccataacattctaaaactaggccacaggatcttgtaagtctgtcaagcaagccctgggagcccatggagatctaaacatttagaagagggaaaaccaatgagacattttcaattcttcctttcttgtagactgtaagcactagcaaaatgaattgaatctgtatacagttactacacactgccaaaatctgattcattttggataagtgatgatttccagaagtacaattctcagctgaccatacgctgctatgttcattcaatttaaaaaccttgagccattctaggttttgaagtccctcaccctgccttgccacacccctgtagcaggaaagaagctttcccaaagaggaggagattttacttcaagagttattacccgcttagttgcacacacattcatcacattctgagcctgattggtggctagagttctcagggggccagcactggctggggaaagtggaaggaagagatatattttaggcacccattgatagctttgctacaaaatgcactacccgggcacaacacactgagttctggcaagtacagcccatgttaaagacaaaatactccactaacttgactttgtctttcttggaccatctcaaatttggggaacctctaggtatctgattgcatatgttcctgtgtgctcctaaaggtgccaggggaagagaaaaacacatggcaatcagttgacttgcaaggcctagttataagccgaaataaagttttaggtacaatccagatgtataatttgctataaaaatggactcggaggaatccttggtgatttcccacaagactgagccactgtcctcctttcaatacgagggggattctgggttttccagacctcactttcttcaggtctgagataagcctgagacatacacaattgctgaaggtaacgtgaagcaggaaaaggaaggccagttgctctattaaaggagcttgtgttttcctctaaccaccacagtctgggcagcagacaattctcctttttctttcagagcaagtaaaatgttctaggtcatgtttaggttgtgacaggcacccggatcaacaagacgtcatttaccaagataagctggaggtcaacatctccttatgaaagggctccaggagctgttgcataaatgcaaaataacagatgcacaatatttgagtcctttagtatatctcataaactttaataatgtgataatattcaaacacatggtagtgttttaatggtaactacagaagagcccctggaaaatctgacaaatgctgtcataactggcccttcagagatgtccttccagctagtccatatttgcccttttaattagagttttagtccacttgttccttcttgaaggaaataaggaggctgttggaatagcaattttcaatatccagattccagacacatcaccctgttatagacagaactcaaatccaaggcatttctggaatccctatgttaattaccacattatcaagtcctggaaggactgtcgcataaggattctgagtaacttgattctcctaatgaacctgagccacccagacgatggaatgaacagcctgtagccagtctgggctgctgcctctcacccccgcagtctcagagctttggcctctcctgggtttggcacatggcctgtcctttcccattgtcagcctccttttcagcgcggtttggcatcctcttcaacatgaactgcctagagtctcgtcgtgccccttttcttgacccagccactgcctcatgtgctgccgtgtctgctcactgatcacctccactgtcttctaatctgttggtactgcattgttttacctgggtttgcaactggggctctgagatccccaacgctagctgttttctgggctcagcgatgctcacctagacctcatgcgcccgccagagatgaacccaggtggaatccctttgcctatttttgtcaggtgaacatggacttccgcttttgagaatcttccacctacccaccccatccatttgacactaacatgtttaggtcagtgcttctaaactttagagtgcatctgcatcacttaagaattttgttaaaatgaggattctgactcagtaggtctggtgtggggcttcaaattctgcatttctaacaacttcccaggtgatagccattctgctggtccatggattgcatttgagtagcaaggctctaggaaacagccttgtcctattcatctttgctggcctgcaatttccacagcagtttcactgccaccacttgggaagccccttctagtggtgtgaagcagtgaagacagaaggatgaccatgacacagtccctgctccccagggttcatagcctggagcagttttcgagttcagcactggatgttgagggctgataatatttagttgtgagggaagtcaggtgaaatgtaggttatttagcagcatccctaacctctacccactaggtatcaatagcatcttcccagttttgacaatcaaaagtgtctctagacattgccagatagttaagaatcaccggtatagggagggagacaaatatataaattaataactgagaggatggatcaagttatagaagctatgtatacactattcaggaaaagggattattaatatttcagaggctgtgataagcatttgacacagtgtgtgctcaataagtttgttagatacacaaatgcactgtgatgtccccacacttcctataacagtttacctttctgactgtctaatagaaaagacagttttacattccaaagattagcatctacttcactgacataattcactttcatggacatgtttgccaagtgtattacaagagaaagaagcctccttattttttaggataatgaagatagagtatagacatttgtaagaaaataagacacttaaaataaatatattttgtgaaacagaccgtttgtactgcttttttgacattatatgcacattcctatcagacaacaactaagaggagcattgtacatattacttggtaaatgaattcaagcaggatggtgcattttgttgcttggcacatcttaaatgcatgctcctaagcagctgtttcttttcccttacaggttttgggaggatgaatgtatttccaaggaactgtctattctgggatgctcatgctcttatacagatgcatttgacatctcaccatgcatacatagaaaggcaaaccagtaagcagataagcttggggaacccaaataagaggaaaaccagtgagcatccacatttatgaaatggaaaggagatgaggaatgctcatgtcgagcagcagctctaaatctcagccccaaatggcagagctgagaaaagaaataatgtcagcattggacttacataacaagatggcaagttgaagattttttggttatttatcttaatatagaggcaggaattgagaagggtctgactttgaggcagaacaaaagggctgtgagaatactgaaggtgtaagggcatttaaggataaataaaaaaaggaatggttgtgggggggggcatagcgtggaatatttcagtgcaaactttcagacatgtacttggtaaatgttattatcccttaacattttataaatggaatccaaaataggccaatgggaaacattcttggaaatatataccaactggacaagaatattcacagttgccaaaggaaagtgtgacacttggttctcgtgccaaagtcaacaagcctttgcccaaataatggcaaatcttttcgtttggaacacagtttcttaattaagccccaatgtcaattactgcacgtaagtagaaatcagcagatctgaagtcaaggccaggctccacggctggttggccaggtgaagtaacatttgtgctccaattttcctatccagggaatggggaaggtaatactttccaccaatctatgctgaaggaatattgtgatgagtcagagaataaatctctgattttttttgtttgcttaatgaagagtatcactgcatttactatagtaaaggcttgttctgttttagtccataagttgaaaaaaatcaatatatagcattcatatatccaaaatattcacaagaaaggtcttcaagaaatatttgctcatccatgttcatagcagcactgtccacaatagccaagaggtgaaagcaaacaagtgtcagtaaacagataaacagatgactggctaaagaaaatgtgatatacacacacacacacacacacacacaaacacatacacacacacacaccaatataacagaatgttattcagccttaaaaaaggaagaaatccctgtcacatggtacacggttgaactttggagacattgtgctaagtgaaacatagtagtcacataaaggcaagtatgattgcatgatatgaagtatctgaagtagtaaaattaatagaaagcaaaatggtagttatcaggggctgggagaaggggaaaaggggagttgtttaatgggtacagtgttttaattttgtaagacaaaaaagttctggagatctgttccgcaatgatgtgaatatacttaacactattgaactgtacacttaagatggtcaggatagtaaattttatattttttactacaatgaagtttttaaaaagatataaataattcagcgaaaggaaacaaaagcctcaaaataacatcccattttggttttagcattagaatttggctaaaggggtacagtctctgatgagacttctttacataagtagccaagctcctggttaccagaggtgtgtctggtcagtaacacactttgttcacagacaggaaccaagagtgcaagtgtcccccattctatctagtttgtgcctttcaatggcataggatagcagcaaaggcatcataaccttccagggggaaatggatagttagtacttaattctatgtaggctgccctatacaggaagcactgatttttgatcatgtaacattctaaatagccacaaatgaaaataattgccagttctgcatcatgaagagcaggagaagaagacctgctaaaagagtcagaaaaataaataaataaatgaaatactgagataatatgaaatggaatgaaataaaataatataaataaaagtaaacaaacacttttcaagcaagttttgtttctcaagcctaagaaaccccattttggcccaatatacagactactagagaatttcttgtccttaaagcaccaagtgcttagtgtggcatctgctttttgctaatttctgaggagaaggtgcctcatgattcgtggcagtgacattatctttcctattatgaataaaaaaccttgaatcaaattggagtgatataaacttaataggatagagccttcagatctgcattctcagccaatcactactttactgggttatcctgggcaaaactgtacttcatttgttttttctgcaaaggtagacacttttcagatctgattcgagggacagcaaaggtggagtagaaaggtcactggatatgctgatacaacatgctacagaaagtaaccaaagacttcgtggtttgagggaacctgggccatttctgctaggcagtaaatgacaggaagaagcttggaaggttttctcttaagtgatgtttaaggctctgagctaccaagacttctgggaatcaccaccaatatcatagtgctatactttactcagtaagcagaaggaatttctctgttggaaaaaaaaatcaaacaaaataaaaacaaacctctaaaggtgtattgggctcgcagttatttccaataggggctcagtcctatgggggaaagggagtcaggtagacgccatggagatcagacacctggctgattagctccactgagaacgctgcaaagggcaaaactttgtcatcccatctctttgtagaagcatcttctctggaggcttttaaaaataggacttgctctcagcatttagagaagacagagcataaatcttcctggggaggagtggaagaaataaccttgcaaaatatttgggggactgggtcctgtggacagttggtctccatagttaactggagatgttgaaattgcattcatgcaacctaaaatgcttagacatggtgaaataactagttgaaccaattattttgcagtgaaaaaaaaagcttcaccagtgaaatccaacctgttttgttattgttgatgtttcattatttttactgcatttagcttttgaggggacacataccaaggtgacagtgctttaggtaaattttgtttattccttatttatcttcttattcaagaggtatttctaatattttaggcaggagctgcattttcaacacaggaataaagtttgtagatatttattgcagcttcctgttgctgctatctctacagtaatcatcatagcttcttccctagggaaagagtgcttcaggctttggaaggcgcacagataaaaaggatacgtgtttttggctggagctacctgattctatgatctccctaaaattggttactgaaatattctcaaatgtctaagcaggtcatattgtgtaaatgaatgatctcctgaatattttacttttttttttttttttttttgtgagacggagtctcgctctgttgcccaggctggagtgcaatggtgcaatcttggctgaccataatttctgctcccaggttcaagagattctcctgcctcaccctcccaagtagctgggactacaggtgtgtgccaccatgcccagctaatttttgtattttcagtagagacagggtttcactatgttggccaggctggtctcaaactcctgacctcatgatccgcccgccttggcctcccaaagtgctgggattacaggcgtgagctatcgttcccatcctaaccattttttattgatatataatttacatataataaaatccaacatgtttaaagtgtataattcagtggtttttagtatattcataaggttgtgcaaccatcaccattctctaattccagaacattgtattcagccccaaaagaaaccctgtaccaataaccattcactcctgctttcccttcccctcagcccctggcaatcactagcctactttttatttctgattatttcatataaatggaatcatacaatatgtcaccttttgtgtttggcttctttcacccagcagaatgttttcaagtttattcatgtcatacatgtatctgtactaacatcttccaagtaattactgtgtccaaggtaatgaggtgttgaagcttttcttttcttccagatgtatggagttggtgcagacccagtccagtcttatgacgagccttggatgccatggtcacaggcagcacatttacggtgtagccctaagggttatgggaaacccaagtagttgggttaacccagtgagacatgaaaaactgcccagaacacaagcaagaaacaggtcataattgagaattgaggaaagaaagtgcaagacaaaggtgttcagatacacagttaagatctgagtcctgggtcaggacagaatcaattaagagagaaagaacagtgggtgagaagaggtcagtggccagggatgtacaccaagcagccaaggatctgtagtactcgggtctgtagcagctgccctgactcaggccatgtgacttcagagttctctgtcacagaagcatagaatatttgcactggagaaaaatttagagctatattctttagcaccatggttttgaagatgaacaatctgagctctagaggggctaagagacctcccctcaagctcaccaaccttagtgatcacttccttcatctccctccactcagtagaatacattttccacaatagctcactgccatgggaccacggcatgggatcccaacagatggatctggtcatatgttagtgccaaaatgcagtttagcaaccatttactcacatacccttatactatgtgacaatcagcagaaggtcttagatatttttatattagcttaaaagaaaagtttgatgttctttgacctaatttttattggtttaattgtctaaatacctggagttcctttacattttaaataaatttaatagtatcaatctataggtttagaaactgagagaaataatttttattggttaattgtctaaacacctggggttcctttacattttaagtacattaatagattagtatcaatctataggtttaagaactgaaagaaatgaatgaggtccccaacacgtcagtcaatgggaattagaacagtgatgcccaaaatatgcacataaatatcacgtgatgaccactaaaaaacacttggtgttcaacagaattgtaaaattagtaggtcaaaaggaatgactccaaaacccttcatcatttaacattcaaagctgtaacttttaaatcagtttcttctagcatcattgtatagaaaaaaatcattttttcttcagaaaaaaaattaaaaataaataaattttaaaaatagccttcagattagtcaaaaaattttgatgcattcatatgagaaaatcgaaggcattaatatggcggtatgatgtatgtctactgaactcaaaagtttagtaacatgttgagtgaaataaaaactatagaagaacatttaaaatttgatgtctttatatatcttacaagtgtgtttatttatatttgtgtgtatatacaaagaatatatctggaaggacatccataaagtattgacaattgtatccccaagtagtggaattatataaggatttagtttctataattttttgttgttttgttctctttatcttctatttttttttctggaatgaacatggattacttgcataattaaaatattaaaaatagactttgttttgaatattgtgtttgcaagactggttcattatcagtttctacaacaaatatcattttagaatcgataacaaaaataaaagcaagttgtccttatcatctccacaaactcagaaaatagttctacatcaaatataaaccagtacaaagaggcacttgtgaaaggaaacaaatgtttggggacttgacctactccccttccctcctcccttgcgtctcaaagaggtacagctcattctcactccttttgatttattaaatcaccatcttctccctaggctagacaaaaaattcatggttaggatttaccctcaagcttcaggctgactacattgtatttgaaacaagcaagtcatctctgtcttgttgcaaagtttacaggaacatcacctcaataagcacacttgctgagcttattgttatccacctttacctcataggaaagccctactagtaatggactttgaatcaccttctttgtttattcatgaagttgaaagctacaatagatcatgattattttccaataaaacaaactaccagggtcatcgtgatgcgcaactgtgaggggtactattttcatcataggttatattaatggtgccactttgctcatcacacatctgctaacagtggtccaggaaacttcatcctgtaacattttaatcaaattctgcttttctattcagtatttgactctgaagggcattttctccacaaattataaaagtataaagggttttagataagtacaagtataaatataaataaaatatacaggtataaatatgtatatggaagcaaatttttctatatatcctgtatatttcataagtttctataaggatggacttctgattctaaaccaatgggtcacatacattggaaaatacaagataagattgcataccaagttaatcacataaatagaagcagaagttcctacttttagatttggaaccatggtgtgccagatataatgccaaactttatcaactgtagaaaactatagattagttttaaattgtatattcttttcacagttactcccatgttctagagatcgattgttccagttttttaacagctttatttgatgtatcactgacatataataaactgaacataaagtgttcaatgcgataaatctaatgggttttgaaatacatacacacatatgtatatgtgtgtataaaatatatgtatacatatgctgcatatactacgtatatacacacacacacatatatatgtacctttgccataatcaaggtaataaacgtatccattaccccccaaagttctcttctctagctattccctctccaagtaatcaataattttattgtcactgtggattagtatgaatctccaataattttacacaaatagaataatccattatgtactttggggaggggaaggaggagagtcaggctttcactcagcctaattattttaagagtcatccatgttgtgtgatatataaatagttcattcctttttattgctgagtagtattgctgtgtatggaaatggtataatttgattacttattcacttgctaatagatatctaggttgttttgagttgtacaagtctttgtatagctatatgctttcttttctgttgggtagataccaaggtgtagaatggctggattatatgataagtgtatgtttaacttttaaaaaaacggtctcctaaggtagtcgtaccattttacattccaaccagcagtgtagttgagtttgggttcctccatgtatttataaatatttggtgtggtcaatttttttttaatgagacaggttcttcctatattgcccagactggtcttgaactgctgggttcaagcgaacctcccacctcggcctcccaaaatgttgggattacaggcgtgagtcacagtacctggatatggtcaatttttaattgtagctactctattcagtgtgcattactatttcattggggttaatttacatttccctagtgagtaaatgatgttgagcatatttccatgtgcttatttgttaacatatattttctttagtgaaatatctgctcaaatatttgaccaattttttgctgtgttttcttaattgttaaattttgagcattaattaaatattctgatataaatattttgttagatatactatttgccagtattttctttcagtctagcctgtcttttccttcactgaacaacatatttcagagtaaaaggtttaaatgttatcaatttttaaaaatagataatgttttggataaagaatctaggaaatctttgcctaacctaagttctcaaagactttcttcaccgttttttgaaaaaaatataattgaggttttttattaggtttcagatacatttggaatttgtgcatatagtgtgaagtaatagatcaaaattcattttttatttgctgcatatacaatatttcgggaagcatttgttctgcacagaattgccttgtatttttgttagaataacaacaacaacaaaatccaaaaccagtttattcatatatgtgtggatctatttccatagtttattccattctaatcacttatttctatttttatgccactaccacactagcttggtacctgaaacaataaaataaatcttgaaatcaagtagtgttatccttttgttctttttttccagtggtattttagctattttaggtcctctgtatttatacatgaactttagaaaaagcttgaaaaatttacaccaaaaaaaaaatgcttattgggattttcactggaattacattgaatctctagatcaatttgggaagaacgattatcttaaaaatatgatgttttctgacctgtgaaaggcatatctgtctatttatttaggttttctttaattactctcaggaatgtttttaattttcagtgtacaagtcttgcccatcttttggtcagatttatccccaagtattttatatttttgatgacattgtaaatggtactgtttttctaatatcagtttgcatttgtttctcgtatttagaaatacaattaatttctgcatattaatcttgtaccctgcaaacttgttaaactcccttactagttttagtggttttacagatttttatcagatttttatataaataatcatgttgtctacgaatacagaggttcatttctgtctttccaatctggatgtaattttttttcttgctttattgcactggctagcacctccagtacaacgttgaataaaagtggtgagagccaagacatccttgctttattcccaatattaggagagaagcattcagtctttcattgttaagtatgatgttaattttagttttttcatgtatgtcctttattaggttgaagaagttcccactattcctaatatttctgagggttcttaacatcagggacagatgttgggtttagttgattgccttttcaatatctattgagatgatcatatgttttcccttttctagttcgtcagtatggtggttatcaatacagtaatatggttaacattttattattattaatgctgaattgcaaaacgtaatttctagaaaaatggaaggttagtcacagttgtgcctcaatgatactagattagagtgagtaaggtaaataaccattttctttcctaagaatttttttttttttttttggaatttcagttggctatccctgttacaactgcttttgtatctatatttgctacatccaactgggttagtattgaactagcgtttaaaaagggaaaaagaacagtgaattttaaagttggtatgtaacttaaaatgtgaccccaaatcatgatccctgcttgaagaattggtcaaaataaataaaaatggatcacatgctctttaatgtcactgtcttgtctgaaatcaaaccttcaggaatatttatctgaagtcttttcatgtagctaaagtgcaatcatcttggagacttattttccagtaacatgtcccagagatagaaatttatctaaatgttatctaagttctttatagcctttggcacatggtgataatgtattaagaaacaaaagggggaaaatactcaaaagcttcttgcaatgagaacatttgtcactggtatgtgtcatgaaacggacctgggcatgcaaccaagttaagtaattacactggtctcaggccaatttaaattgtgtgctatagaccttctatgtagaaaatagtccataggttctgcatacaagcatcacatgcaaaaaaacgtgatatgaaagtcttttgttccccaagaaggacctgaatgtctgtctgtcgacaagacaacctctgtgggtacctcactgacatagtatacatggtgaaaaagaaagtgtcaattggttgtgatcatgatcagtaaaaacctatttggtttataagcctggatccaatcacactgatatcattctggactcaactgtcctttgtggttcaaggacataagaaaactgaagagaaggcttgcaacttggatgttgaaaagaaatttattgaaaggaacaccacttgaataacttttactacctccaaaaagcagtatgttctctctactggaaaagacctaaatacactcaaaaagcttactggaggattttttcctattaatttgaacgtcgtataggaacacaaaatttggttaaatatttgatagataagtttggtattaaaaagtccacttggttcattataaatattaaaattaggaacatgtgttctttgtttaagcctgataaagctttagctgagatcatgagttttcataaaacaacttttcacaacacaataatgtattaggtcagggtctactgccctcctgcagattttgcctgatagtattttcatacaaacctcatcactcctgctttttctcagatcttctctgagcttatttcctaatgcaaatcttgatttatatcagggccctaacgtggctgtccaaaatacctccctcccccaatttgtgttttatctcaatacattacccagtggtggcccagcatctcagagtgcccaacatgtaatcttagtctcatagggataaaggaaagcaaccatacctcagggcattcatcatccctgaaagtccctctccctgtcttaccatgctttatgtcatcatctggctcatttatttatttataaatagccctccactcaaataacactcctgaagggtggggaatttttctactttgttcactcatacggagtaagtgctcaaaaattgtgttaaactaatagcattcagttttagtaggattagttgcattaaaaatacatctcctagaattaagattgcataatatgttactgaatagttcggcttctttgaaggtatccttggcagagacaaggttagttctccctgactcaagcagagatactgttttctcaattctcttgttcgactaactcctctctgttatttattactggagacagacagtatccatcacttctcagattgatgcaaggcagtggtaataaaataagctacatacatcatgtaatcatattggttttatgaatcatatttttctgaattagggaaaatagttgttttggtttaagctggagaaaaattctgactcatgtcaacaaatcactgacaaggcaagcactgataaaaataaaaagcttaaagcaagttttattagagaaaacttgcaacaactctacacaaacattgattaattataggctcacttggtcttctttaaaatgaaaatacttttaaagacatgactgtatgtcaacaactaaagaacaggatatataactagaaaaataggaatatttatttaaaatgttatactgcattgtgcttttttttaaagataaaagctatttaaaaatgaagcaagctcaatttgtaattaggacacacaattcctcaaactctgtaagtctattaccttaagttgcccttacttaaaaaatttattcttatctgaaaattatggcaatgtttaaaatgtttaaagaaaacagtaaatttgtgttatgtccccaatttttgaaatttacattttattttcatcatactgaaaacctgatgctgaccttggcttcactcctcgaggtggtatgtagagttctgtgaggtcattgctgtggatattcagcatgcactaacagtgcagatttcctggtgggtcagggctgagaggattggagagcaacactgaagtgtataacaagagaccagtgcaagctttgatttgaaagaaggcactaaatatggattcacggcaacaagtactatcacatggaacacttaattatttttctttctctctttacatcttaagcaggcaaagtcaacttgctggaactgggctaagtttgggagtggtaaaaacaaaaagtcataatcatccagtgatttttaaaattctggtgtgcgtcagaatttcctagaggaatggttcaaaatatgattatctgagcctcatctcaaaactacctaattagagcctctcctgaaagaggctgggcatctgtcttttaaaaacctcattccaggatattgttctacttaacactattcaagagctgttagttttgactcacacttactatgtaccaaggatcatactaaatcacttcaatgtactacattaactaatgatcctacaattctaggattttggtattatttttatatctattttacagaaaagaaaaaaaaactttataacatttccaaagccatgtgaccagtaagtgatgaaaccagaatcacctgacttcaaatcacacacttaactcttatacaaactgcctccaaccatatggagtatagtgccccctataaatgtagaccgttgctgtctaagtagaacctagagatattttacaaaattcagtcccaaaatagtgctactatttttatttactaactgcaattgatgaggaaagtatatgcattgaaattcagtctttaggactccggaagttacacaaggctctatcagacgaaagcctaccagctatatcaagtgcctactgtgtgcaacgcttaggaaagttattctctggaagttgttcttttttttccctcaacttttcaatacaatgtttgagggtaaaattgctatctggggcaaagaatttctgcagatgttactgttactagaatgtgaacaatgattctatggatttgccactgctataaatacaccaactggaaagctttcaactcccaggaaacaggatttggaaagtgagacaggaatacccagctgagaaggtaatttaggtagacacaatgagaaagccttaattcctggcatatttctgttaacaggcagtgtgggaatggctttatttcacctctgagagaaatccaagcgatggattgttttatgagatgcgtgtgatcacaatgagaatttccagtttcctaaatagaacacttaacaagtgttcgtgaagcttccagcaggtcacaccattttaaatgcagcacacatagctcaacactgactctctttaattttgctttctttcactattcttggaggtacaggactaaggaacccactatgcctcacttaatatcatcagggtttttagtcttctcactggttttctgaagcatggatttttgcagttcctagtcaattaattcttggagcttcctttgtcacctggttgatccagctttggtagcactgaatttctctctagaccatgtgttctttatcagagacgttcaaaacacgttttctgaacaaatgattaagtgaatgaaagagtagatgcctcactaagcagcacatctcatactcccatatattatatatgagcagttccgcctgtcacaaagctcctccttatgttaggcatgacagtaacacgaagtcttcatttgactttcctccattagccatcattctgcctttggagagctctgcaaacaattcttccccaggacaaccattttagtagctgaaagaagttattatgaactcccaagtcctaattattcttccactttcttatcaatttcttaaataatatgacctctagatatatcacaattttgctcctccttctgtggagagagcttaccaatgtcgttattaaaaagtggcactaaaaactgaacacaatattgctgatgtgaacaagtggatggttctgcatcttaaatggggattatggcacctcccttttaaagctgttacatggaaatagaatgatggtcaaatgccaagggcacaacaatttaagagatgggactcaataaatattggtatttgtctcatgtcatcattatcatcattaccatcaccatcatcttcatattacctaagtctctcacagcctgtatagttgcaggtgttttttatttaatgtaagtgccacatactacatttgtaaatacacatacattgtttttccctttcagaaaaatttcaatacttattcttttttttcaatgcaaaaataaacatccgatgttttcattaaaatatagattaaatattagccagggaacaggggtcaaccttgtcctccaacatgacattattctccaaaccattatgtccactgcccttagttgctggtacagtttacctggcattagctgatggacttctgaaaatataatttacttttaatgagttgtgtgtgtttcatgttgtggataaccctaaacaaataaatgtaaaactacaatttgatgtccaaaaataaggaagaatgggatttgcctaaaatcagacgtttattaaataacaaggaaatagctttcagctatattaggtatcttaaaactcttaacattgttttgaattcactttgatgcgtgtctcactgttaagaaaagtgttaagacaagtgaagaatggtttgatgttaaatggatcatggaacacaggagatcatatttaaaagggaggttttcctccattttcaatatttcctaaacttaatctcttaagagtcttctcaaaagaacaatttatgaactctttaatggaaatgcattaaaataaaatgtggccgacctcttctttccttgtagcctcagaacactctatcagtcactactcagaacaaattagccaatttggctgtgagttacccacagtttttatcccttcactccaatagcctggatccctggactgcccactctaaccatgcaggcgggggattgtgtgtgagaaggagccatgcaagccacagggaagaggctgtaaactccctgaattgggagctaaaaaccctttgttcgatttggctctgtatatttttcaagatcatacatctacttatgatgccaatgaatcaatttcctcatctacaaattaaaggggatatgagacatctttatttgcaaagtctttctgtcgtacaaatccaacagctgtatattttccttttcacataatgactttagcatctcatggacaaacatctgttaaggaatgtaattgttttttctgaaatctcggtgtatggtttgcacaagtaaattaagacatttataaccagtataaccatgtatatcatttctaactgggattatatttttcagaaaagaaactaaacctcaagatttgcatgctaaggcagacagtgatctataaacagacccgaaggctctcagtaacgcatggggtctgtgggtccttactatctgtattagtctgttctcatgctactaataaagacatacccgagactgggtaatttacaaagaaaagaggtttaattgactcacagttctgcagggctgtggaggccttaggaaacttataatcatggcagaaagggacgcaaatacatccttcttcacatggtggcataaaggagaagtgccgagtaaaagcgggaaaagccccttataaaaccatcagatcttgtgagaactcactatcacaagaacagcatggaggtagccacccccatgattcaattacctcccactgagtccctcccatgacacgtggggactatgggaactacaattcaagataagatttgggtgggaacacaaccaagccgtatcaccatccatgtaacaaatcacctgagatactagtatgtaaagtattttccactcatttaatcaattcacaagcatttattaaacctctactgtctgattcaactaagaaattctgctgtcactcattagtcaacttagggtatgctggtgaatctctaagcaaatggaaaggcctatgatgactctcactagaattgacatagcaattattcacaaagttcacatatttttagcagtaagtcagtttctttgaccttttttacccatattatactgcactggatgagcttaagaaaagattatatcagtaataattttaggaaggctgctgtgtggttttgcatagtaagaaacgagttttccaggtatccctgggttcatcagctaaacttcttgaatcagaaaactaatttattaacctttctttttttcattccatggaaccaccccaatatcttcaactcagtaggtaatccatatataatttttgaaggaaaaggacaccataattttctcacatttaatgccttcacaagctgggcagtgtggttcacacctgtaatcccagtgctttgggaggccatggtaggaggattgcttgaggccaggagttcaaggccagctgggctacatagagagacctcatctctacaaaaggttaaaaaaaaaaaaaaaaaaaaaaaaattagatgggcatggtggtgcacacctttagtaccagcaagtcaggagtccgaggcaggagggtcacttgagctcaggagtctgatgctgcagggagctgtgatgacatcactgcatttcagcctgggtgacagaccaagaccctatctctaaaaataatgataatgataataacaaaaataataatgccttcacaagtatctataaaaccaagtttgaacactaccaatttaataagaaataagatgattataataaatgccacttatatagtgcctaccaccatttattgggtaacacacacacacacacacacacacacacaccacacacaccccacacacagaatctcatttaatccttagagcaactctctctggtaggttttataattcatatttaaagataaatagagacatatttagcgttgttcagaaaagaagaggcatattccatttcatttttgctaaaattttagttcaataatttttataatttaaaattgaaggattatataacacttaaactaatgatggacagagattactgacagaaggtaggagcatttacagaaatattcttatttgtaaagcaacatcacataggcaactataatgcttttgttctcgagcttccagtgtctttatcatagaaaaattacaagattgataataatttttcttaaatggctgtgaagactgacatccattgcagtgtttccttgataaataatcatcctggattctgtcaatatttccctttcataatttgatatacaaatggatgtaacttaagactttaagacactattactgtccataaaaagctcacaggtcttgcaaatagaattgtcatgtctgaatctcaaattatttcttcacctggtttttaaaaaaggtcaatttccttagctaaaaataactgagtgattaatctattcaacataaaacaaatctggattctgacttacttgcccatcctaacttcttttttcaatccccaatttaaatttctattaacactcattccgtaaatatttgtctggcaaaattcaagtaccaggaaacagcataatgcaaaattaacagagtagcactataaagaagcatatgacccaaacagctgcaactcaatgattatctgtcccaatgcccagttcctaaggggggaaatacaacaaaaacaaaccctcctacccaaacggcttccgagagtgtttaactagatcctaaatccattgctgagatttagaaatatttttaaatgtttaagggatatgaagtgatgccagaaaactcagtctcttatcaaggtatctatttcacttatgaatagataggaaactagtatgagaaaggtgtttcaggagtttaattgtaaaaaaattataagaattttttaaagtctgtacaaaattttgcttatttccgtgcatacttaacttataaatagagttactatgccatttatattccaaattgcaatgcttagcaagttaaaggtggggggggggctgttaacaattacagtatgtgtaaaccaagattgtctcatgaaaaatgcggcatatagtcaccctacttataaataaatttatgtaaaaaggtgatggagatattctaaacagaaatccacgagattgaaatatgatgaggtaaaaggaattagtgaagagcttttaacttttagatcgatactgggttaaaagtagaggtagcatgaattgatactctaagtgagaaggtaagaagggcttacatttttaaagaggggaaacgctcacaaaagtcaaggagtgggaattatacctggttttgaacagacaactataaaatggggttcaaataaagatggggctatttcagaggcacttcctaaaccaacatggcaagattatttaaatttcctgttgtacacttaaacaggatcaaacattccatttctttcctaactcagaagtattcttccccttgttatcactacgaagggaaatgtcatagattcctgctctaaatatgattcaaagtgaagtagctcatttgtttattaaaaatgtagggttttagtctccacaaagtggcaattttgttcatccactggggagaattaagttattagtttctctccctctctcccttcctttcccttcccttccttcttccctccctgtctttctctctctcttttattcagaggcatcaatgtctcaaatcttaagtttatcaggaacatactacttttgattccccacaaaggttgcatcttgacaagttcttggttgaactagaaatgtcgcagtagcatgttttgctattaaagcacacctggaggaaaagaacatcctctgatggtgcagctgtttccagatgacctccttgcagtgcaacaaccaaatgactgcaaagatgatgtggctgagatatggccctggatctctcctctccatgtgcccttctgtatcctaacagcacttccacactctcttctccaaggaatccccaccacatcccttctcactctttccttaataatgatccaatttatttatgtgaaggcccacttcctccccacagacagagtctgtagagaaaaaaaaaaactacaattaattccttatagggaaaacaacttgtattttctcttttatgaccagaaaaatagcagacagttttccttgtgaggcttcagattgatgctcaatgatgtagaaagagcataactctgccagccctagtaagtgccatgaaaatacttgaccttttgaggtagggcaggaagagaatgtttcttgagagggctgccaggcccctgaaaccaggaaaaagtcccagcctggcccagggagctgcttttcccttgcaaaccagtggagcagataaataactgggctaatgatatccctgagaaaggctaggcataatgactacattttctagaaactcattattcaatttatgagcaacctaagcatataagaaggctgcaccttttcatattttgtatctcattgttatattacatgttatattataataccattaaaaaattgggtcagtttctttcagatccagtcttaaaacctgaatcaatataataggtgtttgatttcagtcataaaaaataagcatctcttgggccgggcgcacgcctgtaatctcagcactttgggaggccaagacgggtggatcacaaggtcaggagatggagaccatgccggctaacatggtgaaaccctgtctctactaaaaatacaaaaaaaaaaaaaaaaaaaaaaaaaaagtagctgagcgtggtggcaggtgcctgtagtcccagctacttgggactgatattcgatatttctttaagtttcactatcctttataggttacctagaatgggtaaaaaggtaaaatgcacattaatgtacacatgagagttcactgctgggcctccataatgtcaagaagcatgagctgccttcttcacacgcccacagggaaagtcagcaactcacctgtcctgagctgactgacaagcagatctactgcaccttctatcagcagctgtgcaatctgtacagtggtgaaactgaggatatcttgtctggatttttcagacaggcctaggtagcaaaactataggactcactcatttgcaccagcctcttcgaactcagagctagggaccgcagcgtggaaaaggctactggggtgcctgcccatactctctgttttctgtttaccccttattttgtacttgtctttgcctgtgctgctaaacctcctacttttggtacagtgcactatgtaaatcaagagaacagatctcctggccaagaccacctcataatatagattagaggaaagatcaaaaatagtcatagcttttgaaaccacagtgcttctatttgaaaggctccaataagcagcagggaagagataaaaaaaaaaatggtgaagaaagggaacatcagagagttatcttactgttaaaaacctttcttctctgccttggtcttttcttgtcacagcccactcattttgcttccccaccttccttcttaactatcctcttcctctctttctctttctaactttcgaactgccaagagttaaaggaaaaggtggtccccttgtccaaaatgaagagatgaaacaaatttctggtactgatcaatggttatggtcatcactactatgggctactaatggttcttgacagcctagtaatgacttgcatatttaaagaggactcctttcagtcacttccaggagggcctgtgttttaagtattctcttaatctaatctgtttgatccatttaaattgacgatgtaaatttaaagatgattgtgtggaaacaagagaaggatcctaaccagactgcagaggtattgatcccaaggtcagggctcattagtagaaattgctaatggtccaagtaatcttccaagctcactgtacaatattaggtcctccataggaaacaaaacattacttttgtgtaaaacaacttgtaacaacaatagtaatacaatatacctattttaaaaagaaaagaaactacttacaattctactactgtcttaaattatataattttaatttattccctttcaatctttctcatatgcatgttatacatttgaaacctataatgcacaaataattgtatgccctgctccttcttaaatgataattacatttctaatttgatagtcttcatagtttttaaaagttgcatgattccattgaatgacatacaattcacatgaacattccactgttacaatactggacctttgaattgttttgaaagaactctgtgaagtatgtttgtgcatatgacattttaacatttcacattattcccctagaataaagtcccaaaagaggcattatgtgtcaaaggaaataactgtttcatgacacttaatacatgttgccaaatttcgcagcatagctttttaaaaaacgttgtgagcatgttctttctgcaaatcactttgctagactgtgaggcacaaatgaatgagtttaaaatacagtgcttcaccgtggaatactatgcaaccataaaaaaaaacatgttctttgcagcaacatggatgcagctggaggtcattatcttcagtgaattaatgcaggaacagaaaatcaaatactgcatgttatcacatataactaggagctaaacattgggtacacatggacataaagatgagaataatacgacactggggactccaaaaggagggagggagaaaagggctgaacaactacctattggatactatggtccctacctgggtgatgggatcagtcataccccaaaccttagcatcatgcaatatacccatgtaacaaacctgcacatgtaccccatgaatctaaaataaaagctgaaattatttaataaataagtaaataaatacatgcagaaataaaactgaaaaaaaaatacagtatttgccctgaaaatcatataatacagttggggaaataagacatacacatgtgaaaagagaactaacaataccaaccacaggaattcagagaagaaagaaaaagagcatatttagcagaagagggtaaagagttagacttttgggatattctgaggtttggatgagttgaggtagaaactattcaggtcgataaatagagtaaaaagaaaagaaattaaccattccaaggaattttctgtgacttaaaagcactatgtgattaaatttaatgtattatcctggtccacatagactccccaaggatctttccattattagtaatagttattctttcacctttgtccttgaaacatcgacttcccccgttccatttgatgtgatactgtggaggtttatctcctctgcctctaatcagtccttaacttctttcttttaaattcatcttcctccaaccaccaccatgagaacatttctcaaagttctcctgcagttttctccttctttatatatttctgtaggtaatgtcacctgatgacttagctcttgtcattacttcttgctgcgaatcccccaatctctattttcagctctcaattctcatttttgttcgcatacatacattttccactgcctcttacagcagtttaaactagatatcccaaactgaactctttctgtggtctctagataatctgaaagcaccacagttcgcaagcgtgtcatctttcaggtctctttcatcttcatagctcacactgaatcagtttccaaatttggtcccagcttcccagtgacttccaatttcctcctattgtaggtgatcaaaatctcccacctggactattgcaagggctcccccatctgatctgcttgcctccagcttcagccccttcaatctgtggtctacaccattaccagttgccttttaagagcacagagtagattatgtcacttgtctgcccaaggacttccagcaactctagaaaaccagcaaagcccaatccagacacattaatgtatccctcctggtcccttatggtttcaactcacactacttctctattttcatctcctcacactacaacctcacacacacacacacacacacacacacacacacacacacacgcactggactatttaaaattcactgaaaacagacaaactttcactcggccaaacctttattcctgcagtttcccttgaatgaatactctcatattctctggcccattgaaaccttacgcaaccgttaggtccaaccaaatgttatcagttccaacaatccttcccagacctctgtctccacaatctgaagtactattaacttcctgtattttacagcactgaatggttaattttcttgctgcctgtgcaactacaatgttccctttctggaggccaagttaataaattcaatacatccaagtgtgtttaaattttttaatctctttggccaagggctgaacttcctcttgctgtttgttaaatggctattggaagatctcttgctaaacctgaaagtatttaagatgttcaacagaatcctcattcacagatgtgaggaagaataagagatggaaagagaaaaggatttaagttactaatgatttttctttccaatcagccctatgacgtatcttcaaaaccaggccaagaattctcatcacttgtcatgacgagtcccttagcaaggatagggtgctgcacattcaagttcttgttttaggctcttgctcccatcccaggcccttgcttaggtttaaagtgagagctttaagcagggaagactcccaggttgcaagtattcctcaatcccatcccactgcatgtgatgctgactggagtcctggcacgctgtcacagatcctagcataaaaataacctgaggtaggatagaggggaaagagaggaagggaatttatgaccaaccctccagctttatttatcacttaccctgggaaagtactatgtaataaaaagggggggaaaaacaagacagccaagctatttaaagagcaggagctgaaacttcagaagcataaactaatgtttctaactaaaaacgggtgtggagcttaaaacttttcaaaaagtagatgctagatgcatatcttaataaaaatgaattttaaataatatttttgaatggactatcctacgctatttattaggactaatggttattcccaagacccgttctaacttctgatcattagaaggtaccatatttttccatttgcatagtagaggcaggatgatagtatatgtttttgtctgaagtgagactattaaaggaaacacattaaaatgatgaggataaatggtcatgtgtcatcaaggccagtccttcctgccattctttaagctgaattcccataaaatttagttttacctctttgaaaactatgtgtgttgttggactaaacgtaagaaaagaacaaaaccaaccagtgaataataaaggcaatgtctaaggctgactacatttggtatattaaaataaagtagaaaactggaaatacaagagtagtattcctttatgttttctaattagtcatttctgatgttttccctgaatttacacatcagtccattattccaagcagggacacacacacacccatcaataaattactattataaagagaggtaattgtctatatacaaaataaatatactactagttgcttatagttgcaaaggtaaatgtggaaattctcttcattttaccaattaccagctcataaaggaaaaataaagttaaaatatattctctttttgcacagactgctaaataattgactgatcatgattaatcaagtaaattgaggcattctggaaaaatgacaaatggcaagatttactgcctctggaatctacggcatttgctaaatataacttgcttgtaactacagataaatatctaatctaatacaatcgagttacctgcaaaccagagccacatacaaaattgaatgaataaaaacgtctcaaaagacaataaatactttctttcttccaaatgaaataaaatcttatgataggttttgaggagtacacgtagatgctaggagcatcagctttgcaggcctgcagacaagggttcaaatcttggctctaagcctctgattcctacctaggaaaatgagggtgatattatctatggtatgagattgttataagaatttattgagataattcagtaattgccatatagtgtgctaagcttagtgtctggcacataatacattatcaataaatgtgtcttatcattactattgtcattatttattaccactagtgagaggctagaaagtgaaaagtctaaccaatgcttttaacttcattttctacagaatattcatagaatattcatagaatcataaaacacacacacataatgcctactatatttggtacttgtctgtattcacttctatgacccactttaatgtatatgcaaccctacagtaaagaacactcccgggagaataaaaaagtgccctttatattagcaaaattttatgtgagttaactgcataaaataggatgagttttgtactaaaactcatcaattatttttcattagggtggctttttatttatttattttattttatgtttattttttttttgagacggagtctcgctctgtcgcccaggctagggtgcaatggtgcgatctcggctcactgcaacctctgcctcccgggttcaagcgattctcctgccttagcctaccgagtagctgggattacaggcggccaccactgtgcccatctaatttttgtatttttagtagagacagggttttgccagttggccaggctggttttgaactcctgacctcaggtgatccatcagccttggcctcccaaagtgctgggattacaggcgtgagccaccgtgaccggcctaggatggcttttctaaatattttcgtctatgataatttttctctccatgtatttatttattttcagacagtttgaggttacagtgagctatgatcgcactgtctggagtgcagtggtgtgatcacagttcactgtaacctcaaactccttggctcaagtgatcctcccacctcagcctccctaagtgttgggactataggcatcagccatagtgcctggcagtgagttttctaaacagagatttactaaaaggcttgtgtagtgacttggcaacaccgtaagtattttatttctaaactttgaatgcctttctaaatgtcacaggctaggtctacgtaattccctttacagcaccacatgcaattggctgtttagaaaatgctttttgaggatggtgaagagctctgtttttcattaagtggctttgaactttgagactgcaagtcctgactctggatttaccctttacttcactacataattcaattcaaacagtcaaatgatatcctctttctgcaacatgtgtgtggggggaggacgggggcggggggcggtgtttccccttacttatgtatctttatcccgtgagttcattttaatgaaagaactccagtcttccctcaacttccttattctgaccttgtgctctagtactaagtagtgacgccagggagaaaaaaggctggtgagccaaaaatggcttaggaacataattctctaccaagctgcagaaaataaatgacagggttggctgaaatccaaaggtcaaatatatacaggctttcttatgggaaaggaatgtcaaacctgtttaaaaatcctgtgaagtgagtttataatccctgactaccaaaattaaccatccagctgaatcattttaatatttccgtgaataaagtagattgattagcttttccagagttatgtgttatcagataaacaaaccaatatattttaaataaatccttttgacccaaatggcatggtggagcacaaaatgcttaaaagatgccctctggacctcctaaggtttttcataggaaaagtaaattagctagactattttcctttctgcacaatgcaatacaagctgaaataaaaatgtagctttctcttccttagtcttcttttttaatgcttctgaattatgttagaattttagagcttccaactggattaaaaattgattcagcagaatggtaaattacgaaaaaaaatctcttaacgaaaatacttgttgcactcagttaaaactgtcttttaggccgggtgcggtggctcacgcctataatcccagcactttgggaggccaaggcgggcggatcacgacgtcaggagatcgagaccatcctggctaacacggtgaaacttcgtctctactaaaaatacgaaaaatttgccaggtgtggtggcatgtgcctgtagtcccagttactcgggaggttgaggcaggagaatcccttgaacccgggaggtggaggttgcagtgggccgagatcgcaccactgcactccagcctgggcaagagagcgagactccgtctcaaaaaaaaaaaaaaaagaaaagaaaaaaaaaaagaaaaaagtgtcttttattcccaagctagcataagaatgttgaggtaaccaatgttattggggaaaaatctgaattctattcattttattcaagacctaggtatcccattgagcttattctactttgtggtagaaaatatatatatttttctaactctcatatcttcttaatagtataaacaagaataaataaaacaatttcaattttaagagtctccttatcattattgtagcataccatcacttgtcccctattagtttggagtcagtaatcatcacacaaaaaatatcaatatgggctgggcgcagtagctcacgccagtaatcccagcactttgggagctaaggcgggtggatctcttgaggtcaggggtttgagaccagccggaccaacatggtgaaaccctgtttgtactaaaaatacaaaattagccggacatggtggtgcacacctgtaatctcagctacttgggaggctgaggcaggcgaatcacttgaacctgggtgacagaggttgcagtgagccgagatggcaccattgcattcagcctgggcaacaagagagaaactccatctcaaaaacaacaacaacaaaaaaacaatcaatatgcattatcatgtatatccattttgttgcaacatcatcaacatatctatagaaacataagtgttagaattagctaaaaggagccttagagactatccacctgccttgtttctgaagtaaataaaatgaggtttagagaagttagtgattttctctgcattccagtccaatgtgatgttatcaatggaggaaagaaaaagtaccatgtactgaatattgtattaggcttttgatgacttttagcccagtcaaatactcaacgatttaataccaaaggcataaccatttcagttttatatagacatgacttaagtgtagtttaaggccatatatctggacaatgacaatattttttacagccaatgcatatttttgaaatcacactagaaaatgaaatgtattaatacaatttggataatatatatgtgcattaaaattcttaaaagcttattttattggtaccagtaataaaatcattatctgtgattctaccctggagaaggaagaagggtatgtcctgcaatgcactaaaagggcaggaatcatgcccttaaaatgtcctgaaaacatttttttcagccataaatatgaataaccaaagttgagggttacgcactaatggcaaaattatcagatcattgatcaaatgacgtgctattttcaggcaggcaataccataatagcaaagcaaagagaaatctaatttgcatctgggacatttaaaataaatatattaaagaagaactgttgagccagtccctcggccatactgctctcattctcagcctaaaactagtccctcagcctttagggggtgagggggcagcagtaggcttcatgtcacctaccactgtccttgtcttccccctaacctgtaccaaggccttcagtaaattcggtcatccctgctttagccaaaaagccaaaaactctactgatatcaactcatggatctcattctccaaagaggtcattagtgctcccattttgtaaacagtcatattgtgaatcccaaatgaatttcctgctaagataaatagatatagggaaatagttttggatatggatatgatatagatatacaatatccgtatattattttcctacaattatcatactacaactggctttcttttctatcattttagaaatttaaataatgtaaagacaaagcaaatagatgtatgcccataaagtttagcaatgtgctcatatatttttctaatttcctagaatatcaaaatatgaagaagcactgaaagaagaaacatctaccatatattgatgtatttcaaattcagatatggcttcatctggaaagcacactccctgtaattaagcaaaagtggttagtctataaccataattaaatttatattgtgttgtcaagttaaaactgtgaatactgtgtacaaccaggaaaactggatgggaatgactgacttaataaactaacttcttttaagaaatacaatgaacatagcttcctttcccttaattgtatttttaaaaatcatgtgaataatacaaaaatatctatgctacaatatgacagccctaaaagaacagaaatgggtgttttccatggcccacagggccagtctaggaacagccctttgctacaaactacatagatcatgaaactgacaagtgattgaaataaggtaatccttttattaacaggaaatgaatgtgttttgaggctctgcctttgtcatgattatctggctctatgtgaatacaggctctttgggaacctgatccaatttatatcagtggaatgagcctatcagagaaattcaagaaagagataagtgaattaagtttagaaagcactacactgctagttggtatatgaaccaagtactagaaagtcagtggggagaaaggaaaagtccatgaagtgggtaatgctagagctacacctcaaacaagttggtatttacaaggcagacaagatagggtggcatagttccttatgatgtcatgccatgacttaaaaacgaaatccctgccagtggtgaagagcaaatggctgttctctacaatgctccattcccctctaatctcaaggatgaatttggccatcctaattccactttatgtggtaccttaaagacatctgagcatcactggtacagcaactatcatattgcattgtaattgcctgtccttcacttgaaggtgggaaacatatttatatcacactgtaccaatgtccagtatatcttatacactcaaatgagtaaacaaattaatgaatgaataaggatttaaccaagacaacaaaggccttgcaggggcctctcttgtctgcaattcatcataatgtccactaaaaatctcagaatatccattttatacatggtcaggcctcggtactcctgagaggcctaaactagtacagagggctcctcaagagttccagataaatcttatttaaccataaggctcttttctgaaaaaatagtgtcacatcccttagggaagttatctaaactgaccttttcccctgggaatcctccagtcattggtctaggcttcatttctgaagatgctatgataggctatcatagatatagactgttaagttcactttcgttcacaaaaatacaggcatgaacctctgtgtactgccagcatgttccgctttaggatgccttaatatttttattcatgttttcttttttcatgaaaaaaataataaagtccatggtaatattatagactgtggtgtcagagatgtcacatggaatcttgactctgccactttctgtttaactctgggtgaattaactccctgagccacagtttcctaacctggaaaatggggataataatgcttactttatagaggtggtgaatataaaataagatgcacctggcataatgtaccaaattgatattcagtaactagcatccttaaagatgcctaagaagatatgaacctctttgtaatgcacttctagaagccaaccaatttttctcaacatggttggaaacaaggcaaatgttgcttctttttacatataagcatgataattgtgtaagcgttttaactaatgtgctgaccatagtttacagtgctgtgtaagttcaaaaatgtcaaacacattttttaagaatgggggaagtaaatacattcactgttttgaaatggtattttgatatttatacatcaaatgtagtattttcttaggtataaaattttagtatgtttatgcatcatcataaacagtgatattgttttgtaaatatcatactactactcaagacagctcagtcgtacagagtagttttattttctcacccgaggaccctaaattctataaactttaagaaagtacctgattctacagggaacccatgaaggaagtcaggtaaaaaaaggaaaagcaagaaaaacaacaaaccactcacctccatagcgcactcagcaatgcaatggtagttagcagatccaattaccagctactcagtggcactcaatggtattacttggtatggattcatctccttattttctgttttgcttttctctgtatactttaaccacaatctcctaaacctttccccctaggtttccattccatttattttcttgtgagttacactcctatattcctacttatgtccctaggaaaatgcaaaataattccttctattcatggagaaatatactatcctgatgattctatgaagttttcttatttcagttattgtacatcttccgaagtacaggataaacattacattccttgattcttctttttcactgtcagttctacctactatttaataatactaaatcatgtaagttagatgtcttactagtatttagttcaaaaagtcattttgaggtgtgaatatagaggaaagggtgttgaggcagagagagagacagcaatatggacaacatcacccagctcaggaagcaaaggcagcatctgaacttaggaaataatgagggtctgaaagtgctctgtcttaagtttctctctatctctctctctctccctcccatctccctcttctccctctccctctctctctccctttatccaataaggctacaattcagccagtagataatcgtagtggggtagcatcatgcatctttttcagaagacagagatcttcaaggattcatagcaagagaagcctggacatcctgcctgtaagacaagtcttgacatatatcaaaataaatttggcacctggttttactaatctgtaaacaaaaacaaacaacagtgtgtgtgtgtatatatgtctgcatgtatacatacatgtgtatgactgtgtgtgtatgccttaaagcttcttttctataactgggtaatagggaatgaataccagctattctgagaactctgagcctgctgattgaagattactctgagataaaatgcagcacaagtcaaccctcctggcccacaaaccatggtctttgattttatttctgctctgtaaacatcctcatatggcatctgaccctactgaaatcattcaacaaatacaagtcaatgattactgagactaagcaaaatcaacaagactataggtatgtttttcatccataagtgacaacaaaacaagttgtgtcataaagaagtcactagggatgattcttcctttgaaattagatggcaattatcttccataattggattttcttcttttagaaatttcctaatagatcctgaaaggtatcatatgtattacaggaattcagtaaaatgctacgttaattacacatagctgtgacttgaaatatttgaaaacagcgtgctgtatcttatatgagaacaactaaactaaaaatcagaaattaaaatttaagttacaaattagcatataatctaccagagtctctccaagccacagacagtgaacttccctggaaagcgaagtgttggcctcagatgatgggctgctctgtgctattgtgtcaataaaaataagacaacccacaactcagatcacataaacctaggatctgtctgattttcaagaaccaagatgattgatattactaaacaaatacccactacgcgcctctggcttcttctctcatgtttcttttagttcttagtaagcattgaaatgataggttattcattcctaagatgtcattatctgtagcaaccactgtcttgcagcctgcatatgcttcatgtcagatcagagtattctgtttaaagatgaccagtgattagataaaggtaatgtgcattctctcattacctctcatctagatagcggcaggaggaaaggatatcagaaggcagcagcactgtgagcctctctgatgagcagtggcaatccagttacagagaagttgagggctctctaaagtgaggcagtgccagaattcactttaccatttttatgtacacttggttttagaacttgttctagaaacatatattctaccattttcactgtaccagattgtgaaaagatagtaactgaagtacaaagtaaataagtatatacatgtatgaaaaactgctcagtaaatattaactaatataggttatgaaatagaatgcaatttatgattccattgtcaatatcaccaatgaatgtctcacacatgcataggaaaatttgattaagttcccagctcttactgatgaattgaggtaagggagtatgagttgggcattgtgaaatactttcaatttctaagacgtatctaaatagatggatggatagaaagacagacagaagttactttgtaactataaaaatcatgaacatatatcattatgcagaaaacaaatattcaaaatgcaatgtatcctattgcatacctattgtgtatactttcacaaattcaggtgacaaagctaggtcaatcaaacacaatatatttcatcactgcatgacttttcagagcttttaatgtgtactgtggatgtccactgactataagtagtcatatgaggcagaatacaaatgttcatatgcaaaaaaaccaaaaacttccaacggtcattgtagctcatatcctcattaaaatttgactctttcttttaagtcaagatatattgcatgctctttggagatcaaaaatggtggtttgtgattctgatcaccatggaacctctgaaaactataagaaacatgtctatttcaaacttctggtcctatttctgtgagttgatttggtaagctcgtcaagaagggagtcaaggccaggtgcggtggctcatgcctgtaattccagcactttgggaggccgaggcaggtggatcacttgaggtcaggagtttgagaccagcctggccgacatggtgaactctcatccctactaaaaatacaaaaattagctgggcatggtggcaggcacctgtaatcccagctactcaggaggctgaggcaggagaatcacttgaacctgggaggtggagcttgcagtgagctgagatcgtgcgactgcactccagcctggccaacagagtgagactccttcttaaaaagaagaagaagggagaaagggagttgggggactaggcacatcaaacacagttacccatgcccttcccaggtttagggttaggatttttgatacagaactctcttatcagaaggagagctccacaaggctcaggattttcagagtttaattcttgagactggcctgggcgaatctgtttcttgctaaattgaaagctgggtgtgagagtaaggaaaacggaaattcatcatgcaggtaagccttagaggcctgagggtaagaaaaagtttgaaggagttatttcagagacaatgagatagcacgcacccctctctctacccaaatacactggagacttgtactaaaggctttgattcctacacaaatatacattcccatgagagagttaaactttgagcttttattgatcatttcatatcctactatgaactgctttatgagatccatagtggagaaagcatttgaaggaacggatgcttaagagtagaaaggaatggagtagtagagagaagaggggttttgtttcccaaccagaaagtaactcaccctattgccttgtttggtgtgtactagctttgctttgtgtactccctggctctctttgccttatttttttacatacgggagtgtgagactgaaaattagttggcttcgtgaaacaagtcaattcatcttcagaaaaaaatctcaaagagcactaatgagtattttcaaatatatgtctcaaatttggataagtaagtaaataagtaaataaataaagcaaatggtagtggctaaaaacagctgtcttctaacttggccctgactaacttctagttagaatcataacaccatgactcattgaaactattgtggagtctaaatcaagtaaatgagatagtagttctgggcatctttgcaggttactctataaaatgaaagagttccttctgtggctttgttgattttgcaaggtctttccttggcctatcttctatgcattaaggatctttttgttagcaaaaaagttttattgttttcaaaatatgaaacaaatgatgctttttggaaagtttcttaattaccctaagcctcacttcttccaacgtaaaaattgcagttaatgtacctgcttctcaaggctgttttcaagattatataaatgtgtatgaatgcatgcttttaaactctggggttctacaaaagctattattagttacactggttttttgctggacttctaacattcacaggatgatagtgataatgggtcaaattccattgcatggaccatcaaggaaggacattaattcttgtacttgaagtagatttacctttaagcaaatccttccaaaattatgtattctatctgcctggagtgtggatcctgcttaggatattaagagaaagtatttaaaatcttattaaaaagtaggtagcatgacctttcagcatcatatgggagctatagacctaatcaaaggttatttagttacttagagaaggtgtattttgtttgattcactttattactgatacaggtccaagagttagtaaagtttcttgttaacctagtgaaatttgcctggtagagatacaaataatttttgtctagttgaaaagataaccccaagggttttagtttatggccctatagatattaactactcgtatctaacactgcaatcttattctaagatttattaaatggcctatatatacttagctctgcaaatgctctttaaactggccttaccatcttactggatctctaattaataaatgaataagctatttgacatgtgctcatttgatgtaggcaaatcatatttttaatgttttaaaaactatattaacagtgatacagaaattttgttgttgtagagataattagagtgggatttgttagatggtagaatatattctgatattgaaaagaatagtagtaaaaagtaaatgggaagaaagatggacgagtaagtagttagaaacaaagagtttctggaaattttaaattaacagtgttaaaatttgctttctttctatttcccccagggggccaacatgctgttagatagtttatgatgacaaggaatttagggaacttatttaaaaagtggatccttctaataattggaatatacactattgcaattgtattcaacgatactaaagtctcacacaataaacttcaaggtgcagtgccatttacttacactttatatctcagatgacggagacccagagaatcttggttgttactaaacagatcactcactgcaaatatgaacaaacgtgaactaaaatagagtattcggggttcttgatactgtgttaaacgtactgatcactttaagatttataactgggtaaaatgtgtctgcacagaggtccctcacagtgtacaataagagatggtaaccacgattccagtcataatctgaaattgttgcataagcttaaacttaaactttcagaatctcattttaattatgagtaaaatgaggatattggaataaattatttttttctttctcgggtgatattctattaaaaaaaggaagacaaaagatatatgattcaatgtaaaacttgggcaaaaattacttaaaaagggaagcagagtaacatatagtacagcctctaagagtttttgctgtgaatacctcttttaaactctgtttaattatgcattttctcaatcttatttggccataggataactcacttccacctcgtcttttcttgcccatcacctataaacatgtctatgaacatcaccatgaacttaaaactcaagttgtcagtaactctttgggaacttctggattaatcatctctgaagtcacttggaattctaagaagtcacttggaattctaacatcctattatcacttggctaacatcacaaattaccctaaatttacttagcacttactatttgtaaggcactgttctattcacttaaaagtgccaacctattgagatcaggtgacagtgctggagctcataaatgtcagccttgtatgtattaggatctgtaagattaaatatctgtgccatacaaaattgttcctggtaattatgcaaatgtggctacaatttttttaaagcacagattattataaattaaatatagacatatcataagttctgtagtgtaaaggaaaaagatgttcatgacagactgagaaaaatatgaatgggaaatatagtttgaaaattacattgggaaatgtatttattttcaaactactgtacttgtaattttgaatcaaaggctaactcccaacttctgctaatgattggatgagtcttacaaatacccttttccattttttataatagaatttttaagtgactataatgtacaaatccattcaataatcaattgaaggtcaaactacatgccagtacccgcatcaggtacagggatagaggtctcagaaagttcacagctttatgagcaagagagtgtgtacgatggcaatataatgaatcagcagtatggcagccagatgacaggagagatggtcaaggaaagcttccagggaaaataagtgaggccatagagaagtcattttttagagtaataaggaggtcagctgagggcatggcatgaaaaacatattccactagaactatttaaaatatcaagatgtcaacagcaaagtatctaagttaactcctttctcctgagacaatgcaaaggaggaggctctgctgatttcatgcactatttgcctgggatttttttgcatgattcttttaaggtgtcaagcactgggtctatgacaatgtagatgaaggaacatgctttggagggagagatttagcctaaacttttaaaggacttctatccaacccactcactgtccgtatagacacaaaaagaaagggacaagaaaccagattaccccaggtgtgtactacaaacatacaatagtggctttggttctgggaaagttcatctttgagtaagacacccagactcactgtttattttaatgtaaactattagagagaaaaatgtctgggagaaatgtactcaaaaagcatctgttgagaataaccagtcctatgaagtaatatttaaatgctgtgaaaaaaaattcacagagcttcaggtctcccattgcccttagtcttcatcagtctattcctatgtacacaagtttaaaatgttgaggacagccctcctaggaaagtctcactcagaattgacattaggtcctgtacctagcagcatctgaattcccagactaatcttaagaattcatggacctgatactcaaaactgaacattcagcatggtaatcacatgagatctcagggtacatatacttccccacccaatctctcttcctctcacacccacattaggaacatattgcacaggtcaggatggacaaattctagaggactctgggaatcatcttccgtattttgtttgtctgtttgttttcaaaaagtgacaagaggctataagccatggattttctaattttataactggttaagtccaagcttggaatgccaagagtcttcattctcatttttccagtcctgtttactactccagagtcaagaaactctgcacacggtggttgcttatgataggagtgaagggtagatgttttgacactccgtctcctgtggccacaatcaaagcatagcaagaaatttcactaggggccctgctgctcctctcactacactcctacctcatcaataacaacatctgtatttagtaataaacatgctaggaaaatgttaacgtgcttcataaattatatttccatttatttgcaaagaaaattgaagtgtgatagggtagaaaacatgttttataccacatgtagggaagcagtcagaagattcatgtgagcaacaaagctcaagaagattgtcagaacaaaaaaaatcataccattaagaacatgaaagactctacctttcagctctgagatggacagggccactgatttattcccagagttgttaataaatgaataaaaaaaagaaacagcaaatttgtggtaaagtatccctgactatgagccaatatactttgtaatgaccagaaaatctgcattttgaaaaccctctatgcagccatagaaaagaataagttcatgccatttgcagggacatggatgaagctggaaaccatcattctcagccaactaacacaggaacagaaaaccaaacactgcatgttctcagtcataagtgggagttgaacaatgagaacacatggacacagggaggggaacatcacacactgggccctgtcgggcggtggagggcaaggggagggagagcattaggacaaatacctaatgcacgcggagcttaaaacctaaattacaggttgacaggtgcagcaaaccaccatggcacatgtatacctatgaaacaaacctgcacatactgcacgtgtatccccagaacttaaagtaaaattaaaataaataaacacactcatcaacattaacagtaaaaaaaaaaaaaaaaaaaaaaaaaagaaagaaagaaaaagaaaaccctcaagtttcctgtggtcccctcaccacactgctcagaaccagaaagagtttaagactttgaatggattcatttcttagaaagcctggctgtacatctctatatttagggttgatttcttttattgcacacagtgagaagttgatgggaggagtgacgagatggctgagactcccctttcctaagcttttcttgcctttgtagagttgtaatgggcaatttcttaccacataatgagaaaacggacttgaatccatgctactcaaagcggactggcatccctgggacttgttagaaatatatatgctagggcgtttacctcatacttagtgaaattagcatctctgggcagaggactcaacattcagtgttgtgaccagcactgctttatggctacagcagtattcctcctaggaccatgccgccgtcagagttattttgaccctctctgggaagacagcaagcctaagtcaaggttttactctattccacaagagcttgttctctaatggaatttacaagtctggcctttcaagtacagtcccaaaaatggaatgcaagacacaggaaggcagagaggggaaaaagtctgagtgccaaacagagaagaatgacctctatggctaaattgttttgtctgcatcctgtctaaaggcaccaaaatttacagagaataaactaaaggaaagggaaaaaagtcttgtagctcaatgatctttctagtttggaataattttaaattgagcaataatctgagcatattttcagccagcatctgtctgtgttccacttagtttcagtctgacttttactcccctgggtaatcagcccacacacaagcaggttaggaatgaaaaaaataaaataaaataaaccctgcttatttcattttctgtttcccacatctccttttgtacatacatcaaagcacagcatgtgacagaaatgcttccatagcaccaaggcaatagatagcactttgtatagaaggttggtgtgtcttctgtgcctaggttcaaattttggctttgctacatactggctatttgaaatgtggtaacttactctctgtagcctatcgcccaggctagactgcagtggtgcaatcatagctcactgcagccccaaaccactggcctcaaacgatcgttccaaccttggcctcccaaagtgctaggattacaagggtgaaacaccaacctgggccccttgcttcttctaaactatcaacctaaccatgtaaaaggcagaatccctttgagaacctcatatgccatgcttcttcccatcacagggcctttgaatgtactatcgtagaagtcagcagagaaagaagagaatccaggcttcagagccagacagcttgagctcaatgcctggcttcagccttgctgtgtatatgacatacaagttactgagttatcctctctgactctcagttcccatatatgcaaaataagcataatacccattttacagaggtgttgggaatattccatgagaaaatccatgatttacctttagtggtactaagacttctaattgtctataacatctattggctttaatcgaatgttatactaacaattttaaaataaaactaatgaaatactttcgaaatattgtgtattaatttagtttatgactcttgaaacaaactccaagttttaatgaccaacaaaagagatctttagtgattaatcctgaatttaaagcaagatttctctaatttcaaagtccatacattttcatcttgaaatcaaccatataattaataacaaagataaggagataaaataaaacaatggcttacggtctacacattcttttctgtctaagatggcccacttgaaattataagcaatttaaattagaattttaaaagcatattctcaggttttaaaaaatcagctgtatttgctccagtgcttctttatttactgaaggaaggaggtcagtaatttgggagtcatagagaagctgaagtgtgtttccttcttaatttttacatgggctgaaatgttttcaagggctggaagacggcgtggtgacaggaagacaacgtggtgtgcagagagaagattgaactgtacatgaagaaatctgagttcaaactgcagttcccaccagctggaatccacagggcaagtcatttaattgctctgaagacataaccgcctcctctcaaaatgaggggttggcttagctaactgcataggctccttccagctttatattttgctggtcttgagaattgttagggaagatcacagtgactccaaaaagagaagatcagatctcctatcccatcaaagaacctatctaccgtttcagacattttaaatgccaaacccatacatctaataaaaaagctttttttctgaactctggtttttaaaatgtataacttcaagaaaaagataaatctgcgcaagaaacatatgacacaaatataatgcattttatcagcatatgttccatccctagtggtcacgtttattagagatttaggctgagccagggttggctgtgttctcagaagtacggggatgggtcttgcagaacctctgcactccggggtctcagggcagctagtgctgaaacgtgaccagaaagagtgaggacatgaagagtgccatgtcttgcccttaatgactcttggtggtttcaccagaaagacagagggaagcggtattcagtctggaggaaagaagtgggtcagtctccccacagtcgtaacacatgcatcacagtcctcttatgctttcatctgtcaggaatgggccttcatgttgttgttacactttgacctaatgaagagaaaaatgactcagaataaatgaatcttcccactaataaatgatttcttaatttcgtggtgccatgggcttttttgagaatctgaggaatgtggctcttcttctcccacaaaatacacataagcacaaaattgtgcacacagcttcaagggcttcctagactccttcatgcccattctcattcttcaggggctaacagggaaagaatccttcatctaaatgaaggaaaattaagagtttatgaaaacagacacaatttgagcacatcacaaatgtggtataagcctgtttttccatcaaatatgtcaagtctgaaaaaaaccgaagacatgtcttaatcaaatttgtagtctcatcagcatggtgccctgctcattggttacagtcgacactttgaatcatggtcattgagaaaagacagagtgggcaggaagagaaagaggcaaggaaaaggaatgatttaaggatttctgtggaaaatgttatttcaaaaaaatacttctgaggttaaagggaagcagaataaaagactttctagttaccagtgaagtcagagagacacaaatatgaatcctgctccttcctcatagcagctaaatgaccttgggtaagttcctctctgcacctcagctgttttctctgtgaaatggggttaataagagtatctacctcacagggttattgtgaggctggaaggagctaatagctgaaaagcatttagcacagtgcctggcatgtaagaagtgttcagtaagtgaggtatttatcaagaatcaaagctgtggcctacttaagatggtactatctgcaaaagtgccagccttaaaaaggatgtgaaaactaaaccaatttagaaaaaatatcatccttttaatattagaattatacataattctgaaaaacttaagattaattcacaaatcaaaaaagcttgaagaaagacaaaaaaagaaatatggtatttatccataaatataacattgtttctatttccctaagaggggaatataagcagtaatattaatattaaaatggagctccaaattaatggaaagtattcatttccagagatgactaaaaatcagagattagaatttctgagctttgctgtagactatgcattttcctaaactcacagcttagccacccttttattaattttttgttgttttccttacttggatgtttgtgtttatgtgttgcatgtcatatttatatgatgttttaaaatccatttgatctaaacaactcagaattctcttaaaactatcaacgacgccatttatcagctgggtatggtggctcatgcctacaatcccagcactttgggaggttgagtgggaaggatagcttgagcccaggagttcaagaccaacctgggcagcaaatggagactctgtctctacaaaaatttaaatattagctgactgtgttggtgtaggcctgtagtcccagctactcaggaggctgaggtgggaggatcacttgagcacagaaggttgacgctgcaatgaactgtgatcgtgccactgcggtccagcctgggtgacagagttaaactctgtccccctaaaaaaatgtcatttatcaaatggcatttatcaaattacaaataattttttgtgcatttaaaatagccccaagcaagcattacttctcacgcacccagacaagcaaaaaaaaaaaaaaaaaaaaaaaaaaaaaaaaaggcatttccatgtatggctgaattattactctatgtgtaaatttgtcttaacattagccttatataagtatatcttttattgtaaaagctaaaagatgttataaattataaaagcacaaaaactgcctggcacgtcactaatctatggagtataagctgccattttttgagtgcctagaatgagccagaatgtgtagtaggcactctatataaattatctataattctcaaaataatcatgtaaagaaaatattattaatattgccatttcataggtaagaaaattggggctttaagaggttatgtgacttgtcaaagggcatgaggctagtatatggcagagctgagaaatgacggcagctctgtctaaacttcacattctcatccttatcccattgcctataatgcaatattaaattattattctaagtaatatctaataaactttagacaatctcaggtaaagcattataagtggattttatctgggaatgggatcacccatcatactttgtatcatattttataacatttgtatgtcagttatttatattaagaaccatatcttacctaaggcagcgactgagtgtgaattttatttctgtgcagagtagacatctaaactctcactgaataaatgaacaaatactacagatttgaaacatgccatggatgatacatgattcctgacacctcacctcttccactcctcacctactttcccatctccctggttaagagtgagttcaagggatggagaatgtggagacagtgtttgcagtgagaaatcctgaaaaagggagaccataccaatcactagggcttcatcatactactactttttccacagagacttccttgtctgcccctcctgtgatgccgccagtattctaatctccaaatctaacatctgtccttatcaatgtactagagtcaagtagattggcatactgaatgttgcatccaaaaaaaaaaaaaagttggaaaactcatattctagttcagtttccaaccaagacagaccaagaactcacaaacaacttttggcatgcactaaaatctgcccctttctaaataaattgaagaaaggcagtgataggggaaagagctttgacaaagacagtaaagagctctatgtattacagacaatagcttgcctaagtatttgaggttgtagagatggtaggaatgaaagattcaaaccaacaaattgaagggactccccatgacctagactaataagcagtactgatcctaaggtgatgtacgacaatttcaaattaaatggttttctgagcagaccactcctatgttatttaaaacagggtatatgtgcattcataaagaatccaaatcttatccaaaagaagcaaaaagctaaaataaggaaacatgaaaaggtttttaaaaccaatggacgttgcttaagtcaatctagagaataattatgcctagaaattgtaacaagctatttcctatggaaataaatagattaatgcttcgtatttatccagttttcttcttttaaaattcattcataggcgttcatagagaaggaacttgcagttgtattgcaattttgagccagtgtgtcatgtgaacaattcaatttaggaatatactcatttagggaattaaaaaagcagaagttaaatttaacccagaaaattaagaacattatctctgaaataacattttccaaagctaaaaatatgccattatgtttattgagaagtgtttgatttcaaccaatgtctcaaatggttaccttatgcttcccgtgttattcattttattgggaaatggatgttctattcattgtccaaaggcttgttgagttctctttctataatcctcaggaattcaaagaagcctgtgagtcatcaaaactcatttccaaaactgagtgtgaaatttaatttcctagagattaggaaaaatatagcacatatctttggtctgtaaaactctggatgtaattttggctataggcaaagagtggcttaagtgacctttgaagaggatttctatgtgtacttaggatttagcctccaagagtcggcctactcagcctcttttgaaaagtattactgaggcagtcacattttagtcagtaaaatgatttttttccgaacaagttgactgctttcagaagtaggacgtggctttaagttaacaccaggattccacgttactaaggagaggcctcgatatgtctgttgcatccaggtgggctactccctgttctccagtcacgtctgtatccagtaagagctttccaactctttgtggcttatctaatacatctacgagaaaccagggagggttttaaaagctggcagggcataactctcacttacggaaggtccacaccccagccttatttttaaggccttatctttgatttcctgaaggggtggagctctcacagccttgcttttgtgttcaacttctgacttactccttgtgcacctataactttctattgtcaactgaaattacttgggaatcaaaggggtaaattgttttcagcactggataaagaaatttttgagaatgagaactttttctggaagcattctcctgcctgctcaaattttgttcctcaaatatgtgcttgctgtcataaccatgtctctgagcctccttaggagccaactcttgacagctaaagaaaaaaatggagcaaagagagcaatcttcctacagccctcgctgctgggggccccacccttctccatcgttcaacctcaaaaacttggcctcatctgtgaccctctcctgttctccgcaggctctccaaggcctgtagatttttcattatggaaaatggctctgacccattattaagcaatttccaccttaacctccctcctctcatgcctcattacaacatcgctaacatcaagtccaacattctaatattacaagtggaaaaaaaaaatgatctgagactgtgaactgtgagaactgtcgactgtggtaaattttaagcatgttataattctaggcctgaaaactaagagataacaaaagaaatgtaatccacagatgcccccttctttatgctgcctacctgcctttgtactctttctcccaaagtcatcttctgcatatccttttagaaacttgtgtcccattttcattttcccaatccatccacaatggcagcgaagcgctctaccatccttctacctgcacacccttcagtagaggtaaacctcttaaggagagggaggcaccagattagaatctacttcctcactgcccggtctgtcttccttggaaaaggaaaagggaagtagatattgaataagcgtaccattttacctacaaggcacacagtaagtggttgatccaatcaacacaatgccaggttgaacattatacacaagtcattttattcttgtgcagatgtttttataggaaagagccccagaaatggggttgcaagtcaaataataaatccacatgtaattaggttaaatattttcagatctccctccatatgcgctataccactttgcattctccctagaaatatatgagtgcctttgttttctcccaactttgcaatgaagtatgattttaagctgctggattgttttaatctcatgaaagagaaattgtttcttagtgtgatttgaatttgcattattataactgaggtgatcatatgtttaagggccatctgtattctcccttaaatttctgcatttggcagaaggcattttgtaatccaaagagctatttctttaccttcaagtcacactccgtgcacagcccacccatctgctgacctatgtaagaggtcaatgctgcttacacgtgttttgggactaaatgggggtggttgtggcatttgtgtcaatggagcaaaggacctagaaggcatcataattcacacagtcagtctttagttgatggcttggcagaagctgaatgaagtgtgtgaaggtgactctacagagcacagtagtaaggaggggttgcttcttctgtaagtttacatctcatgctattttgggatattgcctggatgacttgtcttctcctctaacatataatattcagagtgttttaagttgtataaatcttaagaaaagaaaaagggagaaaagaaagggaaatgctaggaaaaagttctcacatttgacaatgtgatttatagaactatttctaggcacatcttattacatcaaagtggcagtgtttatttttttacaaatgtgtaataataaggatcttgacaatgcacccctccctttcagattacctctagaaatatccctggaaaactttaagatgaggcaattgtggcataaagaacaggcatagagaaatgctttttgaagagtgtttgacataaaatttctattaactgttaataagcactttaaaaattgttctgttctcaaatacgtatgggaaatgccggatgaaataaagataagcaagctcttgtattgcaagaactgaaaaagcctttactatggggaggagttaaagtaatcagtgtcccccactataatttggctgcagaaaccccttctcccccaaaagcaatcaagagtctgatactgtgataatgctggaaaatgctgatgcagagggaaaaacatctaacaaggtgattccgatgattttttgattctgacaacaacatgcatgatattctcagtcacaaagcctctcagtgctcaggtcactcatctgtaaagtggggtactctaaaaggtcactttccatttttactttgacctataaggagggatgccctgcagaagacaggtcttcctgttagctcagccagtggctttcttggtccatttcaagggcactgttggaggggtgggagagacagcacttctatcatgccaagctaaatatcctgagaaagatcaggggttttctattataaaatataatagagaccttgacatgaatcctcattctgtgtacagatgttgagcccacactcttactgattaccacacactgacccatctagggagtggtttaccctgaggccaggtcactaagccagtcaaaatccagctcgctttaatttgtagtccatgcacgtaacaaacactggtccactgctccaggtcatcattcgaatgtcagtataaactcaccagtggtcccaagagttctgtttctttggcatttgctttctctggtattatgtgccattttacaacaacagaaatcctgatctgtcaatgtcactcaattattaacatttcctggggtgttctacaaaccccattaagtgggatttgctggaaaggttgatgctctgctttgccccttggccccttcaggcacaaacatggattgaacctacgacatgccaagcacctaccgagagctagaggtagagtcactgatggttacgcacatgctgttctttctgaatgctctgccacactctccacaaaatggagctgagatgcctcttcctccaggaagccttactgagcttcacctcctctcagtctggattatgtgtcctacccacccccagttaaacagttccttccacagatatcaaacattacccttatattcctacatgcctgcctccctccttgagggtatctctgctccttaagtgtgaagactaattccttaatcttcatttcctcagcatcaattgtagtgactgccacataggaagtactcagatttatgactgactgactgactgaatcaaggtatgaaaaaccaattcctgctctcaaagaccacagagaatctagttcaacttttctacatgactttaaaacaatttataatgcatttatgatgctttaaataaaaatcgcgtgaatacttccaaatatttttgaattataaacacattttcaaatttgcctttcattagaagataccaagaaaaaaaaaactgcctttcaaagatattggataatgttaaaatgttggtttcaaaatcacgtatggtccaagataccaagaaaaaaaaaaactgcctgtcaaatgtattggataatgttaagatgttggtttcaaaatcacgtatggccccatgcagagaagggtccagatgtaagaaagactaaaacacagctaagggagacaagcacttatgtctacttaaatcggcctgctttttcaggctgtcaactctcccaactctgcagcttccacatgccttgttaatgtgaggagaaaccaatgtgagacaatagcagtcatatttccagtttaattacagaaatgcaaaccttacatctccttaagcctcaattataaaaaaaaatgacaaggcacatgccatgttttctctgcttcttgtcaccaaccatcttgccctattataaacaagaacactccatgagtattcagagtataattctaataaactgctctcagtctgccagttacatctgcagaacacagcaagaagaacttttacgaatgtagatatagtagggtaggaggcacatgaaagagagttccagcttcatcagagcaaataacctgcagagtgtattttgataatagtcacataccatggaaaaaacattcaaaaatatatttatttttccttaaagaatgtaaacaggtcagctggctcgtacctctaatctcagcactttgggaggccgaagcaggaggatcccttgagcccaggagtttgagaccagactgggcaacatagtgagaccctgtctctacaaaacatttttttttttaattagccaaatgtggtggtgggtgcctgcagtcccgactacttaggaggcagaggtgggaggattgcttgagcccaggaggtcaaggctgcagtgtgctatgatcatgccactgcatgccggcctgggcaacagagccagaccctgtctttaaaaaaaaaaaaaaaaaaaacacaagatgtaaacagtaatatttctgtgctcagtgtagaagtaatcttctcacagaaatacctaatgtagacgacaggttgaagggagcagtaaaccactatggcgtgtgtaacaaacctatgtaacaaacctgcacgttctgcacatgtatccgagaacttaaagtataattttaaaaaaaggaacctcctctcattaataaccagcatatagaatgctgagctacatcactggatgctaatcaaatggattaaaagccctagcttatacgacattcctttagtgcacatcatcctctttaaggagagtacagttgatggcttctctctcccccttttcatctttcctgtttcctaactttagggagacgtaagctgctaggaagacagatcattgtttttgagttgcatggttcctctgtgctgccagatattttatcctgatgtgtttgtataaaaagggataaagggaaatccatcacaaaattattgttgctcagtgaatgccaaacaatacatgcaactgaaggaaaaaaaaaaaaaaaaaaaaaaaggtggcggtgctggtggtgacctagccctcattcctgttatgaatgggaaactgaagaaaggttaagaaaagcatttatccatccactcatccacccattcattcattattcattcaagaaaaaaattcagtagctatttaaggtttttagataatttctcaaatgcagataatttttaaaattaaaatctgggcagattaagacaaaaaaaaaaaagacccaccacattgtgccctatgtttaaatatgttctaaaaaatgtccttgtagaaacatctgcagcccacatagacattttcatagacatcttgacagcaaaagaacagtactatcgtttcaggtacttaggaacataaaaggcagtgaatatatcagaaatctctcaaattttgttttttagttcattgaagcatcaaggaaagaataagggatttggagtaagaacatcttaattttaaaacctaatccagtctaatcctatttattctctttattttgtggagctgaactgaggatcaattaaattaatgcatgcataaccatttggttcttgcatgtagtcattcacccattcaattgattgattcattaattcactcattcaacaatctgtacaatggcctaggtacagtccaaggtgctgctaggattctaagtttgagaagaaacaggcaagactcctactctcataaggttttttgtctattaaacagccaggggctgataaacaacaacactaatgaatttacaatgacacactgaagcgtgcactctgaaggagggatatgcttctacaagactgaaggcaaagaaccacacaaaaacagggatgtaggaaggactttactgagcaggagacgctttgtacctgagaggaaaacgagagcttactgggagaaggtgcgggggtggatgggggtggaacggcttgtgcaaaaacctcagaacaggagacaacacggtgattggaggaatggaaagaaggtcaacatacaaagctgggcagaaaagaagtgaaagtgaagctgaaggtggggaaggggtatctagcacgtacgcagctattgagcacttgaaatggggctagttcaaaatatatgggctgtaaatgtaaaatacacactttattttgaagactgtgaaaaaatgaaactctctcaatttcatacatcgattacatactgaaatgacattttggacattttgggtttgataaaatacattattaaaattaatttcacctatttatttttacttttttaagacgactcctagaaaatgtaaaggtacatacatgactcatatttttcttggacagtgctggtagtaagtacatgcatagccttttaagtgtgaaaaagggtttttgtcctgagcgcaatgagaagcattgggaggctttacgaagagagacaatgggatcttcgcagcttctgggtagaaaagagatcaaaaggcacctggaggcaatggagaaaaatgatctgtgtactgcattataacagtttggtttagggtcaagaagtagagataagaggagtggaaggatttgagagatatttaggaagaaacacatcaacaggctctagtaatgaattgagtatgttactgagaaaccccaaagggcagaaatcatgttgggaaaacaaagatacagagtatatggaaatatacaatttaagtcctataatagaggcatggattcattgcagtaggggtacaaagtaagaagcaagtgtgtgctttacataggataaaatattgctgctgcagcttttcaggtaggcttcattaaaaatcaacatctcatcaaaaatatgcattctggttttaaatatcttttacccagagtttaacttaaaaaaaaaaaaaaaacagatacataatgagtaacggctgtgcaagagtctgtggtagggctgctcttgaaatggaaaagaaagagaatgtttctttagtgcccactggcatgtgccagaagttttaagtgtttaatttatttaatcatcccaaaaaccttacaaggtcatgttactatccccattttagaggtaagtaaaatgaggctcaaaattgattgaagttccacgaagacagaaaccatttttattttgcccctccactctattcctaatgcccagcacactgtccagcatatgctaggcactccgtaaataaaggttaaaacagctcccaagaggtagagccaagtgccaaccttgcttatctaaatttgggatcatcatgctaccatttgtttttttaatatattggatagcaagtacatttaagttaaagctttttaaaaatagaattaggcatagtttatatatttatatgtggttaggctaacaggtatttatataagagccctttatctgtgacaggtggttatcctctaccttattgaataacaagaacagttaacacttcctgagaatgtactgtgtgccagcctgttctaagcactttgcttgtattatttatgcctcattctcagcaaccctacaggatagatactatgatttctctcactttagacactgggaaactgaggtacacagagctgaggcatacagaggttgagtcacttgcccaaggtcacatagctgtaaaggcaacaaacccaaggaacctaattttagaatctgcatcacactctcaacccctatgagacagagcccactactccatgagactctagttcttacaaagatctctctagcattagggcaaggtctgccctcttgccattggtccagcaccctctgctggggccacacagtgttgtggtttatcagggcacctccttgtaaatctagaaaatcattcaaggataaattgtgagtcagacatttggagagtcagaataaaatgagcacaaaaagagcctgtagatctcgtgtggatctcattccatgaaaagagcaaacttaccctgagtctttaaatgtccactagcaggaagctatcatttgtctatggtgacatcagatagagtagagaaaagaggtgaagaaagggacttagtaagttgaagatttcccaacagcagaaaccatggcattcgggtgttaacagtgaattcaagagacccttgttcatgaatggagtttaatggctaagatactctctaagcacactaggcaatcagtgcttgctaggagttcacataatgaacaggatggttacaaccagacatccaggcatttgatgtgtgccggttacttcaagtgtcaaattacttacaagttttcaattgtgatatgtaagagggcttattgctatgatttggaagatcagttgggcacatgtgggtctatatatgaacacttcacttcttccaatactttaaaattgttatgcacattagtagagctcctgaaggagcctttttttttttttgttttggaatagtcttaatattactgtaaacacttgagaacatgttcagtatctggccatttcatacaaagggacctcatctggtgccccatcaagacaatctgaagtgcaatcaagaactcattatgaggtggtctaatctgtagggtacctcactgcctataaactaagagcagcacgatgcttctctactgaatgatgtcatctgcagtcactgggaacacacggaggtagaccaaatgccctatatggtaagtggccacacgtatcgggtaggaaggattgcctctgcccaaattctaatataaatgagaaataaattcatttacaagagaatattatgcactgaaatgcataatttttcaataataattatgctagatagtcagatgtttatatcttttctttccttttttttttttttttttttttttttttttggagacagagtcttgctctgtttcccaggcaggagtgcagtggcacaatctgcctgcaacctctgcctccgggttcaagtgattctcctgactcaacctcctgagtagctgggattacaggcatgcaccaccatgccctgctaatctctgtatttttagtagagatggggtttcaccatgttggccaggctggtctcgaactcctggactcaagtaatccacttgcctcagcctcccatagtgctgggattacagtaatgagccactgcgcctggcctacatcttcttataatgactaagtttggaagtaagagaaaaaattgaaagccattctgtctaataggtactggaaaatggaaaaagaaaaaaagaaaaaaaaacttagatagatagattccagggacacaaaaccagtgttagcataaataatgacagcccagatttatttgtacttaaaaaggtatacaggtaaataatctcaatttaaagtaggaataacacttgcaagacaaattaccaactaccaaaataaagaaaggaagaaagaatgcatcattgtgctactattttttaatatatagggtagcaaattcaaaatattttaaaatgctacaccacttaccatttaatcattaataatacactatgttaataaaaatgatatatcttcatgtgacaattacagttgcaaatcaatacagaggtgttgtcttggtgactcaaatatcacaaaatgttgttgccttgggtgggtataatattccaaaattgggaataaattttggtaagtttataaaccaaataaagtataatctttcctcaatttacatcatagttgcatccctcaaacatttagtacaaattaaaacattgtaaaaactacatctttttgtacaagttaaattctgtgttctcataattataaactgaacttgtacttctgtggatttcttgggaatgctcagagtgacctagaactcaaagaaattttttgttatttgagactaccccatgcaatacagtttatctagccccttagttctgactaaatgtcctttctgttcctcctcagtccctagtatgaccataacatgtccccataaatatccataatcatttccccaccacccctagaaggtactgctttcattcaggactacagcttacaactcttttgtatcaaatttgtacatctgatctagaggaatgaaaaaggttttactactgaaggttggtattagatgagtcttataatcatttttcaccatataagttaagctcagagataagattcattcaacatgctttatttttttaatttaaagttaaagctcattgacaaaagactaagaaacaactgataataaaaagtgcctcctctccctttttctgaagtggtttctaaaagaaccactgcagggatgatgatgatgatgatgatgatagcactaacatttacttaaacagttattttgtgtcactactaaactatgtgctgtaaatgcaagaaagctacaaaacagacctccaaactcacttgtggagcacttgtgaagattagagatgatcaatgagaaataaactggcacatggtaaatgattaaaaacaaaagctatcattattattaaatcccaagctaccctgaagcagtaactcaaaaaaccgtgccttaccattatgtcagttgttcagtagttatttatttataccacagacaatatgtttcttaaaatatgcatgcaaataagcccatcagagcaaaagacttcctttaaatttgcccctttgtggcaggtaataatgacatcgcctcgcttggatgattaataaccagttgttatgaggactgtgcctactgacgcaaatacagcattgtatttgggccctgagttataacattcatttctttaaggctgattgactctgaacagtcacattatttgcttgttgagtttacgcaagacgtttttccaagggaggtttatttatttatttatttagtggcatttacatgtgtgcctctgacttcggggagaaaaaaatgaaagcacaatgtaagtagtctaaaaaaagggctaatcagaataaccctggatgttttttcaccatgttacctctgtactcatatcactatagccaatttttaattaaaaagcttttattttctttcaataggatagtaaaaatgtgcaactgcctgataagtatttgctcttagtatagcacacttttcagatatttttaaagaagtatcagataattaaaacaaaacatataaaaacatatcagctgatattattttctcaatgctcagtatatgaattaactgatgggaatatagagaaacaaaacaatttagaagaaaaatagctcttaagccatcaagtttcaaacatttcaaactcactggaattgtgcaatcactacgagtttgtgtgtgtgtttgtgtgtgtgtgtatgtttagggtaatacactttattgattcattaaaaatgtaagtacagtaagctggaaagtatggcaagtaaaacaaaaaaaaaacaattagaagatttctatgaaaactttacaatctaataaaattgaatcctttttttttgttgttgttctctccccaggcaattattttgctctgttcacatgtcttcacaaaatactttcaattttatttttccaccctcagataaacagattccttttgttcggcagatgagaaacgtaccagctgttagtactactatatccatccatttactaatatttaatgagaaaaaatttaactccattttcagcctttctttccctctgctcattaaagagaagcctgccctcctggaaagcccttacttgtcagcccagttcttgaattatttttaaacagaaagttaggagaaaataatacagtgatgaggataagaaagtgaaagtgctgcaatttttttttcttttaattttttttcttgagaaatgacagggaacagctttggagtgtgtgcaggtaacagatggaagacaaaaagagggattttaagatttgttgctggggcacatgtctctctaatcaagaaatcaagtaaagaactgagttattttatggtattattgtattgcatggcatgtattctttcaaccctgatgcctctctgggactggcccacactggccatgttctccatgagttatttatggtactttaccatttttagagtgtatataaatgctttaccttatttgaacctctgaaaaccacagggtaggcaggaaagatattatacccacattttacatatgactaaaccaaaaaaaaaaatgaaagcgggacaagaattcagactttctaccatagaatttggtggtccttctatcagctatacattgacatatcatatttttatacttaatttattgtgcatttgcttcagggctatatctttacacatccaaacatctaaataacctgtagaaaataaaatcagtgatttatgtgtttacaattatccgaatatttggtattcatatataacagagaaataattaactgcccatttcacttttcacctaacaatctataccttctgtactcttagaagtaacagcactgctcaagaatcactacggttgggggcaaggtgaggggctctgaatcccatttggaagctttcttcagaaatattgcttcttgtgcagaagtcatgggtcaggttttctgtttggttgatgacctgtctatacctacatttacacacacaaacatgtcattcatttgcatttaacttgtcagtctaaaacttgcttatttggccaggtgcagtagcgagcacctataatctaagcactttgggaaactgaagtaggaggattgcttgaggccaggagttcaagaccaaactgggcaatacggtaagatctcacctctacaaaaaattaaatatatatatgcatgatggtgcatgcctgtagtcccagccactagggaggctgaggcaggactgattaagcccaggagttcaaagcttcaatgagctataatggcaccactgcactctaacctgtgtgacaaaataagaccctgtctgaaaaaaaaaaatcatttttaagattaagaataaaaaaatttggatccagagaactaggacttcattcttcttctgtacattatgagctacctgaaaactggtgatgaatatgcttcctttatctctacattctctatttgtaaaatggggataataagagcacccacctcataagggcactgtcaaatgggctaatacacatgagtacttagaacaacatatagtatgcactcaacaatgttaactttttaacattattaagttttattatgttacagttgctagtgcttgctaaaatagtgctgacacatggtagtcacaaaataagtgttattgtggtatatgttaaatgaatctcagttttgccaatgtgtgatcttggaagaagttacttcaccagaaaaataagaatataaaacccacaataatgacagctgcctgacaaggctatcgtgaggaacaaatggaataatatgtcagaaatgctttataaattataaggtgtgaaataaatgctaattaccatgtttgttctctaactttatcctcacaaataggctgttctgtagatgcaattatcctcattttatagaggaggcaacaggcttaaagaggattatataactcgctcaaggtcatttagatggtttggaggaaaacacagatcaaaaatttggtctttttctggccctttaactccagtaccttctttactatctctgttccatacagagatatgatctccctacaatgttatttctgagtattcttatgcttttttttttcacaaatgccatttgaaaatgttgatgaaaatatactttacattttatggatattttgccatcgccaagaaatttaaaaaagagaatgtggcagcaatcccatggcagcaactaacaagttgaatcaatccaacatcctctgaacaggatttcatctttagttttaggttcggtatattaaaagcaagcatcttaaaattccacctgagattaaccttcagcatctgatttttaaagttttgagggtgtggttgtcaaaaaaatgaattactgaggttctgggtgatttcatagggatttttcataaaaaccaaagagtcataagatcttcctagagaggccagcccccaacctgccagtgtgctgatccccaaagacaagctgtcactttgcaaaggattcatactaactcttgcttaatcaggcagatggcatccttgttctgcctcctagtctctgcttccatttgtctcctagacatcaaatactgagtctatagttcagaatcttcttctgcctgtgttccctagtcaacctggaattccctgacactgactgactgacacctttacatccattgtgctataatattctaacacttcgctgatctttgctgcaccctctgcatccatggtatcgctacacacatcccttttttccccgactgagttacctatatttgttcctcctctgctcttttataataagtattggtaaactgtttcttccaatagaaacacaatgtaccaaactatacagtaagtattttccttgccctattgaaaaccgacaacccactctcaagtgagacaaacgtacatgtgtcatcagtgtgtgctgctccgccataattgttcgccatctcatctagatgcctccagactgtcaatgaaatctgaacatgtgggtccaaaatggaatctaatactcaagctgtggcctatccagtacaacatgtagcgagacaataatatctcaggatctgaatacaccccttctgttaaaatgcagcctaggattacactagctttgttcacagccacgtaacaccactgactcacatgaagactgaagacaacacaaccccccacatcttgttcacaaaaactggtagcatgccaggtcttccatatctttacaggacacttggtatttttcaaaaacttaaattcagtccttcatatttctccccactgaatcttaaacctttggtttaggtcaagtgtttcagcctgttaacaacatgttgaatttttaatctatcatgcacatttacatattcctcccaactttttgtgatctgtagctctgattaagcagttatcttgttgcttcttttaatcattgataaaaacgttaaagatactaaggataaatccctaacactttttctaaggaccactcatggtttgatggtgaaccagttatcaaaactttttgtggatgtctaactacagaaaattcatttcaacatctaggccataggctccctttttatttacaataatatcataaaagattttcccaacgcttttgcaaaaattaaatttttaaacaaagttatttctttagtaaccctaccaaaaataaaaataaattcatttcaacatggagttttaatgaacctattttagtttcttctgaacccctaagtctttcagttatctgtttaatgttttgtatgtaaattttattgggaggaactgggatttaccactttttatttacaagaattgggatttactgattttatttaaaaaaacagaattatcttcctcttattaaaattgataaatattttcaattactgtgttttttaaaaacttttaagttcaagtggtacaagtgtaggtttgttacacaggtaaacttgtgtcatgggggtttgttgtacagattatttgaaaacccaggttaagcctagtacccgttagtcatttttttctgatcctctctttcctcccgcccaatatgtgttgttcccctctatgtgcctgacttcaaaccatactacagggtgacagtaaccaaaacaacatggtactggtacaaaaatagacataaagaccaataaaacagaatagagaacccagaaataagaccacacacccacaaccatctgccctttgacaaacctgacaaaaacagcagtgagaaaataattccttactcaatcaattgtgctgggataactggctagctgtatgcaggagattgaaactggacccctttctttcaccatacaaagaaactaactcaagatggattaaagacttaaatgtaaaaccccaaactataaaaactttaggagacgacctaggcaataacattaaggacacaggctggggcaaagatataatgacaaagatgccaaaagaattgcaacaaaagcaaaaattgacaaatgggatctaattaaactaaagagcttctgcaaggcaaaagaaactgtcaacagagtaaagagacaacctacagaataggagaaaatttttgcaaactattattgcatttcttaccactttcacctcgtcatcatctgagctggttgtttctagtgtgtctgcaacctcagtgttcagggatatgaaaaccattagcggaatacataaagcattaagttggaaacaagtatcagcacagaatctctcttgttaacatgcatgaacttcaagaattccactctaagagaaaatgaatagatttagcattgctaatgttaagagttctgtctgtttttcatccaccagttgtctgtggatgttttactgtactccagtcaaatcttagttgtttaaataatgcttattgggttgtggattagccagctctaatgtcctgtccatctatgtctatcagccatttcaatacttgttagtaccaataccatggagtacgcagggagcaacattctggcaagtaaactggattttctttagcagatcttgtaaatgtctttccagttaaattgttgagccattggccagagccaattgaggaatcatctgtggttgggcctgacagccaattctgagagcagaacaccatgaaaaagaatttcctatgaccactgctggtgtagaaaagaaaaaaaaccaaaaaaataaaaaaactgcttaaatacactgaagacataattcaaaatttattctttgtttttaatatctttgtaatatttctgtaaagataaagatctataaaataaagaccacagaagatggagagaagttgagataactgtaaaatcttatctgttgctgttagtcttagcaaacacaatacagggagacatggcattttaatagcttcacatgtgtaaattctagatgatctaggcaacagattcaacacacaataccagttaaaattaaggaaaaaggtctcatttctgtacgcttgttggtgagtcattcattgcgtgggcaggagtgatcacccttacagaatttcttctagaaccataacctcagttggtgagttctgagagctcagacatttttctagaaactaaacagggtacaggacaccagaaccctagggaatcaatttacatttccaacttttcttccagcacccacaccaccttctccccaacttcttatatagcaaaggctctctggtgcctcttttctcttttccccttcatcttgcctcagacttgtgtgttggcctcactttcctagtgttgttttaaagtgactttgctttttctcatgtaattgacaggctaaactatccttgcgtctaacaaaacatcctggaaaaaactgcatttcttagatatcttattcttatcagaatgacttgagctttctgccaaaactacatttaacttgaataatgaattataaaatatgttaaattgacaaatgacactaattcaataaatatattacaaaaaagcaaagaaagcctctactgtattcttgagtcagtatctcatgaaactaataccaactccagtattttacaatttacaaagcactttcatacctgtattcttacttatcagcattactaatactgtattactattatcatttccattttacaaataaggaaattgaaggtttattgaagtaactggagacactgagaaagtaaaccccaaagctcatgaagccaaggtcagtgcattttatttagcatgacttagtacactagttgctatttgaaggtacccctagacattcatttctataaagaccacctacatttcattttctgactcggggtacctaagaggctgtctctcttactttcagaaaggttttgctacatggggacaaaaactagaagggatcttttctagcaaaataatgcctaaggttcaaggatttcttagtatgatattggtggtccctggcccagcccctggaatgatccctgtgtgcattcatttcaggtgttcacaggaaagtctagatttagtacaggctcacattttcctttcagtgtaggggttaagattttgataaagtagaagcaaattgctcaagttaaatcccttcattgttgcctttcaaatatacattacagcttcagaaatagggtggactttaggtaagaagggggagaaaatggtgttaggcagaggccaggggcagtcctgttgactctcatggatctgacagggaaaatcagtagtttctcattgtgaacataggctttgatgtctagcaaagcttgactacaatgttaccaaggctcagggacctcactcttaaaacacagaagatgttagtgtcttctacctcttagggtttttgtgaggaccgaataggctaatgaaggtaaagcacaatacatagtcaacttgcacatagtgaatgctcaataaatcctagctcttgctattatgagattttatctgattttggagatagaacagagacacatatgtttaaagaggaaacaagagagaacaaaggtttaaactgtctttgagatgggatgtgcaaaattgtctcccagcagaaagagttgatcatatcctctggaaacccgatctctggcaggcagattctgaggctgtgacatcactgattcttgttgctgtggcagcagccctgcagccagacaatacggttttacaacagaaccaggtccccagttggtctcctgggccaggcactgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttgacttcttttctttttttctcctttctctacttcttttggcctttaggctagaaagactgtttcttgaaagtattcaactattcttggaaattgcaacattttcctgcattctttctatgttgaagacacttccagactaagtttgggttctagggaatcttgcagaagatacttcctcccctgtagttaataagccatcgcttataccacggtattttgttgtttgactcacgtctccagtgtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatgtgattctatctctttactaatatacaaagctgtcttgaatgatttacacctactttccacccacaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtcaccctctttccccttccccctaaaatgaccccaagactaatttacagttgtgggaggtggggactaagagctcttgagtatctattttaagctaggcatttttcaagtttttttacttacataaccctatttagcctgccgaacaatccagtggaatagtactaatttatctaatttacacataaggaaatgaaggctgagagaacttgagtaacttagccaaatagtacagttggatccgaggctcagaattcccactttttccttcctacaaacaaacagtagataaacaaaatattcatgtaaggcttaatggcaggtggcatgagagtactgaatttcattgtatgtatctgcaccctccattcccccatcttttgccatttgtgctccatattccctgacagtgcaccaaaaacaataggtttaggtattctctttcagatatcttccaaacaagtgtgcataaaatggactagaaggcaacttgatagagcaaataaattcacgtgctcttctcaagaaatctgagaagaggtatcagatacactccttgcctgacccagtgtgaaacacaggacgcagtgaggtaaagtttggacttttccatcctcagagcacacacaaatccactgaggattaaaaccacacaaccaggaaaaaatgttaagttacagaaagagctctttaaagccaaaagtcatacagctcatgagaagagagaagtcactttgtgctcaggtgaacaggaaaactttaaagaaaagatggaataaggccaggcacagcggctcatctctgtaatcacagcactttggaaggccaaggcaggtgggttccttgagcccaggagttccagaccagcccgggaaatatggggagaccctgtctctgtatttatatatatatttatattaaaaacaaaaacaaaaacaaaatttaaaaaagaaaagatgaaatgaataaaaataatttatatatggaaaggacttaaggctattcaggtgtgtgtgtatatatatatgtatgtatttggaattataaactgtacattttgcataggggtgacttgattacagcaagggaaattaacctgcccctgaataggcctgtaaaggaaagaactaggtaaagaaaccatttagtaagttattacccaaatccagctttgttggtgataaagtgaaccaaggtgatggtggcagacagaataagaacaataactttcccagcctggcctgacacacattcaggcctgatacacacacaggctgtatcagcctggcctgatacagcctctaaaagattattctagaggctgatcccacatggtgataataaaccatttcaactgctttgtgaatgaccaaagatgacatatgtttaaggactttttttaagaattgagacactgaaaatacagactagccatttttaaaagtactcgtcaatatccactaaaaaggagccccttatattttcatcttccttatttaccaaagctagcttcatcagtataaactagaaaggtaattccagagtaataaatcttccatggagagctctctacctctggctgcttgataatgaatttaatcagtcgggagaacagccctgtcattatggattaatcaccaaagactgttttggtaagttgatgctgtgtttgcagctgatggtggtcacaagacacacttgatatttttaagaaatttagagattgaaggaatgctcagttaattaacaaccacaaaacacaacaaacaaaaaatagaaaccctaagaacagcataaacacagatattagtacctttggctttgatgaattcaagacagaattgactcaaaatattggtaatatttatcttcctgttggtttgtttggtttattttccaatccaattagggaattttaagccagtggattctggagcagggtgaattttcctaacaaacttacttacaatatatccaattagtaaagtgcagctcattttaaaaaataagcattttaattggatagttttattagaagaattttatgtttccttttcaacatggtatcaaataccataaagtcctcattaaactttcatgtatatgactccaggatcattaccacagatagaattaagtaaagttggctaagagtggtctagtcaattattctcctaaaagatattaaggatttcagatgagttaagacccactcccaaagaaactgaaacaagttaatcacttgacaactatatcaagttatatgcttaggctgggagtggtggctcacacctgtaatcccagcactttggaaggtcaaggcaggcagattgcttgagctcgaaagttgaagaccagcccaggcaacacagggaaaccctgcctctataaaaatacaaaaattagctgggcgcagtggtgcacacctgtagtttcagctactcagaggctgacatgggagagtcgcttgagcttaggaggcagaggctacagtgagctgagacagcaccactacactccagcttgggtgacagagcaagaccctgtctcaaaataaataaataaataaataaaaagttgtaatttgtaggttgactttttcaacagtatatttagaatgctgaatgaagaggtagactctcaaacctaaaattttcttctagaatatatttttttccaacatctttgtcattcctcttaagtttcactgattgcaatataagtttgtgacttaactgttaacctatcagtctagtatttgtggccaaccttaagcatctaacaatgtacaatttacattgtacctcaacggtttctgtctcagataagctaacctaagccaattttgcttgtcaatattttggtaaataatcatggtcacctgggattagagatagacagtagctatggtttgttcgcctacaatttcactatcaaacgttctgttctataaaagcaagtctcagactaaattctgctgaaccttccacatttgtttacaaacaggcacaaaatagacattgtaaatctgaggaggtctcactctctgttgtcagtcactctgacatttacctcataagcaatgttcatgcatttcagtcaagttcaaaagtggcgaaaggaaaagaaaggaaaagggaaagggaaaaggaaaaggaaaggaaagttcacgctgtggcagatgcaaccaacaaacaacaggaccaggcaaccatggagtcacttagccagtggaggccccagtgaaatgggagacaaggaccgatgatgctttgactctgtgtactaactgcctcaaaagtattgagcagctgggctagcagattctatatgtccttaatgcaggaggagtagggcttataaaatctctcctgtcaactaaataatctgaatacttgtaatttccaaaatggaaacttattccatatgtctattataattaccatgccctctattatgcaataggtagaattctaagatgacccccatgaaccatgaccaggtatataattctcttctcttgagtgggaacaatacatacaacttgcttcttatgaatagaatatggcaaaggtgaggggatgtcactcctaagactgggctattttgtatggcaaaagtgaagaaagtgtgcatatgtaattaaggtccttaattatttgactttaagttactcaaggaagagtttatcccgagtgagcctagcctaatcaggtaacccattaagaagagggtccagggcttcactgaaagaagaaactcaaagacattctccagttggctttgaataagcaagccaccatgaagtctatggattcgagaaagtgaattttgccaaaaaccacatgagttttgaagaggaccccaagcatcacataagaccccagccttggccaataccttgagtgcaggcttgtgagaccctgagcagggagcccagttaaacactgcatggtcttctaatccatggaaactgagataacaaacgtatgttgttttaagccactatatttctggtaatttgccatgcaccaacaaaaagctaatataaaaatatttgaagtgcttgaagtctcacttctgaattgtgtgcttcagatgccaactcacagccctagagcagagctcaaagtgaatctacacacacatgcaccacctgtttttttctcaagtaatttaaaatagatttccaccatagataataaaaaactctggtccacatacctggtcttagtctctagatacgacatcaccgagtatgagtgggagctggaagcactgcagatattgtttagtcttctcctgcctctccaatcaggtctacttctactaccttctccctgttatagatgacaaagtagagccctacaaagtttctgtggcttcctcaaggccattcagttgcagaataagactgaaatcttgtgtcctatggtcatcaattcaaaatgtttttatttcaccctgttgtaatgaagtcttcttattgtcttataatttctaccacaaactccaacttcatttcacaggttttaaagaaaattatcctgtactctttgtcatccattcattcattcatcaaatatgtattaataacctgctgtatgcaatgcgttgttctaggagctggtgataaatcagtgaacagaacagataaaaatctatgcctttatagagtttaaattctggtgaaagggaaataagaaataagaaaaaccactgaaatgcctagtatatttcatattgataagtgctcagggggaaacagtatatggaaggacatgggagctgcaatttcctggatttcaggaagatctcttgcagaaaagtgccatctgagtaacagcctgaagacaagaagggagtgagttaagcaggtatgtggaagaaaattgttccaggcagaaggatgaagaaatgcaaaggttatgtgtgagtagaaaccttggagtacaagacctagaaaaactgaaggaagcccagatggctgaagtagagtatgtgatggggagaatgggtctgacaggtaacaggaggccaggctttgtggagtttttactctcagtgaagtgcgaagctagtggagagttttgagcagaggagtgtctgggaaaatcagcattatttcttgggagtttcaaactagaaccaagtcagagtgttcatatagctgataacagtttgtacctttcctgtggaagagaaagctgcccgtcatctgcagagaaagaggaatgagtcagacacatggagagaagtagaggtcagaagccagaaagaattcagccaggtatcacacacatgctcctgttcctgttaaattcctattttggcccagcgaactcacttctctctttaaaatggccttgcccctcattttgctgaggttgagctcaatgccacctcctagagaggtcttctttgaccatattctaaagtagcagtatcaaacactctatctccttctcctgcctaagttgtattcatgctaggcatttatcaccactttacaatgcactatttatttgttcactgttttgttcccagactggaatgttcaccccatgagggcaggctctttgtccatctttgtcactgttttaccgccagtttccagaatagcatctggctcataatagatgccattttaataattttttagtgaataaatgcaaatacctaaaatccccatggttatttactccacttggaaagcttgttaaaacatgaattactggaccctctcttgagaatttctgattccgttttgaggtggtgcttaatcatttgaatctctaagcttccaggtcatgtccttgctactgatccatggaccacactttgaaaactactgttctatacctcgctagtttctgttacaattaagaagttttagctaatgtagatgacttgaattcttttttcttcaatttttcatatgatttttgttttcttccttcaaccataataagatgatacttaaattttgtcttaaccaggagatctataaatacaggcttatccatcccacttataagcatggcaaatggtgcttctcaaaagtgtcccccatgaaccctctggtcacctaaccgaagtcgcccccttgcctgtccttagcttgactatgttgtgcagccatttcactgaatctcattccagactaatgtttccatagccttcatgattttgcctttttttttttccctgcagagaatgtgtctgtttaccgcatcaccatcacctttgggaccctgtgcctttatgtcagcactggtgctctaagaggcttcttctttgctcattttcccagagccacattttccttggggcagcatcttcaaaacttgccactgaagtctcctgaagtctttctaaatatctattaaagttctcaggctaaacttaatgtaaaacatatactcacagtaaaaacttaatggctcactcaaatattttgccaatatggagccattaggaaagagctctagtaggtctcatactgttagagatgtgaaaattaataaaatactttaagtcttatttatgtcacttgataccacatgtcagcacattttctgacattatatcataatgtctacaatgaaaatcatggaaaattttggcttactacatttagcttgatcagtgctttgtagtttacaaagcactgtttgttgttctatctcaatagcaatgccaagaggtaaaccgaacaagtatccttgtactcattttccatatgataaagctgatgcttgaagaggtcaagggcttgaccccaggccatgctgatagacagcaagagtcacactcatatatatgccaagcatgcaaggcccttgccttcacagtctatttacaaaacagcctggaagaataataaatcaatcctaagaattgctatgaaatgcctttagcataggcattaatgtgcaatggatgtacagcctattcaatttcttcatgaatctctatagtcttcacaaggaactttcactagaaaaaaagacaaacttatctgttttatctcatttttttttaacaccaaggactatgagacagatgcaaaatcatttttgatttgttggttgaggattgactgaaatcattactaattattcggcacaagtgggttccaccagctgcacttgaagaacacttcaacatcctaaagcaaaataaagtagcttacggcaagtgatgagtgccttaattatgttattgctacacttactgcgatttcaaagattaaacttaatagaatttcctgagcaatgatggtccacactggatctgagggggcttttcacaaaggaaaaggagaaaatacttactaacctggctacagctagatctggcctccctactaaaatgagggttaccaggtgtcctacttcttcagggaatgtgctacttttcaacaaatcaccctgcgtatgggatccaaagtagggcagtaaaaatgtctggctttctgtgacatgccagattcttctcctctctctgactcactgattttccacacctttcagtgtccgagtttgaagtttttcttagactgaagaaacttaggattggtcaattccccaaacctcttcatttcctatagcagaatgtgattaaagaaaaatttccaccaaccaggcaagccaaattttctagattgtatatccacaacaacaacctcagctggttgctccaaacatcaaaatcgggggttggctgcactcggcaataccaccagccctgcttgaaatggtttactgcatgatgaatgctgaactgtcacctcttccagggagcctttcccaatccactacatgctccacccacccacccacatgcttggctgaaattaacttttccatttccctgtccttccacaacactccttatatacttctcttaaagtaagtataacaagattcctagtatcttagagattcctgtgggacaaacttcacaactcctttctcttctcacatctctccatgagtttatgaaccttcaattcatatctccagaacaggtttctttctcttcacttcgtcaaaattttattcatctcacagaattcaggtcaaatgtcttttacctggccccattcttcccatctccataaagttagtcaaaacttccttcatgatctctgataactatgaaatggacccagctgtcctatagaacagatgtttatggtttcttttaaataaacatagaagttgactctcccagtcttaaaacttgagaaagttacatttgtcttatctgagttcctttttcaggaaaccaaccattgggcctcctagatagtatcaaggaactgaaactttccagatcaccatctggacaaagagaagccacacccctcacctatcatgactgcctaactgaccacctgcttcctgttcaccaactcctcttccatacctctccctaattcctgttctcctcatgtacttacatttcttccctgctctacaaacccgattttagtcagtcaggaggatggatttgagactgatctcctatctcctcggctgcagcacccaataaagccttcttccctgacaataatcattgtttcagtgattgattttctgtgcagcaagcagtaggacctaaccagaacccctggcatttcagtaacacacatttctctactgtagcactaatattgtaattagtttaattattactttacatatcttcttcactagactgtgaattcatccaaagaggccaagcttaatgacctgccacagagtctagcatattatagctcagaaaggcataacagtagaagttctcctaaccaatctctacttaatgatgacttattggtgaactgaacattctctgtagcacagtgagtacatacacctagtaggcggtcttcaggtacatccagatggtagaactgcacatttgccaagggttagtatttttattccgtaacctgtttacatcacttttgttaccgtaatttccataatttgattaaatattattcaaatcaataaaatatgagtgttttaaaacagttatccctataagaaacaagcagaatgccttgtaagtactaataaacactccgtaaagactagtattattttcttttgactgcctgatttgatgtaaagaagacaattataaaagactgggcaaaatatgtatgaactctgcaattagattgccttgcaaccatctaaactgaaaatcgtatattataggtatggtttgagcaaataagaaaacacaaatttacaactggtggacctttgcttaaagaaaagctttaattgttctactaaaatagaagtgagtaaatgtacatttatatgttttagttaaaatagaatgtctattttaaaattatttaaaattcctactttgacattttgattaactaccaggaatataagagggattctattataattatgtctttcttggttgattcattcattaattcatctgaataaacacttgatgaatactatatttgcttttatactatttaatacacaacctgtcttatggcatttattgttgacatataaatgtggcacatagtgcttggcaaattaggtacccaatgataaaacactaaatgaatctggacctattatccctgctttgattttgttttttaatgatacgttctgttttgacacatccttgtattcaaaattggcaaattaaagattacagacacgttgtagataataaacataaatcatggagcaaagtttcatgaatttttcacatttttttgaaatttggagaggctattgtttgtatatctcacttgtcacttagtaacttttacataccggaacaaatttgatatatgttttttgtccttagttggacaacaaaataacaaacattatattttagaattgctcttatccttcgccatgtttataagaaacatttgacacaggaaccatcccaaagacatttggtgactgtcattcgcttcatattttggtagagagcatcactcaagtttagtaataaaaataataacaatgagcatatttgccatgtgacagacctgtgttaaataattatataaattatctctttctagatttacaactatgatagtactcactagagaagtaggtactaacagagaaaaaaattaaatcttagataaaaaaatttgctcaaggtcacaccaactaattaagtaatacttaatacataaacaagtattaaatattaagtagttgtcacttaaatccatttgatggattttgtcaatttatttggcaagacactatttaacaaaggtacagatccacagaagtcacagactgtggtatatgagatgcatacgtgtgatagggaaattgtcataattaatagcatctgtaaacattatccttaacagaaattttagagatacaatgtagtcctatatccaagagtgaaccttcagtcattcacagatctggtaacagggcatctgcgaactttacaattcactataaagtaataaatggtaagcactggccaggtgcagtgactcacacctgcaatctcaacattttgggaggttgaaatgggaagattgcttgaggccaggagttttacaccagccaagacaacacagcaagagcccatctctacagtttttttttttaacagttagacatggtgggcctgtagtcccagctactcaggaggctgacacatgaagatcacatgaatcccaggagttggagactgcagtgagctaagaatgtgccactgcactttagtctgggagaccgagcaagaccctgtctctaaaataaataaataacattttaaaaaatgttaagaattattaaactgttatttattgtattaactagaaactttcttgattcactctgtatgttattgagcacagtcttttgtagattgttgaaatttgatgaaaacacaatgagacagtctcaagcagaacagaaccttgcatcatgaatcatgggtatagaaggcaacattctctaattatctttgaaagaaggtacactatacatcaacatcatcatcattcaaaaagaacatagaagacagaactaaattcttctataaataagaaatggactcacttggccatcattgcaccacctattggtttctactatgctcatttcttcaagatattatagttgtattttgtcatgatctttggtggaatattttatattttttatttatgtatcagggaggttttgttaaaaaatttcaaggactggatgaaagcctttcgaaaccaaaaaatatttaaaaacctaatttctcattactttcacatttgggcatttaaaaatgtattagcttttacaattttttcccggcattttatcttctattgcaattattgtcttttctgtggtcagatgagtcaaggctttacttgtgtagattaacaactgttacttataatagcacttgtaatttcacaaggattgcataatcaaggtcaaatctctttcctaatgcctgccaccacttctccttaagtatatagagttcttctaaatctaagtgatatagtactttcttataaaatacatttctaaaataatcataaatgacatgccactattcaattcctatagtactcaaaaattcaactcttatagtacttttgatcctgtagtgatgaaaagttaattgcaaatagtacggtcattaattgctatcacctttttaagagcgagtatgttcttaactgtttctgcaaatagaagatgcaataggaataatcctagtctcgaggaggaaactccttttttctaatcaagttttataaggaacagtttttgagacatactactgtaactctgggcttttctccttctccttcagtgatcagccacacttaaagaaagttgtcttgaatactggatttaaaacattcatttattttttcctacctttctcttttaatctctctcaaatcaccatttttcaaagtatctgttttttggaaactgtatcaattgctacgaaaagacagaagtataaatataggtgaggagatttataataaacacgggataatgataataataacatcaatataatgtaaaagttatcatatcaacaaggaaaaaaatgtaccatgaggagcaacataaaacaaagtttaaactttggcaggctgaagccaaggaaacttttgaacacttaatataccatctttcaaatgtctttctggagagcagtttgctaaagtgtactaaaaaaagttttaaacttcatgctttttgattcagtaaatccccttaaaggaatctattttaaaacagaagcttggcaaatataagtgtaaaatatgtaatgacaatggtttttaaaattaaaatagtcctggaaattataaaatgtccaaataaaaaaaagtacacaaaatgataatccacttgatgatagaatattattccaccactacaaagatttgagaggtagaaagaacattcacaaaaatgtaaaccttctgaattataataggtgattttcatttttatctttataaatttttaaattctccgagttttctttattgaactggtattgcttttgagctccaaataaatgctactatgtgttttaaaagaatatctgatagcatggagtatgcttacaatacaatcaagatataaagtataattttaattttgaaatataagtttacatatgcccacggacaaaaacaaaaaggactgttaggaaatacgtggaaatcttaaatgactacctgttattaatacagctggagataatttatattattttattttagtttagatattttccagaattttataatgagtctattttactttcaaatggtaaatgtgtgtgtgtatataacagagcaatagaagtcaatgtagcggaattcctttccttggctcaaacctgaggcttcctctcagaccttgggacaaaggtctgagaaataatatgaggcttttacattatttaatctcaccaaagaatgaatgcatgaaaaataaagcctaaagctattttagatcaggatttttatttaacatcaagtaaatgaaaaaagagataatgaataatgggactacccttttatgatatacaaagcaaggtattgggtctaattacttgatgaaatttaaaaatcaaaaaaaaaaataaagggaaaacaatgcagttaagtttccaagtatattattaataaataattgtaggaaaagtcagtaagtccatatattcatgtacggaaacagaacccatgatggatgagcattggttactcctcattgctggaggttttataagcaaacaggccagttttcttcttttgtggctttgtgagttttgccccttgacataaataatgtatccctaaaataccatgaatgacaacaaactaccattttgtcttccttgtctatcttcagtatgtggtggttctactatagcagatcacttcaacccaaatattatctttaaactctccaatggtgtacacttgaataaagagaaactagaatatcttaagtaacttggatcctaaaattcacagagatcaaattgtacatgagcataacaacctttatgaagatccaaagaatgaatgattcattggaaacaagtatgttccaaaggctgacctcacagagcattggacctcagaattcaacctccatctctgtctttctttccttgtattttatttaggtttattctgtagtaatggtatttccagggtctacatctttacttggatattttgttcctctttgtgtgccttctctctagagaaatgctgcaagtatagatcaccaccttattttagcttcccattactgtggcatgtagaagagaagcaaaggagataacaaagaaattgatatattctattcacacaggggtaggatgggaagatacaagcttttaatgaactggctaaagtttccaaaactcaaactttttttttccataatttttgcaaagctaattgaaaccagatacaaaacatcgcagacaaactacctaagagtaccttgattattccttctgcattgttctcactgttatttatctgaagaaaggggcatcctagacgttatagctatattttcataataaactatctatgctaattatgttgaactagacttatcaggaggatattaacttggggtacttaagaattagttgtggtggctcatgcctgtaatcccaaaacattgagaagcctagcggggtggatcacttgaggtcaggagtttgagaccagcctggccaacatggtgaaaccctgtctctactaaaaacacaaaaattagcgggtgtggtggcatgtgcctgtaatcccagctactttggagcctgagacatgagaattgtttgaacctgggaggtggaggctgcagtgagccgaaatcatgccactgcactccagtctgggctacagaaagagagactgcctcaaaaaaaaaaaaaaaaaaaaaaagaattagttgagactgatgggctactaaggaaatctctcataccagttaatcaatttagctactttgtatctcaaattggcatctctaaattgtgactgaaaagtatataatcccttttcaaagcaagtcatggtgaaaaatgttcccacttaagccaaataaacaaatgtttatgccactgatgagtagtgccccttagaaatcatcaaaacccgctttagggattagggcagaacatttgagagtataattaaatgcataaaagtgcttaaacttgaattgctacaaaatatagaaaccatttggaaatgttttatggatcacattaatgtgtgtgtgtccccgtgaaacataagatatatagttgttgttgcataatgagttctgacagcacgcttcctagaagatgacgttcatctgagcagtatcttacttttcattctacagcattgcaaaaagtgactaatgatagagaaaatactgaagagcatctcctttgatactaacttcaagcttctaaaccatgagaaggacccatttaaaacgttaggctcatttactgatgagagtggaccaaagaaaatcactctatgcatctaagcaacagtatgtagtgtcatcactaatttatgtcctttgggtaaacgttcttgttaaacacactggtttttgacaattttgttggaaattttctgtttataaatttcctcttttattcagaagcttggaccaaatcaaataacgcaaagtgaacaatgctcttttggtgatgtgcaaaacaaagagaactctaaaacattctgttaattttaataaacaacatgacttagaaaaaagtaaataaatcaaaaagcaagtagaatccaaatacccaaataacgggtgtgttagataaaactattaaataggaataaaatcagataagaaaattgcttaagaccttgagcctgctgtgaaatatttagtgaatctagggaacaaaggataacataatgaagctaaagtttaggaaacgtaagtgttcacctatcacactgtcttagaaatgtgtatataaatacatacgtatatatgtgtgtatacatatttacacaaatgtggctatatattttttgcaggtttttatacatatatttgagtgtgtgtgtgtaaataaagttcacagggatggcctgaagcttaacctaaaatatttctatttcaaagttgatcctatttataggcgtatttaacagagaggctatacggacaatttgtagagatcaatagttggctgtatagaaaggattttttttttaccctttataatgttgtgaatccctaatccccagtctcacggtaagtgtcctacatatttagtagagggtgatatgaacattcaattcttaaaccctttggtgccagccttaagctatcagtttgcaatatttcatatttacaatctaatctaagcttccaggattttcctcactctgaaagataaaacagacattttaaaatatgtatcattaattctaagttttagcaaataaaattgctacactgagacaaaatgtggttacaaaaatcattgtgtcagttaccaaaaatcccaagtctaccacttagactacttttatgtcccaccaataaaaactataaccccagaccatccaactgaatgagccacgaaaattacccccattcccatgttactgcctttccaattcccatgtcactccctttccaattcccatgtcagttgtgggtctcatacctaggtgtggggaagcaaaagaaagtttaaattatgagaaattgttttcagatacttttttttatgatggacacttaaaaatttggggaaatatatatatgatatatgatatatatgatatatatatcatatatatcaaagaaaatcaatgttataatcagccagtctccccaaatcaccaaagctaataaaatattttcttccaatttatagacacacacacacacacatacacacacagtgaatctggtattctaccaactaacatgttataaacattttccctcctcattgaaagttcctcaatcttcctttttctaatggctgtataatattccataatatagatatgttgtaatgtattattaggcaattgtaatggaagaaacattttactagaaaatctggattacacaacctagtcactgtagtaaagtaagagcattagtagaaactgtaattgttttagaagcttttagaagtgacagattcacctatcgtttcccgtactcttcaccgacattccttaaggagcagattctgttcagcttgcaattgtcacttggcttggaatcatataattatttaccactttttttttaactttcaattgtggataaaatgtttattaaatgaggctgattcacctcagctccaaagtctgtggcaatttctcacctgcttcctgctaattattctaaatagttacagaaacataattgtgattcaagtggttctccaagtagagtccctggaccaccaatttcagaaatacctgagaatttactagaatgtcaattcttgcataccatctaggtctactaagtcataaactctgaggatgaagttcagcaatctgtattttaacaaacctccaggttattctgatgccccctcaacttgaggaaccaccatcttatcctatagacagatcatgctgttgaaatgtgccattttcacatacacatagtccacagaggcttctgccatgttttttttaacaacccgatatgtaacttttgtcccagcaacattttaacatcaggggactgcatccatttcaatctgaacacttttgtccaatcactccaagtgagcttaagaaaatgtagagtaaatttttttaaaagatctgtgtacccaatttgatagacattttatcttattttggcatttctattctcaggtagcaaattgcctgaaagggcaaacaataaatatgggagctaccgcatggctctttgtggatatatttggaggcagtttaacatgctgtggagatgtttctagaaagattactgacaagatcaaccattttatgaaagttgcttttattacctttggattttttctaacttgaaaaatattgctcttaaagtatgcttctctactaatccttcctgttgagcattctattctccttaaaatatatatatatataaatatatatgtagatgcgtgtgtgtatatatattacacacacacatatgtctgtgtgtatgtgtgtgtgtacatatgcacactcacaaataattaagtaattccattctgggagaaagactttgaagaaaagcagtttatttgctactcagaaagggaaagtgatgttcgtgggacataaagggatttgaataaataggaataagtgtccttttaaaagaaagcagcatatggaactagaaatactttctggaagctctaatctcctatttgaagaaaatccaattgttctggctggtggcaaactaggagattacagctgaatttctctccctccattcaatgtgaagtaatcatagagccataaggaatttgacaggaaccataaatacttctcctgtaaatccctaaaaatttataagagcattatgactttcatgctctttctttcctagagtctttacttcaaagtcttctgagactagaagagcccctggagcaatcattctgcttccatatccacaacttggaactcttagtcccagaccctcaaattatagaacctgagggaaaatttagggggcactgaaaccaaataccttcacgtgtcagatgacaaaataaatcaggtagacaaaaagtgttaaccacatcacgcaaagaccaaaacccaaagttccacattttcaggcagagccctcagcctcatgtcactaggcttcatttctaccaatatcgccccactgactaaatgtcctttgtcactagaattgtttagttctgcataaatacaaagtatcgatgatcaaatttgacttatttcttctcattcagtccttaagtggaaacagcaaaatgctggttgccttctcttaaaaaaacaaacaaacaaacaaaataagaaggaaggagaaggaaggaaggagaaaaataaaaaagaaagcgagaatgaacaaagagtgaacaaatgaaccaacggaagaatgaaaaataaaagaaagaaaaaagaaaggaagagaggaagaaagaaaagaaaaaagaaagaaaagaaaaagaaaaagaaaagagaaagaaaaagaaagagaaaggaagcaagcaagcaagcaagcaagcaagcaagaaaacctaaagatctttatcatcacatttaaataagagtaaatctcaagaggccatcttatctacccgttcccactaggcattactcaacagagaaccaatagctaggaacttcctctattcctaaagattttcaagaaaggaagagaaatatcttgggaagtttaggaaacataaatatttaggctcatttattgatgaaagtgggcaaaatgaaatcatcctatgcatcttagtaatactatgtggtatcacaagcagcttgacataacaggctggtatcaattgtcatgggtaagtgctaattgctgaagatctaccaatttgctgtgtgcttttactaaaaatatctttgaaagttccacagccttccaagattttgtattccttgatataacctttaaattgccttcttcacattccctcttgtttgttagtaatgaaatgccaatgatcacagtaccggaaaaaagaaaacggagaagaggacaataaaaaatcatggttatgatttgtggagcaaaggagggctttcagcattaatatttacattaatgtttacgttaaagtgggacagattacactactttttactcacttcacttcttcttaccctgcatagagttaaatacttactgtttgtgccttgtaagaactctaaagattatagtgtactagtaaatctactttattttgctggcaggagtcagcagacaaaagaggagcaggagaaatgttgtcaaatcaatagtgatactgactgaattttatcagtgtttcatctttagctgaactatatgaactcattcagattttaaaaaatatgtaaactgtctaatctattttatagctccgttttacagagttataacatgtcaagaacaaagttacaaaatccaaaacatacaagttagcatcacctctatttttttctgaaaattccgaaagtacaatgattagaacacacttcaaacctcacagctctgtattacttaggaaaaaaatcccaacagctatccagttgtgctttgaggtcatttctcaaagcatgtgcattaagaaacttagcaatctatgtttatggttgctttatctggtagtataatacaatgaaaatctcacatataaaatttataatgtgatatttacaggttcaagggtggaattgctatgttccaaatgattttctgtcatcccttagttcactgtttctttaatcctttaaaacaatctgtacagcctttgctgtaaaagattattacattcttatttccactgtgtagtcataattttgaatgtactctctaatttaccaacattgtttccaattccatataaacccatatgagggtgctcccagcaaaactaattagggggataactgtgtaatgtgaaaaaataaagaattggaatattatccttgtgtcatttgatttgccaaaattcagcttgtaacaattagatactacagttggaaaattagtgattttatttatataacaggatctgtcataaaagagccaaactggcaaaatcactaatagtcataacctaaatcacccaatcaaccaaaatattataaagttcagcttttatttttatgcctattacccttttcatggcaatgggttatttcaaataccccaccacaagccctgagaacacagctgggttacttgaaaccagtagctctaaaccagtggtgacttgccccttaggtgacatgtgtcaatgactgaagacagttttgcttgtggcagtctgggggatgctactgacattttgtgtagggctcaggaatgctgctaaacatcctacagtagtgcacaggacagccccccacaaagaagaatgacctgggctaaaatgtcaacggagcttaaaaaaaggttactagtctaagtgagcttaagttgagaaaccctgcactaacattaagaactatgtgtccaacacggttgcaacatgttacgcaaacacctgcattttgtggggtggggggtgaatacagccattctagggagagtaatttgttctaacttgggtatttctgcccaataagctagtaagatatttgctttttctaacgtggattcatcagggcactgaaatttaactattttatttaaaatatggtatatactatttctttgtggtttttctgttagtgtgtgtgtgtgcgtgtgtgtgtggtgtgtgagtgaatttctgaaacagagcggtagcaagcaaatggcagatttggttttatcatcaagtttctgttagacatttcgataagattatacagagcatatagtggatgcctactacatatttattgatttttgaaaataaagtttgtgaacctatttctgctatcttcctctttagagaactgtgattgcatttttcttctttttttctaacatgtatagagtgcctgttgccatagtaatcactgatttagcacaacgtgttttttcctccttctttaaaaaaaaattagttcccattcctgccaaaaaggaacatattaatctacccatcatgctagcttggggaagttgaaggccacagaagttgtcatttgtgcaaagactcccagaaagtcagttgttagcatcttctgtgccaagaactctaccccaatcccagagaggaaatgagacactgaagtaaaagattctggagctgaggaggtaacatctctcttcttttctgcaaagtcccacaaaagatgtgcacaaatgctcatgtctgtgtaaacaaattcacctactgattatagatttaacagaccactgatgtccagaaaacagggactaactagacagtgctctttaagacaaaagtttaccttaatctacttacttctgagggtaggggaacaacaacaaaagcaacaactaaagaaacaaaaaccttttgagaagtctaaaagaagtagagaaatcctactgaagaaaccaacatcaacagtttcatttctttatcaaataaaaagtccggcctgagtctcctgactgactacattctttctagtattaggtaaatcagatctcaaatctgatctagccctgctattcagaccacgaattcctgtaaacatacctatctagaactgtgtgcaggcccctcttatgacaatggtctgtgctcacctggatttttatcactggcactcttagtcaggaccaccagattcttcctaatttctcaagtcaaatccgaaggctaccctgcttgtggtgttccataactctgtctggcccctcatgagaaatgccacctacttggatgagagcatttaagtcagagcaagacagcacagaggttgactttaggttcccatctgacatatttactgttctaagagaggaaaggtagtggaagagaaagaaaaactaaagtggaactgcaggatttctgattttcagaaatgtctgcttattatcagagtgataagaactcaaaattaagacatgggaaaggaaaagatagggatatagagtcagagctgttccttaaccaaaggctttacagaattagaacacagctgacacaggaaattcaatgcaagaaggtcctgctctaaataaaaacagatgaggagaaagtccattcatttttactaatagtatgcatggagaatgaacacacgctgccttttacatagacccttataactgttcatactgttctgtaaaatcagcatatttcttattattttcttctgggaaaaaacacttggctatgcatttccttttaatttcatggaaatgggaaaggggtaaaaggaaagaaagataatacttcctgaaaacttgaatgttttgctgaaaacacccttaaaggaatgtatctctgtcagggtaacaaaaacatttaataaaatatttttaaagcagttggtctctaagagaaaatgtgaggtatatgtaattagtagcaaatatgcattcaattgtactaagcatgaccattcttcccctttaaatcctcaatccatgaagtgtgtttgttaattaggcagtaacttgaagagcgctgcttttcccatagaagtcaggtgctcaactactcaaccatgaatctctacggttacatgaatctatgaatggtctgcaaaccacttatactccaggtttcaattctgctgccagtaataatagtaataataccatcattctattctagtagcacagtgcaaatttaagataattagaagatgatgatagaaatttgaaagcaatggattacaaaacaagactgcatcaaagcataacacgcaacacaacactttttcaattatgtacataacctggaaaaactagttggcaatgaaaaaaatgtgttgagaagtaccttattaattcattaaatatttctgtaatcctatgtttctttaaaaagaaaaaaagattactagtctaagtgagcttttatctttgttaagcagcatccttttaacctccatcatctctaataactaaaaaaaaaaaaaaaaaaaaaaaaaaaaacaagagaagttaaagaagcaaaccagcaagagaaactgtagttgctgtatcaatgacaattattccagtgataatgacctgactttttgggttggtcttctagctagtccacagggatccactgttcaggacggtgttaggggaggtgggctttgtcattttgcacaaggtttgacaggtttcagggtttaaatctgcaatttccatggccctggaaaagtaatgtctaaatattgcttaactgaaagttgctgatgagaatatttcagtgctctgtgcaaagagtggatccgtggatcagttaattttattgaacagaaaaaaggtgaagtattgttgtagggattgaatgagaacagatacacagtgtttaaagtaattcctggcacatagtagatatccaagaaggtgtctgactccaccccttccttttctctctttctgaattgtattccactgtcagctgctagtgtatacatgtcatgagctaatgtgcccattgatggtttagcttatgactttcaggtcagttttctaagttgataaaaacaagcattatagataataaaattcagaggcagttccaacatggaataattggcttgtctcattccatagtcaaagctcatctcaactaagttttccattgctcacagtgaggactagggaagaggaattgctgcaaatccattttcacaggtgggtaatcaacacaagaagcactgtcaactgattgtgggtgtgaaaccatctacgcacttgaaagttttcatgttatcattactatgtatccacatacatttgccgagcctgaccgttccagatcagtcttctgaatgctagctgcatatcagaaccacatatgtatagtttcataaatgtgacaatactcaggccctaccctgagacaagtggcacaaagcattcagaagtggaaaggattctcaccaggagaaccactctgagaatcaatagaaacagagatccaggtcaaagaaaaatattatctttcttccctgggaatcaccagcatttgcacagacttctacaactagctacatgacccagggcaatttcttaaagtgggacacagtgtgctctgaatgcagacctgacactaaatttatcatggttgggtagctgctgccttatggagaatggcctgtgggacactgaacttacacattaaacagctgagccaacggatgtttcaactgccaggaaaataacagaatggggagaccctctgttcatttgacaccagtgccagcttggagaaacagcatttcttctgcagttattgaaagaaagtaacccagaagtacccacagtcttttagctcttaaaatatggagccactttttcttttccagcttatttccaatgcaaacctgattccaggctcaagagaagtacaacgtgccttggtcccttctccctagtcttggtcagcttcttcaattcctcttgctgatctggcctccagtttggctggctttttagaggagtctctcagcactaccagcagagtcttttgacctatgttactaacgcgtgtatcatatctagatccactcctcaccatatgtcatggtactgtcttgttcctggttattggtggtatatttgtttttctactgtatgtagttaaattttaagtaacttaaagaattacaatagcaatacaatttcattataaaaagcagaatatgtggataaacagaaagaagaaaataatatccactatcataccattaaggtgacccactaacacaattttcaaataaatttcctacgtacatattttatttttataaaaatgcaatcatagaatagtcaatatgatttttaaaagtcccttttatgaaataaaatatgtgaacatctttttgtaaataattattcatttgaaacattcttttaaaatggctgtatagtatttccttgtgattttcataaccatccccatattgatatttagcttgttttgaatcttctgctgttataaactatgctaggatgacagttacagctcttcttcaactgctactacccagtttgattgataaatgacacacttcccttggcctaggaagaagcaacagattctgatgtttgcaaaatttgtcagtgtggcttatcaagaaacagactctatctctctatttatctatcatctatatatttgacaaaacattttgaaaaatgacttttaaaaatgaaataaggaatgtaaagtcacaaacagcccagggacccaaatgagaaagcatctgtcagagattcatcagtcaggagtacctattattttaacattttcatggtcatataagaggaaagaacaggtaaaacagccaaagtatcacctgattcccactgatttagaacagaactgcagaaatgttgaaagattttttattagattaagcttcccagcaagaaatctagacagcaatctgcagctagcaacatgccttcggaaaaccaaatacgagattcactgacactgttttgtgagggcctcctctacccctcgtctcccctacccctcgtctcccctttttcacataccccacactaggatcagagaagtttggggaaaaatcaacagaaacaacacgccaggtagattatggccactgcaaccttgctgcagcttaggctaggctcttaggatgaccttctcaaaatccttgaaggagaagttggctgaaggaattttatgcaggtctggaatggtctcgtctctagaggtctagatccaaaaaataaaaagactgcaatttttaatctaactcttaccagaatgaaaaaccatctaaatgctccctaggggccttaaattgttatgttaccaaaaatgctatgctgtgggaaatactaatattaagtaaatagcccctgtcatttttaccaaggacatttgggggaaaaaaagtcactgatgaataagtgaaaccatcttaagttgctgaaactgacataatgaaaaccaccatctttctaaattccttagccaattaactaagggaggggaccacccctcatattgccttatgcccaattcctgcctccaaagaaagaaaaagtaaaaactaaaaggcagaaatgaaatccacaagcagaccgcccggcgccacaccctgggcctggtcgttaaagatcgacccctgacctaatcggttattttacctatagattacagacattgtatagaaaagcactgtgaaaatccctatcctgttttgttctgatctaattaacagtgcatgcagcccccagtcacgtacccgctgcttgctcaatcgatcacgaccctctcgcgtgcacccccttagagttgtgagcccttaaaagggacaggaattgctcactcggtgagctcggctcttgagacaggagtcttgccgatgcccccggccgaataaaccccttccttctttaacttggtgtctgaggagttttgtctgcggcttgtcctgctacgtaacaacttgtatcattcatcactacatttatttccattaacctatcctagaaccaaaagatcctagaaccgaaagatgagggtacataattgaagggaagactcacccaggaaagaaaaagaaaaggagtcagactgggctatctgagaattcacaaaggaactagaagctgtgtagtcaaaatgttcctggcaacgtggcaaatgtatttcaaatcaaaccatgcattcactagactcttcttttctaatcttttgttttctcttggcctgagtcaaagtcctttgtaaaactttcatggatcacatgaggaggaaaggggagaaggagaagcaggcagacagggaggaaatgagagggtgttcctgctggcaaactcagtggggaatgaactacctccttcagagggaaaatgaggtgggagggacagagagccacggaaagaaaggtaccagttcccttgcaagatgggggtaggagagggctcttctcagaaaactagaagagattttggtgatgatgtcagaattggagcatctgccttctaaggactttgtctgccaactggcatagggagcactgcccagagagccagttctccgtgtaataagcaaaggcaggaaatgggcagggagcagtaaactcagtgggaaaagccacatttgaaaaacttgggagagaggaggagaaaaaggaagccacacagaattttggtgccacgaggaggaggacatctgtatcttgtatttgcatggtgttttacagtttagaaaacacagacaccatcataggtcactgtgaggtgggcacatttattactattttccagttgcagaaatcatcacccagaaataagggaaaaacctgattgcaagtcttcttatatgggtctgttctttctactacatctaagacatttctctgtggcatgcctgcactttgcagtgttatcttccaaacaccatctactttcagaaccctacacttcggagaaactgtacttgtaccattcttcaaacacgctacaagttttcctgcctctatgtatttgttcatactatttcttccccttaaacttctttacccaacttggactgttagaatgttgcccaaacctttcaaggtctaaatctccatgttacctgtttttcttctatgctattttttttaacatgattctttgtattacagatatttacaaacatttcttctcccatactaaatttaactttgtattcattttactgcctagtaaagctccttgcatagtaaggaaactagttttgaattaataggccagtcaaaaaaaaaaaaaaaaaaaaaaagaaagaaaagaaagctttgtgagttcttaatatgtattttttgtcacattaagtgaaaaaaaaaaaaaagttccccaaagtcatgaaaccaaagcagattctatttacatttagtgtaagattttgctaactgaatactatatcccaagtttatggggaactatctatacttacttttatatattgatcttacattttgggtgtgtggttatgaggttaattcattaaaatgagtaaaggctcttaatgattctttcttgactttatgggtcatgtgtctaagtacagaagttagtacacataaaaaactgtaattgggtactaaaaaatacatatacagattgccccatatctaattttctaactttaagtgtataattgtcagaggcatttgaagcagagcaactccatccatgaataagggctgggtaaagtaaggctgagacctacagagctgcattctcaagtggtgaggcattcttagtcacaggacgcgatacaggtcaaaggccttgctggtgaaaggatgtggtaaagaagctggtcaaaacccaccaaaaccaagatggtggcgaaagtgacttctggtcttcctcactgctgattatatgctaattataatgtattggcatgctaaaagacactcccaccagcaccatgacagtttacaaatgccatggcaacatcaggaagttaacatgtatggtctaaacagggagaaccctcagttccaagaattgcccacccctttgccaaaaactcaggaataattcaccccttggcatatgattaagaagtaactgtaagtataatcagttgagcagcccatgctgctgctctgagtagagagtagccattcttttattcctttactttcttaataaacttgctttcactttatgtatttgccccgaattctttcttgcacaaggtccaagaaccctctcttggggtctggattaggacccctttccagtaacacaactgtaggcttttattgattgaaacataggtgataaacagaacttcaaatttcctttgattttctgtcatggcctggattaatcgccacattttccctaattatggccatcatcttttccagtgcaaaagaaaaactcttcaccacgtctttctgcagagtttccacccaatcttgttttccatcacaggaaagtaaaaggaaagcttgcaagtgtctgtagtcatcattcaactactcaacttgactagaccatcatcacctactcctttaactttgtgctcagtaaactgtctctctcagatgaaagtcattgctattagctaccaacacaattgtgccatttgattttttatttgtgacttactgttccagagctgatccacagttaacgaaaattaaagccacaaatttttcccctaattagacatttgtgccttccataatgacacttacatacaaatgacactcaaatgtataagatgtaggctatatgcacaatacacataacgaacaccacatgaaacaattttggaatttaaatttagattaaattggtatttaaagttaatcctcattgaatatgaaacattaaaaaggcaagcttaaaaataccaagcaatttggcattattcagtacagcatgtcaattcaccttattcaaaagcaaaccttttgcaaagcaaaaattctcccattaaacccaggcattaagaagaaataaactcttaattacttaaggaggaaatgctctcgtttcatggttagcaggttatcaatgtaaacaatccagggagctttctcaatggctcctgtttcaagagtcccagcctctattccccattccccatccgccaccctctttctacacaacaggagctaatgtctttatgcgtaccaaaaaagacactactgaccacaatgggagagcttaggtatttgcccacactttccctgcaggagtaaattcagtagaaccctataattctgaaacagtcaagtcatggaccatctgactcattaaatattccaggcagccttgtcagtagtctggaagaccttgcagttataatttcttccctctgtcattcctctattaatactcagctaacttgaatttcaacatgagctttagactagctgaagaacatttattgtgcaagattcataaggtacagaacctattcatagaaagcattttggcatccaaaatatgtgtaactaataatgaataataatagcattgtctccgaaggcaagagcacaaaaatacagctatgaagcaaaaataaactcctgacagtgccatatgtaccctaaaggaaataagtaaaaagctttttttctgaatattagttgtcactatttcatttgattatttcaaaatgtaacttttcattaacttaggtttatcatggatttgcagatacactggtatctaatagagaatattaaccttagactatcaagataaagcaaatccatgaatttcagcatttttttttaagacatatggtctcactatgttgaccaggttggttttgagattctgggctcaagtgatcctctacctcagcctccaaagtactgaggattacaggcttcagccactgcacccagcctagcataattctctatagcttttacacttgtccaactttaatggaagaaaggcttctttgtacacaaatctgacaacatatctttttttctttagttgtgtatgcctatgatggtcaaactttggactattaacatttttattctcagttgcaaacactaagaaccattctacatttcctctgtaatgcaacaattttgctgatgccttcagtaattatgacaatacattttttgcaatagatatggtaatttgaaaagaacacatttaaatatatggttttatgcaacagctatcaaatatgtaaaattcaatatcccaagagtttgtgcatgttgaggaaagaaatccaagaaatatttaattaaactaatgaatcatcattttctcactggtcttccatgtgctgtatttattaagagagagaatatgggctctaaagaccattggtctgacttagggtgccatttctcgcattttcatgatctgaaagtaaaactagagcatttcggcagtttcaagttggcacgagtgcgttgcttcctagcttgaaatgcataattaaccagaaagctagttgttgagcagttaaacaggctgtccaaaaaggcccccattgctgttcaaatgaatgctgaaaagtagggtgccacagtgatttttttgttttatagacaagctacatacaagcaattgacaaagactaattttcctttcttttcaaagcccatgaaagcttgtgggtaatagcaattatttctatttgtcaaatacttgtatccagaagtggatttataatcccacgaaaattctgtaatttactgaaccactgagcaggtccatgctactccccctccccagccccataggatgtaattcatttcaacagaggattggagacaatgatgtaaatgaagcagtcctcacaaggcagaaggggaaaagtgtcaggggaacatacttcttaattcccataagaaataccccaattactggacagagtgccaaatttcagaacataaatgaatcccattcttattaccgagtggagaagatgctagggcaagaatagtggcttagagttagaaggagacatacacctacaattgctaaagcaatttctgcaagaaaaatttaaataaatatgggaaacattatggatcaaatccaaggaaggtcttaaatatatagtgctcaagaaaagtgcatgaatgtttccatacctcaaatatggtattttaaaagagcttgcctttaaaatacaatggatgtgtcatgatctaacagttgtccgcttttccagcacatccgactaactagaattcttgggagatcccatgccacaattcattttccaatttctaacaaagacaatgcacttcacatttttacttttgcattccagcacttacttgcatggtggtttatggttggtttgtgtgtgtttcttttttagaaatgttagaatgggaaaaatgaggtaattcttcaactgactcagtctttaatgattttaatgagttccagtgtttatgcttgagctaacaggtgccttatttttttccttggctattctttcttcccttgtcctcctattccgggcaatccatgcaacactccagctgtaaattattctgatggtatgaataagctttgacctgaaatcaggttagtaactaactgaaatctaacttacatttccataaatttgctgttttgaaaatgattagcatgactttgaaaaatctgttagctgaatcttcaaagactactataatcttcacaaaatcattttatgtaatatgtcttccatcactgtattctatacatacaacatcctctttctatagcactgaactcccaaattgtttccactagtggaaaaatgcagttaatattggattcatttgttgtcagtcacctttataaaatatacacacattcaaatgcacatggacacaggctccgcgttttaaattccgcattttctcaaaaatttaaacatatatgccaaagattatgcaaaatatgatctccctatagaacattttctttttgttaggcagtgtaaaaataatagaatgtatcactgttcttggagctttgtggattcctagactttgtaattcttcatgaatgcagagttatttttccaagatgctagaagattccccaggccattttaatagttctattattaaatatataataaacatgattacttatttattgtataatggatgtataataaataaacgtcagaaaatttcaaaacttctaaatgggttattgagctatcaaagtctgcagcttttcactatcagacaagtgagggtaggaaaatgggccatcacacgatctaaggtgaaggctaagggcagacggtatattagtaagctagaagaggggaatatcttcccaggtggactgataagatcagtgtggcagagctgtgggaacccaaggccctctgttactcaaggctgtgtgtgcagtgctgagaggtcagccatggaggaagcaacatggtcctgcatttcgatctaagcctacaatctaaccattgtcagctcaccccatttgtttcacgtaaaagcaatgctcagagacatctgcagagggacctaacttctcaaacttgccactttggattgaaaccgtatatgatatgcattccccctatctacgtcacatgcatatacatagcacagtaacaaggcaatcctctgtgttgtgttctcaattccttctccacagttttttttacttcatgatgacaatgcaaagagtggactgaggactaggcttaccaggttctaggcccagatctgcccctttctaactgtgtgatcttagtatgtcactcagcagatttgtgtgtgggtgtgtgtgagagggagtctcactctgtcatccaggctggagtacagtggtgcgatcccagctcactgcaacctctgcctcctaggttcaacagattctcctgctcagcctcctgagtatctgggattacaggtgcccaccaccgggcatggctaatttttctatttttagtagagacagggtttcaccatgttggccaggctggtctggaactcctgacctccagtgatctgcccgcctcggcctcccacagtgctgggactacaggcataagccaccacacctgacccaccagattcctcatggactggttccttgtctgtaaaaatgagatgatttattagatgctatctatacttccttcacttcttcaaacgtcagtggtttcttttttattggtagttttctgtcttcctgccttttgcctgtgtccatttttccattttcattttatgaatttttaatcctccacctcagtgaacagcctttccttccacaccaacaggtcctctgtcctgaaagaatatcacagctctatattggagctcccacagctcttggtgcactgcattttgattgctgtgctgcataaactgtcaatttctttccaaaaagacatcctctatcttgtttacccttatgtccccaacttcctggcactttgtgaatattcagtgaatatattttaaatacttgaccttcctaaccttttcttggaaggacccttcaggtaaaggagatggtcaagaggagttgcatttgcttttctggccaactctctttacaaggagccagcctcctgttcagtctcttctgaggtgacttttctatcctgtggatcttcactggtgactgtaactactaaccagtttgcatttattcactcacaaatgcagggacacacatataaccgtgttaggcatcacagagcatatcccataagtgataaagtcacaaatatgttacccccataacaagttaataatcttccagcatgccagaatgtcagtttagccacagaaacagccctatatattcttctacaatctctagtttcttttctaccctttcttccctatcacacaactcctaatgtagtttggggcatcaaatatagttcaatacatttttatgccaaaagtttcttcggaattgaaccagatacgcctgatctaaacttataccttcaaaagtctttatgttgttctctgtgagatacacagttactcaaataatcctcccaggcttaacttatcaacagtttgataaattagcttagactgtggatatcctcactgcagcacacctctgcagattcacacaaacaaaggccaatttggaagcactaagtgaagagattctctcctgtttcattttctccattctcctcctaaaaccacaggaaattttggcactttggacattccttttacacaagggacacagtaaaacataattcaactgcttgaatctgggtgaagggagacagcaattaggacagctttggaaaaataagagagtaacaagtaggtggcccaactgtgggaattgaaactacaataacagcttctaatgaacaagtttctacacagagaagcatgccttcacacacacaacagtggtaaaacagcacgaaagacctgtatttcgaaggggcaccagttagatatttaaaactcacgagtatggtcaagatttagtcatacaaatttattatcccttgcacttgactaattctgttatgctgaaagatagagcatttgagcacatttcaacttaagtattgaatccaaagacactgaaatagaaaaaaaatatagccataagaaccatagaaaaatggaacaaaagaaagataagagaaaaaaacaaaattttctcggtaactgtaactacataggaatgaaaaaagttgtaactatacagcgttttaaacagtagtcaatgattatatgtaaatattgtttttgacattacaaatataccaattcaagacagacctgtaaagtgctgctttttctgtagtcatttacattttgagacaatgagacaagaatacaaggtccttttctcagaacaaatttccctgcaatagtcacatcggtacagcttctggtattcatgtaaaagaacctattagttgactaaaatacccctgtaagttcccaatcatattttgttactagggtatattctaatttttttcctacgggaaaaaacaaatctgtacattcaggcttcaggaatatagttggagtaaagagaaaaatcaggatttctgccctgcattatggccaaaagataatggattcttaggctctttgtcaaaaacttcctactttacaattgtccagagcaagcttctggacagaaataaatttgaacccccaaagattcttaaattcacaaataatcagaaacattcacacataacaccacatcagagcttccatttatcaagagcaggtatgcagtcattccttgagaatactctaattcttacagcccaaactgcatctactgtatagcttgctgaatagaaaaagtgttggaggtggtggcatataatgaggctggagagtggaaaggaataagagcaatagcatgctcaaggttttggagttgattacagtagaaatcatcttgctcaaaatatagtgggatttatgcattccagtgccacatcatccaccattatccatctaaaacacagaaaaggcagtgagaatgtagtcattcatgtgtggtccccttgatcctgctttgccttcaatttcattactgtctgccaaccaaccaattaatctgaaaacttatcagtggtgctactgcatatctggcatccctgccccaacaaaactggagttctgtgagcgagtttaaaataacctagtgaataggagcaaccacggactaagagtgagaagggaaaaaaagggggaggggagaaggaatacagggaaaaaagggggcaacttctggaagcaaatactaaagaaaacatgaaataaaaactttatgttttaactttttaataaatcatggggcaagggatagaacacatgactctttgaagttttagacaataaatcttggaaatgggttgttcgattattatagtacccctccgagggcaatgaaaggatgtaatgaaaaaaatcaggccatcagaacaataaattatcctgacttaccagaaataccagcaaaatctttcaatatgacctgttactggccaaattaggaggaaaataacatccagcgctagggatcacattgaaaataatttcatttgattttcattaaaagctttccagatagtgactggtaaaagaagcccatatattctatctatagtttaatgtatatgagtactacaggaaagaagaaaactttagagataatctatttgcaaatatttccggggaaaaacaaaattgtgagattttcctatgatgaaaatatagtaattataattatttttaaaatgtattcttttattttttaaaaattagaaaaaatgttttacatgtataacatgatattttgaagtatatgtacactatagttaaatccagctaattaacgtatgcattacttcacagttatcattttttgtggtgacatgctatttaaacatatcttcccactctgtgagctcacctataagttatcttcaaaatctgataatacattgcatgtcattttcttattaaaaaagcattttcacataccttatcttgtgatacttaccatagcactttgagaattatttttgccatttatcagaaaagaaaactaagttcaggagtatataactaaattagccatgcacataataccagcaaatgggattcaaaatgggattttttgaccccaagaatgtgccctttctatagtactgcaatacagctgcaggcttgataaatgattttgaaaaataattaagtttttttagattggatttgattttggggccagcctaaagttgtatggcactaagactttcatacgaaataaatgattaggtaagataatgccattaggaactttgaaaaacaggtattatctatggctctgaagataatttcaaagggcattttaagaagagttttgaacactaatagttactattcaaatctacgcacatttcaaaggtaactgatttaaagttaataatagctagcataacactttgcacacagcatacactcagcaaatattagcaaaaacccttaaagtacttccatatataagcactggtaaggttttctaacaaccagtctcatcagaaaattacacatgcccattaggaatgtaaattcaggcagattctcttaaaatagctttgtgaaagttattataagccttaccatgtctataaattttggtctatttattccaatttgagaatttagcctaaagaactaatctaaaatgtgagccatgatttttttgctttctcaaaaatgtttactatgatattatttatgtataaacgttgtctttaaaaaaacctgaaaaaacaaaaacaatgtcaaaacaaaaacaaacaataggggcctcattaaataaattgtattcatttaatgaaataatacttagatattaagactttaaagaattttattcatataatgaaaacttctaacgcaaaccttcacaaaaaagcaagagtaaaacaaagattatacctgtacacactaaaatgtaaaaagtagccatctctggtttgtgaaattacaattttctccttgtcttttaaaaatttcttatattgggtatcctgtttttatacagacatctaagttattttataatcaataactcaacagtcaaaattgaatttttagcatgtgtcaggcatagttctaacctttttgtacatactatataatttacttttcataaataccattgatatagaaaaatttactttgtttttatacgtggaaacaggcagagagatattaaataactagcccaatattactttccaaataaatatttgacctgggtcttgaaccaaatggtctgattccagaactcatgttcttcatggcgttgctatactcttcatgttacacaggctgcttagcgatatgtcagaatatattaatgtcaaggagaaagtgatctcatgcaactgcgaccatgtctataaaatgttataacctttttggtgagatggactgatggtgtattaagtgtacttagcttacctcacatataactagttttcatgaatgtgttacttctccttcccgagaatacaaaagctgttttacatagagggatattacatctattttgtaatcatatatttacaaccatttatggtatattaggcactggattaaaagctggaaataactagcaagttatagcattcattgccataaatttaacactaccttggagtgggcatacggttttaactgaaacagattcttgaccatgggaatggaggcactaccttaagagcaaagagattcagattgtttccttgctagaacatgcttctgaggcactactgactgtatagatcaaagacagcacaggtaatgttattgacttcagaaattcctgctatattcactggctaatattatgtccacaaaaccacagctgctaaaattgcaaaggcatgagtcagtcatgacaataatttagagtattatcatgataagctcaactaggaagacaccaacctcattttactatggatgaaaactattgatggatatttttggtattattgattccatctaaatatcctctgaaatgctagagtgtaatctaggtattttttctggttatcattgctgatttttttttattatactttaagttttagggtacatgtgcacaacgtgcaggtttgttacatatgtatacatgtgccatgttggtgtgctgcacccattaacttgtcatttagcatcaggtatatcacctaatgctacccctcctccctctcacctcacaccagttagaatggcgatcattaaaaagtcaggaaacaacaggtgctggagaggatgtggagaaataggaacatttttacactgttggtgggactgtaaactagttcaaccattgtggaagtcggtgtggcgattcctcagggatctagaactagaaataccatttggcccagccatcccattactgggtatatacccaaaggtttataaatcatgctgctataaagacacatgcacacatatgtttattgcggcactattcacaatagcaaagacttggaactaacccaaatgtccaacaatgatagactggattaaaaaaatgtggcacatatacaccatggaatactatgcagccataaaaaaatgatgagttcatgtcctttgtagggacatggatgaagctggaaaccattgctgatttttaaaatgatctatttaagaatctttataagcagagcccttttttcttaataaaggaggaattcagaagttaataacattggtctgctttacatcctatacttgttttccctccaaattatatgaaagtcttatttcaaatgcaagtgaaaacattcatgtcctgtagcttgagaccttactacatataatatcactgcacagcatgatacaaattaacgtctttaagagggagctcaaaggcatacagaagtataagacatgccaagaagtttcatttaaatttcctttgttcataaggcaaatttttatatttactaatccttggataaatataacataaatacatagaaaaagaagcattatgttttcttaaactataggttgacccattgcaagcacatgatgatgcgtctcactaggtgtgcatgtagtaaaacagattgatttgccaaccaacagttaagaaaattaatttgttgagcatcatattttatactaattaaaaaagaaaatttgtaagaattatgtaagagaataacctaacattaaatggcaccataatggcatgaacaatttagaaacagaaagtcaataccttggtttctctaatataaatgtgttgctcatgctcttcaagcattttatgaaatgaaacatgaatcaaagtcattacagagctaatgagtgaaattgtattatttgctgtctctcattttcagtgttgattttgttggaaaacagtatcttaagaccaaaactctgggaactgttgagattctggccacaaagacagctagaccgtggggaagcaaacatctgtacacatctgcagccatatatgaggtccctcatgagacttagcaacaaggtgtgttttaatgtgacagtgtgtctgatgtgtccccagcacattgggaccagtacacagtgttatttgtacatctgctgagtaacattgagtgtgtgggtaactaaagccctcagtaattattttacttaatgttttcaagcttaattctgatcttgtacttgcatgatttattattccttgtgctaaattcttcaatgttcttgccttgattgatctttcattatctatcacttaactaaaatattaaattctttaattaagtcatgtttaaatgaggacttgttttagtctcttggaggtttattcattgcttaggtactttttcaataactcttctcttgtttaaaatcaataaatatgattaatttgccatacatttatgataggtcaatatatttattatggaaacatatagctaacttgatttgaattaaattggtttatgcctacagatcaatattgttctactcctacaaaatcaccttgaaaaaaatactattggttaaataaagaagacaatgatgtatatttataagacaataggtatcaaccagagaaaactctttgcagttggcaatattgggaaagaaggccacagacagatttatgtcatctagatatcaaagagaatgaaatacatggctcagaaatttgttgtaaaagggaatggactcgtatttaaggacaggactctgaggactattcatggaatgcatgaagaagactgataaggatagcctataaggcacagtatagtagtatagtagaagtgcaccaactatttctccagacttgaacaaccaagtctaagagtaagataaggtaagacaaggtcaggaagtctcagggctggagaggtggtgatgttgctgaataattgctttttaaagctggaggggacttccaagagtctctcatttaagaagaaaaattaaagacataattggtaacggttttgactgctgcagaggcaacactttgctcacaatcctacagatctacttcacctgtaactacaattttcctgaagacatagaagaaaaatcaattgttctaatccatatggaaaaaaaaaaaaaagaaaactgccaatgtggtttgactagcaaaccactggagttgtggcttaagcataaaggattacttcttccattgccactaatctaattactttcccctatctgtctccattccagcaggcatgtttagtagccaagctgtattacaaaaaaggataggatgtgggtaggtaaagcaaacaaacggcaacatcaaatgcaaagtctttcatttcaaaggactaatgctctcttattccacttgtctccaaagaaaagcaatctcaaccaggtgtggcctgttatcccagcactttgggaggccgaggtgggtgggtcacctgaggtcagagttagagaccaggggtgggtcacacctgaggtccggagttcaagaccagggtggccaacatggtgaaaccccatctctactaaaagtatacacacacacacacacacacacacacacacacacacacacacacacacacacattagctgggcgtggtggcaggtgtctataatcccagctacttaggaggctgaggcaggagaattgcttgaacccgggaggcggagctgagatcacgccactgcacttaagcctgggtgacagattgagcgaggctctgttttaaaaaaaaaaaaaaaaaaaaagcaacctctccacttttctgagacagcaagcacagagatgttcaaattaggttgactatgccatacttcttaattatgtatctgcataattattaatagtgccctcttttactcacaaaagtgctctgatttggacaataagttatattgttatcctaaatacattgtgacaggaaggtcaacttatataagacactaaaacaaatttgacaaaattcattttagtagatcatccatttaacatatataattctacaagttcataacttatcaagactcactaagaaacaaagatttaagctatttttatatatttgttgtctttcaaaatgtttctttttggcaaataactttactttaaaaagtaaggcatagactaatttagaaaacaaaaaaatatcatttcctcacactttactctaaatcttattcagtgttatgtcattttttaaaaaaatttttgctttctcttaggacagcaaacatttttgagatggaagaaaacccatagattatttacttcaatgccttaatgttactatcaagaacactgaagttcagagaaatgaaatgactcacccaaagctgctggtctggtctaggtagcgaccaactaaccagaccagtagcctaatgagccaagttggttctggaactcctgactcctaaatacttgtttccttctgcattccattctgtctcctggattatattctctattttattaggttggtgcaaaagtaactgctggttttaatttaaaagtagtaacaaaaccagcaactacttttgcaccaacctaatagaagcctcctatcaggaagaacttcatcaaaacctagctttgccctaagcatcacattttcccactggaaaagggtagataaaaaagcaaaggaccaaaaataaaaatgataatttaccaacctctctctcaggaggcaaagtacagaggtctctgcaaaggagcattttaaaatgtcttaggttattgatatttgattgctttttgaagattatgcagagttctcctatctctcagtcttgtgattgtcttcagtatgaccaattgttatttttacttatttttttatgtaacttttcttttaggtttggggtacatatgcaggtttgttatataggtaaactgcatgtcatgggggtttggtgtacagattattttgtcacccaggtaatatgcatagtaccaaatagatattttttttctgatcctctccctaatatcaaagaagagcaacaactttgggaaggttggcccaggagacatcattgggaattgtaaaccaaacaagaaaaacataatcaagacatgtttcttaatattcaatttattacaacattttattggctctcaaagcaagtgttaggattagttttgctgaagaatttgacaattttgtttgtttcttttgttttgtttttgtttttctgagacaaggtctcgctctgtcacccaggctggagtgcagtggtgtgatcacagctcactgcaacctagacctctccggctcaagtgatcttcccacctcagcctccttagtagctgagaccacaggcttaagccacagggataaaatgaggatttaaacccaggctagtatggccccaaagcgtgggcctttagtctttatgttaccagcagaaatggcctttggatggcacagtgtccacaatgaacatctaccattcacttttattccatgttcatgtttaggaagcaatatgtttaaaatgaagatagctggagtcaggcacactgatagcttggatggatacacacacacacacacacacacacaaggtaaacgcacagagtcataaaacagtaagctggaaaactttagggtcaaagacccagatctacttcaaaatgtttcaagtgcttcatatataagaattgatcatagaattaataaccaaataatcaaaaccaggtcgatttaaaagaatatagtttacaatagctatagaagtcatgaaatattgagaaagatgttccttccctaaaataattcaaacctatagaggacacttaaattatccaaacaaataacaaccgcaagatagtttagctctagatattgtcagataaatatctggacttaatattctttacattattttatttgttttatgtttacttctacacttatatattcatatttactgtttattacattacattatattaatattattccattttactagaccatgtgtaggtcagataaattacttcctagaatatatcagcttatagcatcccagaaacaacccacaaagggttcttctttgcataatacaacagctcagaaagactcccatatctgatcttttgtcttttctcagtaatccgtctggcctacttcaacaacatgtcaggatattctgaggtactaggccacctgagcctaagacctcaaaagcactgagcctcagctcatcagattcctggctaagtactttcaatgtctgtagtagcctcatttgctcatgcttaataagctcataccatttagagaaaggactcaagtgtgagtaacacatgcttcccctagtaatgcacagcattaagaagcgaagtagaagacaaaactctctccctatttcacattcttctgagttcattattgccatgaaaaacgaatcagatttgagttgttcctaatctctgctcttctggtctccatcagagagggcagccaaactgtgacaggagccatctgggatggggacaggagaggagagagagccctgtagttttcttctggggaaaagcaggcacagggggtaggttgctcctagagtggacagcaacactgacagctcatcatcatttattctcagcctaaacaccagtggcaagagccccatcaggtggcactgagagaaggaggccaaagaaggcacagagaggctttaggggtgactaaacatacacactgttgtaggactgaacattcgtacatccatctcctctagtaaagcttgaggttttctatggcagaggctatgtcttaggtaccagtgttgtcacagcatcttgcaaggggcttggcatgggattgatgctcatagaatatttgctggaagcaggaatcaatgaatagggcccagcccttctggattccaccggctacttctggcttctcaaacacactcaggcacgtacacttgatttcaaggacaaagttgctgtctatttttaataaagaagcagcttgagtgaatcccatttctatttccttactctcatactgtcttctgtttgcgtgagcaagagtatggactaattccaggcttcagttcattttagtcacagcagaaatctaatcagggctgtatattctgtctctgtccctctgtctgtctcctttctctccccctccttctttctctgcctacctctccttcttactcaccctgcctccacctccttctctgcctccctccatctttgcccctgtctctttttctctctctgtcaggtgatatacaaatcccaggaacacagatatacacactgaactgaatagctcatttttcaaaactgtgtcaagattgtaatggttagtgtgcaagaaggaaacttatccttgtaacattaggatttttctttttctttaattgcgccctaagaattaaaccctatgcaaataggacttaattttgcgttcccactttttcctttaataattgtgtgtatatgtgtgtgtgtaagacaaatgttctttgttgaaagctaacagttgcaggcttcttttaaaggttataattatatttataaacacattgctatcaggtttacaccaaatagaccaataatttgccggcaaaaggtaaaaaatttaataaaaccaccttgttcgaaaacaaatttgttatagaaacacctgaacattggttttgtataaagtatatgcaagatgtaactggacattcatgtgattttaggtagaattttttgtttgttcttgtcctccagagaggattcagaaataagaatgacttggaattgggcatttaaaaaatatatctaaaaattctatgtgctgcggaggttggaattctaagttttttataagatgaactgccatgcaggtcacttattctaggaaagtctcctaataaataattcttactattaaccacctccagggtcacagaatatgttttaacctctttttagtgctgacacaaggtaatagcatcccctgatactaattctttgctgtcattaatttggattgtctggtaacacattaaaaaaaaaaaacagaccaagaaactgctatttcaagtacgaagaaaagctgcattcattattcagccatataaggaagttaaatgctacagcgccaaagcaggcaatgacagaaaactaggaataaagaagtttctttttaaaaactaggaacatagggaaataaatattgtgtgagagaaaaaagccaaaaccaacaataactaggtaggtcagctacacggagggactaaaacattaagcattcccttgcctctcaaactcagctattcatggccttctaggttaatggagagtggggcacggggtgcaatgtggttaatacacgttctagaatcccagaaaagataaatgactgctctagtttctcatcttctgagcagcttgagcatgtgttgaggttactgtcactgcaccacagcctgatacatattcctccttgtgtatgaaagccattcaaaggaagaaacagccctgaataagactctatgggaattacagtcaagcagtgctgctgaattctggatccaccctttattagctgtgtgacccagagaaagttaaatctctaagcttcaacttcttcatctgtaaaatgagtctaataagagtagctacttgatatagttgcaaagattaagtcatacggatactttaagaatagcatgaaacttgttgtttaataaatcttagtgccatcaccatcatcaccaccaccaccaccaacaccaaaaataatcaccactaccgccatcatctccaacactatcaccaccaacaccatcagcatcaccatcactaccacctccaacatatctagaaccaccaccattccaaccacaaccatcactaccaccattaccaatatatccaaaatcaccatcaccaacagcaccatgaccatcttcctcattttacaggtgagaaagttgactcagaacctcagtaactggctgaaaggcacaaagctggtaggggacagagagctcaaatttccaagtttagcgatcctcctaagcccatctttatctcaggaaatttgtcatggaaaaatggtgtggccttggtttcaagggtcaccacaaggcttcagaatacctaggaccccagatatctcatatgtaagcatagaaaagcaaaaataaaatcaaaaaactatatctggaaaatatcttagggtattttattaatatgtgaattgctaagtatactgcaacacctggttgccctgttatcatgagcaccagcctgaaaggtgagggactcaggttctgcttttcgttcttaccttcatatcttcaactgtcaccaaagaacacaatgcctattcccatatttagccctgtgaagacactataggaaagaaagaaactgtcatctacagcaccaagtcctcaggagaaaggcaggaaatgaaaaagaattgtttatttagcctggctctatagtgaaacagctgtataagtctgtgaaaagaaagggccctggcttggctcaacctttggcaaatacatgggtattatgtaggcagcatgtcgagccaggagaggaggcaatggaggagatttcctctaatgcttcccatattgttaattgctgctttccctcccagggccttctggacttcccaccagaaatccagggcaggaactgcaaggcactatgggaagacagcagcttgagtcctgcctgcccactcagcaccttccactgggaccctcagcgggctcacccaaggcagttacgaagattatctcatatgccacttacccacagtacattcagctatcttctcaccctttcctgccacctggcccagagccatttaactctactgttgcaaggctaaacttctgagtttcatggcatttatactgtaataagggactaatcgatgttctaccccaaacagtaaatctccaatggtcagatttcagccatggaggaaatatgatgaagatattttataggaaaacctcaatagttcccatgatattacaatgttgcctataggcaattttccacatctcagctttgttagctgacagagaagcaaaataacagcaaataaccccttgtatgtcttagaccctcaaggttgctctactcaaaagaattaagtatacttaaatctccttcccttggttaatggtgtcctaaggaaagaaagcaaagaaaacctcttcccatttcacaacttagtgtaaaatccattcagattttacaagatggtgacagagcaataactcttgagaaaatgatgtgacaatagctaattgtcaatggctaaggactcctcaaaagctgctcaatatccataggattaaagtaaagcagaaccattcctagagacccaaggactagttaacaaagagaaaaataaagtactaacaatattttactacaaatctgttaaattctctttaggaccttcaagaggcaaagtagtatggaagaacaagcacataaccttttatttcaaatagaaaagggttcaaatcctagatccataatttattagcactttgaaaaaaattaatctctctaagtttcagttttttcatctgcaaggtcacttacttcattgggctattataatatcacatgtatgaaaagcatttgagaacgggaaaacaatacgataataccattagtcttccaaattttgtttctacacattccacaaacaaaaagggttctacaaatagcaatcctttaaaggatgtattcaggttggtttaagtacccttataatgatttaaaatcccattatacaaaatgtacttttacttagcctttcattaattttgataatggtcctgtctattgaaactgcccatactcttagatttaccaaggtatgagtccatcttacaatgcacatcccattttccttttaaattatgcttttgtcctccaaaagcaaatgaaaatattttatctaaaatcaaggcttcctatagtttacaaaatgtctttaaaatgaaatttgtacttatcagaatatacaccatctcattatctcccattttagagtataaggagcatattttttctatttctgttataattcttagcccactgatggccacaaatctgtagcttattaagtatgtgcagattaactgatatataaattctcctctgcccctaacccagtaaagcaatcagccttctatgtaatggccttgaatgatgactaagaaaagagcccgtaatttaaacacttcaatgtggctgaactatgaaatctcaattgctaagacaaaattcctttacataatgatattataaccccaagctttaattagtgctggaaaaataagattataatagcaaatatggcaatctggttgacaccataaacaacctttctgcacacaatcaatttaagctcctggcagtactaaattcagactcataaatgttttttggctcttatcctatcttatttttataatagctatgcattcagaaaacatgcatttataaaaacatcttttagttataatttaggtttgcagatgatattatatgtgatttggctctaaaaagacataaatattctgttctgaaaagataatccactaaagcagaaatccattcaaatgctagttattccatacaaatttcttacattaatacattacctaggaaaattatatgtcagtataaaatatcatacctccatcgtatgctttaaaggtagcagataaaattctactgctataaagtaaagcttgaatatgttggagttattaaattgtgtgcagaaattagtatgtgctaacagcctttcttgtcttgtgatattttttctaatatttttcatcatttctgatttctccacacaattatccttctgttctgatcacttcaaattttcttaatatcttcatttcaccttgtttacatctggctgtcttattgtattttgttctactctcagaattgaattgccatctcacatagctaagtctatagagaattctatagaattctctagaacaagaaaagaacacaggtcccataaatagcaaaaacaaaatatttattttccctggaatataataataattccatagaacccatatactactgaaattttttttcctttctagtcttttttccaaaaagagtaaaatgtgatataaatattgagcatcagacagctatattggttaagatgtcttacacatactatttcctaaagttaatgaagttacaactacactgaaaaatataatagttgttaaaacaaaattaagtttgggtaggcccgttgtttaatatgttatactatgactaggaacctctggtaagctgatattctaaggagtatattaagtaaataatctaacttgcatactctgatttttcaactctgtactttaaatatataatactaaacgctcataatcttttaaattgtcttccaaaaataatactattgctgggctataactaattaaatttgatttgtatctacattagttaattagccttatcatttttccaaaacagttaagctaatgttagaccttgaaataccaaacaatattttgtaataattattaccattaaactagaaccattaaagaacaatcattaacagcacttcaaatgtgtagatattacctaccaaaccacaaatcaaattagcatattcttaatttattttttattagctgttaacattagacagaattccctgttgtaagtcaaaattagttggcattggtttagtatgtgtcattgattgagtttataaaaaagcatgtgctagctgttaattatatctatttaatgggattttgctttgtaattttaaaatgttttgctgagaatatattttattagaaattacaagcatcacttatcacttatcaaattgaaataaatcaactcatttatgtgagaatatgaataaatatttatagacatttttatattataaatttaaatgactatttctacactaaaaataagatcaaagattaggaatctatcttgtttttggaatccaacaatcattaaagctgtagtgcctcttattctccatccttgatcagattggaccttatttctacctttgttagggacttcttaaaattagcctttaaatttaggcttttccaggaatctctttatggtgctctggaaagaataataaagtctggctttgtgcacaacattaaacaaacatttttttttcaaagtacttaataaagcttggtggcgccatcagccatgtttaagtactgtaggttttgaaggaggacatctttcaagattaactatgtaatttgatgagatataaattcattcttaaagataagttgggtttaatctacatagtctgactccattgcacgatgacaaactctttcacttggatctgactgtatggaaataagacaactgccaaaggaaaaataatccataaaaaaataatgttttctaagctgctaagagggcagcacaactccatttgacccagcaatcccattactgggtatatacccaaagaaatataaatcattctgttataaagacacatgcatttgtatgttcattgcagcactattcccaatagcaaagacatggaatcaacatatctttgataatatgtttttctagaaaccttgtgtttgaatcttggtgcttaatttaaggttaagtcccagccaaacaaatctgtacaatcaacagacctatttagcatctacaaagcttgtcagtaatacaactctacgaagtcaagatgaaatctcttcaaaattaaaaatctagaaaaaagaaaaatgtagggctgtaatttcattccacttataagttaaatgctttgccatttctaaaatttcacatttcaattaagcaaatgaagtatagtaacaattttatagagcaagaaacttgcgattgatcttcaatactcctaagaacatatatatagagatggcatgaattattagccaattttcaccaactccaccaatgtttaccaattctcacaagaaatctaaatttctaaagatggaatgtggcaatattccttccaatttaattgcataggatgaatgttttaaatggaacttggcagaataagttattctatcaaatcaatgtcaatcctttttaaaaatccttttccttattcttctgcatcgtaccacccaaaagaaggttatttatggtttggtaaaagtcctgaactgcagaatagatagggaaagactgcttttcagataaaccagtatagagtccttattcttaagaaaaggtaagattaaattttcaaaagaaaatatgcttagtcaaacaaacaaaacaaaacacagatttaagttgttttaagggctacccttatgagttcatttaacgacatgaaatatacctttaacaacacgcagtacacttttagatggattacaagtgctatctactacagaagggttcaataattgaaatgattagaaaacataatcattagggaaaatataatcaatagggaaagaattcctagcaaaggaataaagttcatttgtgttaacctgggcacacatgaactttccaatgcaagaccactgaaaaaattctttcttggatatgaaggatattaatttgctactagatcactatctttcagtaaaataagtatcccaacaaaacacatctcaataagtgtaacactaacaacattagaattaacataaaatagatattaatcaaaacactttgctccctacaaacatcagaagatggatattataatccctgctttgcttgatttcattgtgatattgtactcgacactacttatcactatagtataacaacaaagagatgtaaagacactggaaggctctctcaggaaaatctgttctctctgcccatcccctccccctttttggtttgttttctctcactttcagtaggagaaatttcatatttaaagagcatgcattcaccatttggcatatcatatgccattatcgtaagagttaactattttcgaactgtatttatatatttatttttcttccctgaaatttctaaatgtccagtgcttcaaccaacataatcattcattttaacgtcgtttgttgtactgaagatattatagtcagcctccctccctctctccctccctcctttccccccagaaattgttcatagagtcaaattttctggtttgcttttggtgagttgagtgcaacacactttcctaggcaaagggggaacagccctctaaatatcaactctcagtcgaagaatcacttaacaactgggtacttcatattactacatgagcacagtgccactgtaaagtaccacgaggaagaataaatttttccttcttttctctgacctgctccctgacaactagacacgtggacagaaccttatttctctctccatcactgtatcagtggggtacagggtttgtttaataaggatgtaaaataaaaccggacttgaactacaaaagggctggatggcctttcccatgttggcataacactgaagaagcaggattggttatgaagtcataatttagcattggcatttaagcagaaacattaacttatattgtcacaaaacacaatgtcacataaaagccacaaaaatattttcagccagccctggtagccaagaaattattttcagggtgtttcctttttgggttttcccaatttgtactcagaaacgaagttagagacctattgtgatgttttaaatattccttttctgagtatataccatgtgattcaaaatagaagaccaatttctcagcctgtcttaagtcatctgataaactgtgtcccatcactcattttatcatagtcacaatgtagttaaaatgtgtaaatgtataaaagtaaaaataaaattctgatgtaaataaatttaagatctctgtgtgcagagcatattgataactggcacccaagcaaagactgatatcttgaaagggatcttgtataaaagctattccattccttgcatgctatttaatttaaaaaatgatgcacagactcacattcataaacacactgaaccacacacacacacacacacacacacacacatatataatatagaacttacacaatttcatcattctggaattcgagctctccacaagtgtcctcaaaatcctcccctccacctctggcagtcccttcgatggttttatatggaacgataacatttcctcgagctccagatgttctcaatactttcacctccatgatgccaatgctctcactcacatgagtcacaggttcctcaaaagtaaaaatgcctgcgtggtcatcatcaaaaatagttacagtggcagtggagggagatccgaggcaagcaagtgtagaaacatgattggcttccagtatgccatcttctgaagcttcagaagatactttgacattgctgagatgcacaaggaaattttcatcctcctcaaagatatcatcatctatgatacccactctgatttccttctgggtatcaccaggcttaaacaccacagttccttcagtaaattcataatcagacccagcatttgctgtgccatcctctgttctgaagtcaacaaacacagtgttagtcaaatcaccacctctgcggataatggtaagggccacagtaccacagttctccagacactgatatgtcccttgttcaaagaagatcttactaacagggtcattttcagtcacttcagtgttgacctcgtgcatgctgacagccttccttgcttggtcagctgcatgcctctttaaaatgttgccagctccagtcatgaggcgagtagcttgaatgcgataaaatgctctacttttttgctgctgacttaggacttggtagttagctaattctattaattgctctatttctttatctggatgcttctgcttaagttccttcagaatcctagccatttctcgcctagcttcttcatcatcttggtccctctcatccacctccagaaccagagcaccatctaagaaattttcaacatgagaattgaccactttcccgtccatttcaatttcagtcttagaagatggcctgtctccttcatgttcaataatcatccccctctgcttgccagctcgatacctcttgtagacatacttgtaaaacagaagtctcctatccgctacccaagcgaacacaacacagatgggaaagaagaagaaagtaagcaaaccttcccagacctccacaacaccaggagatatgacagacaaaataatgtaaagccaggtgtaggcaaagatgctccaggctgctgtcacaaagaagacacgcaaatgcttaatcttccttgtctctccgtcaggcaccacataaacacagagtgcaataatgatgaacatattgaatgcagcacttcccacgatggtgctaggaccgaggtctcctgcagtgaagttatggccacacacttcaattactgaaaggagaatctcaggagcagaagatcccagggccatcaaggtcaggttagaaactgtttcattccagatcctcacagttgtcttggtggtctctccattgggtttctttatggttatttctttttcttgagatgtgatgacttctatagaggacatgaaccgatcagctatgatagagactccaagaaacatgtagaccatggccacaaaatacacagtagctctagcaattttgtccccaaaagaagggtcttggggttcccaaatgggcaaaatcacccctttcttacagtaatatgatccagtacattcaccagtttcatttccttctccttccatttctgtctcagcaattacatggtccacatgggaaaataagagactcacagtaactaacagatgaaatcccattgaaaaggtgggtgaaagacttaatcgccgcatgttgtacatgacacttccaactgtcacaaccta

SEQ ID NO: 1982 - DNA, 318159 bp, Homo sapiens; identical to SEQ ID NO: 1981

SEQ ID NO: 1983 - DNA, 400290 bp, Homo sapiens
taccattttggtttttatttcttcaaaacatgaaaacaaaaaatgaagtagatgacaatgagaaaggagaaaacatttcatacagaatatgctgtatcactagtgattaaatcagaaacaattagaaactttatttgtctgtgtcagtaatatgtaccatttataaggaagagcacaattagtgcatttcccgccccccccccaagctgtgcacaatacacacaaaataaaataattttacacaactataataataacaatcctgaacaaccagaatcatagtttcctagaacatgaaaatttaaaaagcaaacaaaccaaaaagctttcaaattgaaatcgaccaatgcaagaatttcttaaagttctctgtgaaaatttgctacaggattattgacattcctaatacagctaaaaaatgagtgcaaaaatttttctaatgtttaaacaacttatattccttgaatatatttacttggtgcttctaggctagctttccatttagcaattctcaaaaaaaaaaaaaataaggatgggaaggatgggttagaatgacaaagaattgtaaagtgtgggccatagaaaagttccattgccaacaaagataaaagatgggatacactgggctttctcagtgatctggatcaccaacatgattgcccttcttggtttaaaatggagagatatatttatctgcaagtcggtcaaagataaagagggtggttttccaaacatatgccttatgctctcttagttaaagaaattcttgggtataaatacaatttggacaattgctttgatacagtttcagtgtgtttatgttaaaagagtttcataattgttttttcttgcaagataaaaatctttccatatggctttcttcacttttactcatgaaaatagtaatcacataaactgtaacccttctgagggcagggatctagactgttttgttcatggcttagtccccagaaagtatcatactacctggcacattaagtgggtaaccagcatttaattactcattcagtcaccaaatgtttattaaatgaggaaggatcatggttactgagtgacagaagaaaaaataagtctcaacagctttaatttattaagtatttttgaatcaatacagagggctaggaatgtctccagcctgggattccttatagacacagaagtctccgagaggtgaccaaagtcattctattatttttctcattagtggactcactactttggaatgttgggtttatccatgttctttggtattttaacatagaaacagctattctttttaaagggttaaaaatatcccagtccaatcctcctgggaggtactagtcttatttaattgccttctctttcagcataagtagaggagacaacacttttaaaggcccgttggtcaccctggcttctttcttactcagcaactactgatataatcaaagaggactagactggacagtgaaagaaacagggctcaaaatagccttttaagtaaaaaaataaaatgaacaaaccagcactatctaccatctgtgccagacagtgcagatgtgaaataaatactttgcagggaggggtgttgtggaaagggtggctctgaaagcctaggcacatccaacatatcaacgtctctataaggcctttctccttggccttcctgaattaatgggtgatttttagaggcctctgatgtgttccacatggctaattttccatgaagatctttgtagtttgcctgctatcctctcaatagctttaacttctccccacatgacagttattgcttcttagaaatgaatgtgcagaaccgtgaacaataatccattttctccttttatccctagtaattaatcaaactcaataacagcacaaaagtaacaactcaggtgaaaagaaaactcacttatgtcttcaatgtccaatcaacattgccaaatgggagaacagtatgtactatactctactatatacagatactctttgttttgttttatttgtttttcaccatgcactgtgtaacaggtatcacaacaacatttccgaacggcacatgaagaaggagcaaatgttcagtcatgactggaacaggattgtgcaagccatggatgcctttgaaaataaaactgacagacaatcccaagcaacggcaacatgggactgagacacatgttaatgcaaatggaaaacgatgatgtgctttttgaatggggttattcttactgtttgcataggggatggcaggtggacaggaggaacagggttgggatggggcacctgggggcttagctgggctgaatgctggaagaaggaccttgccaatcacagtccagagctaaagagataagaaagaaaggattttgcacgttcctgggaatctaggcacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggtaagtgaacatgacaaatgtcagtttcctctgtccattatacataatttttatgtatatatatgtatatatataaatttactatatctgatagttcctttagaagccttttatgtggcagtaggcctccagggaggagaagaaaatgtacaagagccataggagcacaaagaggcaggatgtgaggagcttggcagtccggggcccacccagctcacctccgatttctggcctccgccgatacagcagcacccccacattgatgaaagcaaaaatggtgaagagagtgacagagaaagctagtgtgccaggggacactttgaactgttccccattggctgcgtggtagatggcagcgatggaccaggccacaccgattcccaggaagacattcaccgcgttgctgcccgtgacgttacctatggaggcgtctgcatactggtcctgggtggctgccactttgctggcaaatgtgtctgcagaggaagaagagaaagtcaatgacactcaatcttttagagatgtctttggagtgctgcaagcttcagctgtgtactctaggacccaacccttaatataaacccagtgaccaagaaatggctttgatgttcctctgagtcagactcatggggtgaaaagaacaggatctagatattgggagttaagggttcagtgctggctgtgtaatggactgagcaagtgatcttggtcaagttttgtatccacagatactgcagttctttgtaatattgaccttgcagggcagcattttttcagaaagtagtcacagctcacctacatcagaatcaagtggggtcctttcaaagagtgagtattgcaaggtgccatgcggctgtgctggtcataatgacagcggcccaggaatctattttaacagtatcctaaaagattctaggtcactaaagtttcggaacagctgctggagggtattactaaaagatgctgtatcagcagctctagtttatagatgagaaagttaagatgtcgggagagatttttcaagattcaagagcaagccaatagtggaattgaaaacaattgaactataatagagtagctgacatttgcttagagccttaagaataaaaaagcagattcagctatattactgcattgattgtgatggtacttttttattattattttttattattatactttaagttttagggtacatgtgcacattgtgcaggttagttacatatgtatacatgtgccatgctggtgtgctgcacccactaactcgtcatctagcattaggtatatctcccagtgctatccctcccccaacccccaccccacagcagtccccagagtgtgatgttccccttcctgtgtccatgtgatctcactgttcaattcccacctatgagtgagaatatgcggtgtttggttttttgttcttgcgatagtttactgagaatgatggttatgaggtgagggaacgaggcttagagatgacaagtagtggatgcaatatcacaactaggaaaaaaacatgttagggctacagctcctgcctcatgtcttcaaaacgaatgctttctcatggtgcttttctacctttcactgtgctgtgggcaccaatgatcattttcaaagccctttatttactcataatcctgactgtatctttttgtgatgataggaaaatcttggtccactacagaaggttgaacaacagtgacttaaacttcttgatgggtagaacacaggggtttagagcacatttgagctgggggacttcaaatcctgccttcgcagctgactgtgtgactctggaagattacttaacttctctgggcctcaatttcctaatctgttaaatggggatggtactgctcacttcagagtgctgttggtaaggtgaaatactacatgtaaataaaatgcttttgatgctttttggcacaaagtagtaggagaggctgtttttgttgttttggaaacacaatataaaccgagcaggctagatcggtttaaaagttgaggtaggatctgaaatagcttcctgtattaagcatgtgaacagaacttgcaagatactaaatttcttgtccacattatgcctacttacatcaaagtcctggctgggcacggtagctcatgcctataatcccagtactttgggaggccgagatgggcggatcacttgaggttaggagttcgagaccagtttggccaacatggtgaaaccctgtctatatactaaaaatacaaaaaaaaaaaaaaaaaaaaaaaaaagccaggcgtggtggtacacacctgtaatcccagctacttgggaggctgaagcatgagaattgcttgaacccgggaggtggaggttgcaatgacccgtgaccatgccactgcactccagcctgggcaacagagtgagactccatctcaaaaaaaaaaaaaaaatcaaataaagtcctttcagctaccttgcacagtaggattatagcagatattaataactgtcaaattgaacttatttccaaagccagtaacagcaagcattaaatgactgcaaggtgttgtgttatctgctctggtcctcctgaggtcctgggcatgctctgagcatgtatgtagttgtacgatacctgtactagtctctcccctctgttgttatgctattgccaccatccttcctccgtaaacttccagtggggaagatatgtacagcatgtaaatatagatcagcccatggattctcctgctttacaatggataagaaggctttttaggctactaaaaggctactgcatctgcagtatgacattcttcctgaaagggagttggtcaattctgaaggcctatcatcaattctgccctctgcctgtgatgaaaagcagatctgattattatttcataattaaagaagtagacaaacactgcttattccatgctaggcactatgctacacaggcaacgtgtgtattctcattcacccctctcacaagcattatgggctagatgtcattactcctctttcatgatatgagaaactgtgacgttgtgatattatgcctcttggatagggtcttagcaaatgtgaatttttaaaccaaagtctgatttcagagcccagtctcagtccacaccacattgccccttccaggaagcctgaagtttgtctttcctcttagttcatttcaggtggccctgttcctttcactcagaaactttgaagcaggttcttaccaaatgctctttactgtatcaggagaacaaagattgaagaaggtatgggcagtttgtgaatccagactcctggatttgtgctgctttgtgcattcatgatcacacattcacacagcccaatcaactatcacagagactggtgagtaaaagcaaagcgagacaaatcttaatggtttcttgtacttcattattaaaagttaatagaaacagggcagcagcctcaaaaagaaaaaaaaggaagtttttttttttttttttttttttttttttaaggtcaggcagtggaacatggaaagtaaaggaacaaaagtctgaggcaggagaaagcagcttccagctcaggtacagctgagaaacacctgagatgttattctaagctgaaatggctggtagcactggctggtggtgaacagatggccacgttaggtggggcagttgcgggggtggtaattccctctgtatgctacagggacaggtgacctggtgctgttccatagaacacacctgcttacctcccctggcacctgatacattgcacactggacttcctgggtatcccatgtgtactcagaaactctgggctttctagatggcacctttgctgccgcaccagaaggaaaggaagtttaaaatcaaagactcctgggtctggggactcaaagcacccaaaccagtcctttaggctgacatggagggcacacctgggtatgcagtgatttcctctccctcaagccatgtatcagtagcctattaatgtgaatgttgcataaggattcttacttgtaataataataggttcctattttcaaatgtctttctttgaatttcctaagagttaatagccaaagtgactagcttgtcacataagtaaaacatgtttttggctactttgtgtctcataggttttatttacttgggttagacatcaggccttttgtctgtttttattttcaattcaaaagcaatgtaaaaaaaaaaaaaattgcaggaacacacgcaaatccaaaccactaaccttagctccaacagagagaactctgttttccaaatgaagtgcgatggattctccccaaattaccttttattgccgctttgctgctcagcacatagggcaatacatcacataccatatgttaggtgctgccaagccctactttgaacactaagcctgtaacctgcctatggttaaaccaggcaaatgccatatcctaaaataaaatccaagaaataactactgccttgggtttgaaggggatataataatattcagaggttggcccattagataaaaacttttatatatggatcagatttccaatgcgattgacacaaaatatgttgataataacacatgtattttttccttcatctatgtccctggctaggtttttaatagtttttgctattaactcccaccttgaattctaattaattttagatcagtcatacagttttagacttttagtcctggctccttgatacatatgactataaatcaataagaaggaagactgttgaggagacagcatggctggaattaaactacacatcacaaagtcaggacgtaattgttctttgcagacctgcctcaagttcatggtatattaccttgcccaagtcatctggtcaacatgcaaaaataggccaatactctccctttccttcagcaattattctttacctaaatttctcaaactttattgctacttataggctaagccttaaacatctcttctgcaaaaaaaggtcattctcacagtcttgcaggatggatgcagggataatgtattatctggagcaagggtttcgccccagatggttcatcttattcttggctcttagtgttctttggggaccagctgttcagctctccaatgcttcatgcccaggaactgacactggcagtggttttaattggagtccatcctggctatgaaggtctgcttgcttctcccagcaaccagaccttgacgtattcgttcactgacaatgaaagaggcagccaaggtgtacagatcttcatggtgtagtagtggaagaagcctcatcaaagagactctcggctcttccaactgtctgtatgctctcggcaagtcacttcacttttttagattgcagtttcctcatttaattagagtatctctaagactctttctaactttactgtttgggtggtgcacagaatacattaaaatactaaatttatatgcaatgtttgattttgctggtttttttgataggagtttgtacataaccactcttcacaataattaactgatgattataactattttatcattgtgaagaagaaatgacttaaatatttgaaaatcctaggaaaatctcaagacctgaagatactacctttgatcaaactgtgacaatatttatggaattaaactacatggcacagtcatttaccttttaaaattaggtaagaaatgttggcaaaattatcaacttcaaatcactctgactggccattcattgatacgagtgaagccaaggtggcagacagatgaccatgtttcaaaggctgtgtctagtgttaatagtgttagaagtacctggagagctttgcttaaaaaatgtaggtttggggcttcacccccaagcttgtccagcctgccttattttgttgttgttgttctgttttattttgttttaggcttttgacagcctgaagccatggtttttagtttctgtctctagtgataagcagacaggagggatgtcgaaggggctttactggcccagacagaaacagaaactaagaagccatgactgtattctctctcttgggcatccctgctagatccacttaatcagactctctgaggacgggatacagaaatacaccttttaacaagcggcctaggttgttcttatttataccaaggcttgagaaccacagttgtaagacatgggaaggggagatactactcgaagtgcccacagttttgggggccttcctgcgagtaatagatgtttgagtttcagggaagcagctaatcggaaagaagtaagaagctggtttctcttagaaacatggatgcccttagctatagtggttattttgctgataaaatgtgggtaggcgtcacggagatgctgggggctgcttaattgtagcttcttccactcacaatatggttattctcctatttttttaaaccctattccagctaccctaaaaggccaaatgagggggaattacctaaattgattgaattgtgctgctctgtttgccaggttggaagcttacctacttcatagggttttgaaggaaatgagttaacatgaatagaatagggcctggcacttaatgggtgttcagtattattagctatttttataatacaacagagccagatccccagagaatccatacatggtagggaattctgactattgccaatgattctatacttttaaggagttataacaccctttaaaaattattaatttgacaatcctttgcatttaaaagtgtgatagagcttaaaattcttaattattttactttgaaaatttcatacaaccaaagtcattaaaagacattagagctcttttggtttagagcccaaatcttactaatggctgtaaggtagatatctttacttaaacagtgtatatattcctctcttttttcttttttgccttctataccctcatctgtcttgctcttttagaattaaaagagaaatagtgtttacttatgtacttgttcttctgctgtcactgaagaccttaaacaagcatttgtctttggttgcgatatttatttacccaagtaaatagaaaacctctctttctctctcacaagtgcatgcgcgcgcgcacacacacacacacacacgtgtgcgcgcgcacacacacacacacacttcactggttcatgtgaaaagaatcatcatttggcttccaagtgaagttcaagaggtaacagaattgctgatgtttgactgattaataaccaggtagatgaggagttgaaaaaaggaaacacactgaaaatttctgcccataaaagttgtccctgaagagggtaaagaagaaatggagacagtgacatgacctacttttagaagagaaggaagcagcgataagtaaaaagttcaagaggacctatattggcaggatcagggcacctgcttctagtcacttttgtccccagctacaaatgagagtcagcaggacaacttttgaaaacatgaacttgctagccccaccttgagtttctgcttaatcggcctgagatgtggctggagcattggtatttatcaaagcttccccaagcagattgagctccactaactgaccactcacagccctggtttctttgtccctgtaaggaggacaatgatgcctcccttagattaactgaggtaatgatgtatggaatgagtgacacatagatttgtttttagagtaaccatttttgttattgaaaaattagctatttttcatttttgcatgttaacttgaatgtttgcactttatggaggtgccccgggcttagttttcctactttgtatctgatatcctgctgtattttaagttcaaagaaagaaatttattctaattaaaggagagaaaaaaatggaggtttatttttcagggaacacaaaacagtgaagtgaaaggatacaaaccagcagcgcagcactatttgatctgctttccaaactgtaattggagtcatgttctcaaaaggaaatgataagactccactacacacacctagaataggattatttttcagtgtgatgttcacaggtgtccaagagagaatccaaggggtgctgacaaggtctagataactgatacatttgacaacggacagagtgtccaaggaaaatatcaagaagcttcatcatgttcaactccgactgtgactacacaatggtaaagcagctgatcgtttgaaagaaaataaatacaattattccatatagaaacatcaggctgactcctttagcaaacatggataagaaacagattaagaaggagctattttcatgaaagactccttattctttaataccattaatggagataattctctgataaggaaaattacactctgccactcacatacacacactcacttcactggttcatgtaaaaagaatcctcatttggcttccaaatgatgaacaatttttttttgattccttaaattcttggcttctcctggcattacatttgggctgtctttatagtactttaaaatgggctggaatgaacttgcttttaaaatagcatcaagtttttgatattttcagttttaagccatgattctgttactttcataataactcttattttaataatgcaaagtccgtgagggcaaaaagaatcataagatttagttaagcaacatttggctaattttgaaaaggaaaaaagcaagggcaaatttgaagctaaaaacaaatagctgaattaattgtcattttcccaagccagatggtttgttattatatagatataactgaaactaacttcctgcttaaacacaatctagggctgccctgcacagatcggtgtcctctgactcgcttctcctcccttcccaataatctccctctttcagttaatcctctttgcatttgaagcctagttctttcttctatgctttgttctatttctggaacatccatctcctatccaaatctcctcaaattctcttctctcctattttagagatagtaaagacataggttcgcctgtcttgctagagctagctgagaaggatcagatagagaaactgtactctaacttgaagagaaataaaaagaaaacagaaaccttcattctcacctgcaggtagccttaatgggttataaggaaacttcgttgtcagctggattatactggtgtgattctaagtgtatggatctagacaatacaccgaagatgcccaaaatgtgcctttccccaatggatatctacctagttagttactcactccagagacacttttttgaaggggctgctttgtgtattatcagttcacaaaaatatgaacactattaaaagtaggccactgcatgcaacctcaatccagcacaggaggcagcaggtgacacttgaggacacgtgagacttgaatgggttctgaaagtttccaataattcacctattttgccttccaccttgctgtgatttggtgtaaaatttcctccattaactcattcctacagattagtcataggatacaaaaaagcatatgtgcctatcaaaagcctgaaaagtctactaactatttggcccagcaattctctacttctgaggctctagaggcaattttacaaacacacaaatttatatcagggattggagcagagtttctatgttagagaaaaattagaaacaattgtctatcattttagaaaaaataaattgcaacttcatataacatgatactgtgcaactgttaaagtacactaagaaaaacattcatgacacactgctttgtgagaaagcaggttatgtaactatgcctactattagtccataaaaaagtatgggtaaatatttgctatatatctgtatacacattttttgtgcaatttacttaaatgtcccaggatttcacaattttaaaggtgcaaatggctgaatgtagatggtggtgagatggcaggatttctttttgttgcttgcttattaacattttctatttacaaagagcatgtattgtttattgcttgtgctactaaaaactaataaatataggttaaaaatagacatttaaatagagtctctctgggaaggagtgaacggctgaatttcagctttttcctggtccttttggttaattcagcattcataattatgttagacaaatccttggatgaaaagcatcctatatactacacacagagcaggtgcatctcgaagggtgtagcggggaggaggaaggagtggaatagaagaagaggagatagccttgacatcaggatctggcctgggatccagtgtcccgagggtgcctaggacagtccacaatatggaacaagaatcgtaaaaagcaacttcacccactatgaaagtttgcccaggaccagctgtgaagggaagatgtgtttgtgtcttcattttcccccacctactcgtgttaagcattgaagaactgcagagcagcaccaaaatcttctctcttaattttatattttgtgctacaaataccttctattttatttactaacagtatgttttagtgacttcaacccacaaaattgctttgcatattcacttaacctgacaaatactttttacaggcttgttaagagattcatgtccttgagatgtttgggaagggattgtaatgcccatctttcttgggctcttactagatacgtaacttataatgaaaaaaagaaaagaaaagaaaaaaaggcatagagctctacctaagctgctaagaatatgccatgagcctgatctctcaaaatgttctcctttttctctctcccagggacgtaggacagtttcttgtggatacttaacaaacagcttttgttaaatatctcttatttttatagattcttgtaattttcagagcacgtccatgaatgttatactatctgctgtgcctgacaattctgaggaggaagatgggtgggagcagttacccttagtttcattttgtcagggtgaggaaacggaagctccttaggggtcagatgaatgtgagggcacgaggtgggattagaatccacatcctgtaatttctggtgttcaggtcctcatgctgccagtacatttccaggatccttcatcagtttgccagataacaactccatgctctgaacatgataacacatctacgctgactaactctcagggctgctgtgggtatcaaagagatgaattataaaaacatacttttaaaatgatgaagctatataaatgtagttactatgaaagcattttttatgtgtgtgtgttaaatgcaaggggtctatcttcctgaaaccatcattaaccactgggatcttactgtgatcatttgttggatattccaaagtcctaactaatccagaatatttagaatggagggtctgtgggagaagaatccagggcagtgggataccatctgctgagaacagaggtggtaggggagctcatatgagagtatcaagtgctggagtgagaaggaaaaataattcaaagccattatttgaagtggaaagaaaataacttttcagtttctgggactagacctgcctgagtaaatctaggggtggggtgggggaggacacagattagaggtttgaagtgtgatttgttagagattagtagtgtacaaagtcaaagtttcctattaaaataccccctcccccacataaacactctccattctatggctccatgatctcgtttaattttcttctcagcagtgttcatcctctgtgctacctgaaagtttatcatctgtttataagtaccagtcttactccacgggagtagacatatcatctgtcttgtttatcccccacctccgccatgcccaacactggccagtacatagtgggggctccttaagtatctgagaatgaacgaaaagaaatgcagaatggcttgaaagcctatgctttgccactgggtcatattgcttcctttgttttaattttttaaatggtatttatctcttttttaatgactttatgaatggtgtggaggaaaaaccacttgaaaatttgaggatcaagaatgccacattgcttcagagactcagtttgggcttcctagttagctattggcattgtcaaaatacagtgtttcattgtgaatatttcttgtcattagtattccactgtagactcagttcagttatagaagctatagatgagagagcttaatctttactctcaggataagaatacttgacatagcagaaagttattgtcaggttcttctatgtggtttaccccatttctccccaaagcacagactaaacggcaggaagcacgtccaaccacttccagcgcagcctcaaaccaagtgctggttccccttgagcaaccagaactgcagtcttctaatgtgataactgggttagttttggggttctgatttgccatatttcacccatctgaaggctcatcatacacagaatccttcacagaaggacattttcatgatcacttggcatagttgtggttacctgcttttttgcgactataactcaggaatcacaggctatgattaatcctctggtgggcctatctgtggaccccagtgggggtcattttagtctggagctacagcaagcctttcttgttatcttgacccaggattttttacaatgatgacctaataatagcttataatttatggaggactatgccaaaaagtcccctgggctccagagaggcaggatggggtggggagcaatcgagggagagaaaacaaatacaacacataatttcttgaatgtaactaatacaaccaaaataagctgttttctccttgagtacaaaatacaggatttatagatgctgagctgaacaaaggttataaaatacgggcactaacggagttagtgtttttagatcatgtgctagaaaagatgggtgaacaatgcaaagcatctgatggattgaaatccttttctggaatgaatcagagtataaacaagtaatacacagcttatgtttcattcctgagaaaaggcaggatgtgaggtctgtgtgccgaggagcagtgatgggattccagctggcgctgtgcataaatgccaagcaccatgatttcatatctataatatgcactaccccaaacagatattaaaattttttatggccacatgtaagctttgccttttaaattgagttagcattttatttgttctcttttctaaaaataccagtgggcttaaattcatttgtttctcatgcagggaccagacatggcaatgaagttttgctttcttatagcccctattttcttctcttgcatttagcaacaatgtgtcattctttgtgcagggagatcatgcacagagcctcttaccaataggccttggtctctgtactctcttcctaatggttgtaatggatttgaattgatttaggagccagcagtcagcacctacagtatgacgtgctggggccatgaatgagagtaagaagctccatttgtgagagttgcctccttagcactgtgttgtgatcaactgactgaactggtcaccgacatttggcatttgtctatcattaaacatcaggtactgccctaagagtcacagtgctaattctaagcgccattgtgtgatccccacccccagcaatttgcagtgtatgaaccaagattactgttgggggcagggtagtggaattgttttaaaaaggtggacaaatccatatatacacaaaacaatgaagaacaaaaaatatctcatgtaatttacaaatatatagagagagattctgtgatgaataaaacaaaataatttcaaaatcttacagaatccatggtaaattctgacactatcatgtagagaatccatgacatttttatattagaattagtccttgtgaaaaatagagaaaagtcaaacctattgagtcagaaagtacatcagtggttgcctggggcagagggtggagatgaggattatctgtaaatggccgtgaggcatcttactggggtgatgaaatgttctaaaactggattagggtaatggtagcaagactcagtgaatttactaaaaatcatgaaattgtatgtactacaaatggatgcattttatggtatgtaagtgataccaccataaagctgttaaaagatgcagactgagacagcattaaaataaaaacaacccaccagaaaacagtggtccttgagatgtttcatttttttttttttttgagacagtgtcacactctgtcactgaggctgagtgtgatggcatgatcatggctcactgcagccttggcctcctgggctcaagtgatcctcccatctcagcctcctgagtagctgggacaacaggtgcataccaccatgcccagctaatttaaaactttttttttttgtagacacagggtctctctatgttgcccaggctcatctcgaactcctggactaaagcgatcctcctgccttggcctcccaaagtgtggggattacagacgtgagccagcacacctggccaccttcatttcaaatgtgaaaagggagaaataaaagtcatcaactcaacattatttacaaatcattccttagagactgacactcttgtgaatgcttctgctacactcgatgctcattccctttgcaatacaccctgagcctcaaaagaaagggaaatttacactcattcacataacacatgcataacaccaaccctccaaacacaaaacacatgaacgcacacctgtacagcatgatgtttctaccaagtgcccttgctctggccaacctagagtatgtaagaaggcctagatagaatagaataaaatatttttagctctcttctcttacactgtgacttttatgggactgagtaaagttggctggtatggggttggggcactaatccaaaggctctgcaggacttcagattgggcaggacacatgctgagcatccctgctccctggaccacctcctggtaaatgacatcattgttatcatcctgattcccctccagctttgtactcaatgccaggtgcccatgcagtactgccctttgagagaaataaggagtatgactaccaacaaaaaacccttaaaagtatttaataaaaaaactcttcctttgaggagaaagaataaaagatgcaaagagctttgaaatggatctttcccaggtttttacagaatctttgggtcggctgcatgcggcctattccccactgtttcttagtatacgataacaggcagttatggtgccatttatagagaaaatcttgtaaattctggttgctagccttcttttgtttcattctctcctcaaaaatgtttgcctttgcaggcttcctttaactctaatgacatcatctattcatgggaaagtgtgctggaaagtacaaagcatttaaactccagactgctgcttgctaaagtgaggttaagataaggtcctgtggaaagccatttgagtgattagggctgtcccgtgctgcccgtctggcagtgtccctggttagctttgcctcttggcctgactgcagatctgagggtccattcagcagtactgaacttttttggtagtaaagaaacgtgttgcttattagagtatgtgaaaacaaaatatacttgccctttagtagcctcttggggaaactgacaccatagccactgggaaatactggcttagggtaaagtcactctgttttcttttccatttaagctgatgtgaaatgtagccatccaattaaatatgtatgcacactgtcacaatggcacctcttgacactggctatctgacttgaaatgtcaatgttgagaggagaaagctcatggtcagtgaaactgcaggaaacagaagcacatttggatatgtccacctcactagaattcctaccatagggaaaaatgaagataggctgaaaatttacttagtttttcagttttcaattgctgcaatgtagctaaggtaaataacccaggaggcctaacttgtttatcagtgcattgaaatagaaagtaagggagatccaacatttttaagggtctactatatgcgaggctctgtgttgggtactttataaattctctctcatgtaatcctcactacaactctgtgagatggattttcatgttcctattattctggcttagaggagttaagcaatttgcctctggggatgtcatacatctagtaagtagcggagggagggttgggtttgaacacaggtctacctgcctctctaaagctcatgttcttttataacccctcagcacgtagtcattgtgctaagactttgcataacttctctgagacagaggctgttaactgtcaatctatctgtgagctttgcactgagaacaacacatctatttgaagtaggatgggatgagaagaaatgatggaattaatctgattccctgctgtccttcaagggagctcagaattcagaatgactgggtacagtttcccaaggggaacatgtttgtgatgagtgggcatttttgtgttcgctcctgaccacctctctgctgttaagagtagactgagtgtgtttactggttggtgagaccttggaatattaacctctatggttcccactcctacttctgctcagagatctagaacactggaatgtaatttccaaagctgccagtaagcctgggcagaacatgactgctaggagggtgtcctcaacatgcccttcctgggccccactgaccggcacctgggtagctgtgtatcacagctgtgtttggtctagctcgggaagaccaaatctctctttgtgttcagattcattagtggcacatggctgtgctgatgaggattatcttggtattctattttttttttttttttttttttttttgccagctgggtcagaactgaacatctttcagttgtcttagtgattaaatttttacatacaggaaatgctaatagtttacaggtatagaactggatcttgattcatttctgaatttttttgaaagcatggactccattaggtgtttttcatgccaaacagaataatagttcctgaccttgaagagtttaaatgtaatcttactgttgcatgccttaaaagtaaaaaataataaaattgaggtaaagagagaaatttaaaaatttcttaaaacgtttgtgaggcatatggaaaagagcatatgcaatactttaaaaataagtccaagatggcacgatagagtagctaagtaccagattataaaaacgagagataacatggattccacagtttaccatccctacaaactttggctaaatatggacaagtcatttattctctatgagttttagtttcttcatgtaacatgaggatacttgtattcactctcctataagctattaagtgattttagacagggccactggagttacatccaggcatattgtaccctatacagctccaggagggtcactcagattatggggcctcttggagtatgtagcatacaacctgcacaaccatacaagttacttgatggtccaccgagaagtaaagcgacaggacccagtaaattgtaaagtacttgctgtttaagtattctacagaatatcttagttttgagagttattagaagccagaaaattaaaaactgaaaaacataagctatcaatagctaactgtttttctcagttactaaaaataatataatgttttgtagcacagtgctgaacaaacagaaaaaaatatcattttcaggggaaggatctaagcgtcaaaaaaaataaaggttgaaaggaggcaaaatcagttcacatcacttaatgacataacctaagtaagataatagataaagtatatacagtgcttatgcctagatatagtggagctttgtggtaaattttaaaaatgttccttctctgctcaaaacttttcccatttattctcattttctggtgttttctattccttttgacatttttttagagttgatctcagtgtaaataatgataatagtttcctgtattttataccaattttcagttgatacattctctgagatccatgctgttacttaatcttcttgaaaagtttgtttgaattgccatgtatcattaggctgattttacaggcccagagagtcaagaaattggttaaagccatgcagtaagtaagggttagaagtccaggttcctgaattcagctctaaagctcttgtccctctaccctcttggtgcacagtcgttaacaccacgctaagagaacatggtgaacaaccagggtaaccagttttatatatcaagttctttctatggaattcagaagtcgaaaagtgttgcaatttaaaaatgacataaattttccccaacataaggttttattttattaaaaaggttctatatacaaaattggggggggggggggtggaaaccaaaaccatctatttccttctccttcagccttaaaatccttagagggaaataattcatgtttgacagaatccaagggataaaagaatattcgaaacataggaaggacacagaaaatcatacaatgccagaaactaaaggacagcctatcatacccaatttttaagcttttctggcccagtagcaaccagctggtagcaggaactagtgggagaagtcagcaagcatcaggcacaacccccaccaagacgcgcagagaaagatgaaggcaagacttaatggggcaaaaatcccccccccccaccgactcatcagtatctcagagttctccctgcagttaaaggaggatgcttacttctatttatttgaatccaataggaacaagacatgaaaggaaagtccatattttgaatctgggatataagctggaatgtcctggcccaatatacccaaggcttatccaagtaaataactgtaagctaaaagaatgtccaatgactaggtggcccttagtccaaaaaaaggctgggctccaaatgctccttcttaattttttccctttattttgaacctgtttttccatagaaataatgtgatacataacatagtgatacacttgtgttaggctactgcaaaattcagcactccagagtatacctaaagtttttgtttgtttgtttgtttgtgttttttttttttgagatggaatcttgctctgttgcccaggctggagtgcagtggtgcaatctcggctcactgcaacctccgcctcccgggttcaagccattctcctgtctcagcctcccgaacagctgggattacaggtgcccaccaccacgcccagctaatttttgtatttttagtagagacagggtttcagcatgttggccaggttggtcttgaactcctgacctcaagtgatctgcctgcctcagcctcccaaagtgctgggattacaggtgtgagctaccgcacctggtctacctaaagttttaaaagtactggcctgaggtctgggtcttgcgagaagggatcatagaagagaaaagaatgaagaaaataccaaaaaaataccttgctcctcatcacagttcccaccatagccaaaattatgaaagaggaaaaatgtttgttctgaggtcctcagtgcttttaacttttgtcccttcttactacaataaccgtctcagatatgtcctattcaagaataagcaacactaaaaatcatctacttacctccctcaataatttcaattcttaactgtcgctagaagttattaggaagaaagcaatctgattgaaccaacttgtactaatgtgtaaatgactgatttgtacatgtatttacatatacaacccaaagacaaacacacagatacacaattgcattacttctgtgttagctaggcaccattctaggcactagattagtggacagagttagaaaataataacattcaaaaataagtaaactaaaaaaatccagaatgtaataaatatagaaaatagagtgaaataatacataagaactggttgactacttcacagttggtgattatgaaaggactctttaaagatatcatttaagatgagatgtaattgaagacaaacagccagtcttgtgtaaatgaaggggatatgagacagctagtgcaatccaaagaaaggaatgagcttggtgtgtggatagaaaaaaaggcccatgggcccaaagaacagcaggcaaggaagagaacagactggaaagataggcaggggccaaatcacattggtcttggtaagacagagtgatgcttttcagagtttatcctaagttaaataagaagttactggaagactataagctgtagtctggcctgatttaccgcttaagatgatctctagcagaagcagggagacagataggaggctactgcagagatatgggtgagagaggacagctgtgtagactaggatggtggtggtggagagatagctagatgggctcaaacaagacacactttataggaaaggtcagccaggtgcagtggctcactcctataattccagcactttgggggcggcaggggaggggtggcagggggatcacctaaggtcaagagcttgagaccagcctgaccaatacggtgaaatcctctctctactaaaaatacaaaaattagctaggcatggtggtatgtgcctgtagtcccagctactcgggaggctgaggcaggagacttgcttgaacccgagaggcggaggttgcagtgagccaagatcgtgccactgcactccagcctgggcgacagagcgagtctccatcttaaaaaaacataaatacaattaaaaaataaagatctgtaggacctttgaccatggggaggagaaaaaggaatcaaggatacctggacggaatatgacttgttctcctgagaaaggcaagatgtggaaagagtaggtttggttaaaggataaggccattgggcagtagaaatcaacagttctgttttagatacagtaattctgagctgcaaattacatgtctggcatcaatatagggaagacagctagtacataaatctttcacttagaggaaaattgaggctggggatatacatttagcagtcattggcatatagatgtcatttacaccatggagactgatgtccaggaagtaagcatggaccaagatgagaagaaggatggagaccagtcttgggcttactccaacatttaaaggtgggaagaggctacttgggaagcctctttctccagagaagtaagtctgaaaaatggtgatttgggaagaggaggccctttctctattcacaggcacgggtcttcaagctcttgccaaaacacctaacattgagggtaagtgaagacctttatgaatccttctctgccagtagagtatgagcatttgctaccagctggtgcaaggaagaagctttgtctcacttgaaaatgtataagcttttccccatacattttgaatagtatggtaaaaacacttttgatgagatatatagatattaattccttccttgaggcaggaggactaacgggaaagttttcaatgtccgtctggcctttagaatctaagaatcccaaagtctaacctagaaagaagcagcagaatatcagacactaggaaagagcccttctgtttcaggaaaagtgccaaaacatgggcctagagaaaacgctgggccccaggactgctgctgactaaatagtaggctataaatgaagggaattatttttctttattcttctgcctgtagcaactgggctttgtcacctagaaacaatagcatcatttttcttaggagtcaggatatataataaaacattgctctgaatcagcagggtcaaaaaataaagtcagaaatgtgatgttcatccaacagcctgttcaattttcagtttttggaaaaaatgtctttatatagatatgattgtctgagattacctctgaatatattgtttggggagcttgctgcacagttaatattgcagcaaattatggaattctctcaataacagcacaaagaaatctgcgtcccgatggaaagcatttatggcagtgtagggaaactgtttcaacaacaaatgattctgttgtattttccccaaacagattttcttacctcttgatgtctccacctggcttctgagttagttttaagtggcagaacaagtgactcctctaaacatgaaggtttgctgtaatccataattcatattatagggaaaaattttaattataaggctgccacaattttcaagagtttcttaaaacaagagacacacagaggccttttggaagactgacatttagaaaaagccagcttgagggtatattggataagaggtattggggagtaaaaacactttcaggaacaaggatttcagataggaaaagcattttttaaatccttttgaaaacaagagatgtatttggttggataaactgctgattttggacaattgttataagagacctaatttttgcctttatgatcattatttgcacatattctcctcagagactaaacccatgaccaacagcgtgtgctaacttggacacaatgtgattcagtgacttaaaccataggaaaagtggactccaacatattttcctataattacctcagatagaagcaacggacaaccacaatgttgattcctttggttttatatatagtctctaatcaaaacaccttaagaatattttaagtttttccttctgcttggtaaatttctggtaactctggaaaaagatgcaaagaaaaggaccaatatggaactgctggaacgtagttgggattgagagggagtctgctcttctgtaaggatcgatggtcaactgaacgacttcaaacagccctgcttgctaaggtgaaagtaagagaaccctctaggtctcctagctcctccattcccttaattggttaccagaagcatgtggagtctttaatcagaacccccaggcaggcagtcagttgcataacaccatgccttatggctgaccagtataaatctggatacttcatccatggttaatgaatgaagtgtccagatttatactgttcagatcatcctaacttattcaatataaaaatcaccagaaatacaattttattaaattttttctatgtcccaggtgctttactagatgcataatttgcaggtatttttttccaatcttgaccataattctgcatgttaagtatgattatccctattttttaaatgaagaaactgaggctcagagaggtgaagtaacttggccacagtcactggacgataaatagcttcctgaagaagaataactggtgaatttgagtagaaagaaatacatgatttaaactgtagttgttttcagactcaaaccaaaagtcaggcttgacaactatggcaaactttagtagaaaacaaagtgactatctcaggactgtgggaaatatggaaagtggacagtgaatagcaccattagcacagctgtatttgcttctagtcctgccttttcccaagtctactgtaatgcttgtccttggcttggtatttggttaagaacgtgggtattgttgctcaaagtaaaggctatatatctgtcaagatgctaattagtgctggagactagatccagagtttcagttacaataagctctggtgtgtaccagagtcacttgtgagctttacaacccacattcctgggccctgtcactcctagatcttccagaggttgttgatggttcttagggatttgtatttcttaacaagctctcaggtaattctgatccccaccaaagtttgaaaattattgctatcaatgttgtttgggaagatgatgtcttactcagaaatatgagtaaacataataaagtatagttgcaggtcagacaaaaaattcagcttgtaaggaatgcatgaagggatgttcatgaaatatacatttggcctgtccacttttgtcaggattacttttttcctgtcttgatcaatgcctactttctcttttgtctcattaatatttgggtcaagagaatattttatcaggtctccagtaagtacgttttcctagttacctaaatgaatacagtttcatagagatcattaaaatgtaccaagtatataaaagacagaaatttggttcttaaagctgactctatatttttgttttgtcttttcaaaagtgctcattgcaatgggaagctgatctgaaaatctatccatcaaaccaatctggtctcttacaggccgtggagaccctctggggatctgggatgctttcctgtcattgcaatgacactgaccggcttttgaaccttgagaagggccatgacaatgttccggcagtaacatttatttatacctcagggctctcgtctttcataggtcttggtttgttatcacagcccttgaaattgtaggaaagaaagtgtcaagaaggcaaatgaacttctgctactgggggaattatacatgaatgtaatttgtacctggcactgatgttccaagtgcgacgaacacgactgcagtcacagaatctttcaggccaatggtgcagccaaagtgggaagccaggtctccaatgaaagctgtcagtaggccaatcatgaggatggagacaatgaaacacgcccagccattccagtattcagtaggggggacgaaggcaaacaggaccttccagaacacagtcagaaagtgcatcacgtaatcgaaacaggagggcagcttctcttccccacattcatcgtcgtcatcatcttcccctagagagaatggaaggaagcacatttcatcacaacctgtgttgccgggtcttcctctctctcaatctctcctatctaggtcggtcatccctccactctgtgacaggaggccatgagaggtgggtgaagtttagggttttccaagagttaatcataactaatgaattagttatcaagacactgaaatgcctcttacctgtggctcattggtcaatggcaaaaacttaacccctacccagttctgcatccatgcaatcaacacaccctttctactttcacatctggtaagacttgtcacttcagagaaatgaaaatgatttattccaaaaggctggcaagccctgtgtcagcctgagaaataaccctcttttgaagaaagaaaactatagatggagttctactagggttcttttcttgcaacttgaagtccaactctgggttatataatcacctacaggataatgttcacacagggccgttaatcatggctctgagccttgcatatttctccagcgtcatctcctgcaactatttcaaactcaagccttggaattacttgccaaataattatatgccaaaaaatgaaatttatttgcatttttccaaaccagatacactttctcctacttttgttctttagaactaaatgtgcttggcatatcctaatcgctccacccttatccttcctcacccatcctttaagactcgcttcctctgtgatgcactctctgacctccccccaaacccatgctgggaactccttctcagaggagcttcccaacacttgtaactctggatcagtggttctcacaatgtgcttcctgagcaggtggcacagagaacttattagaaattcaaatgatcagtcccactgaatcagaaattggggagggggtggacagcaagctgggcttgaacaagccctccatgtaatactgatgcatggtcaagtttgagaaccgcttttctaaattgtacatgttcatgttctcttctccagttgactgagaacccttccagggcaggaattcatgcatctttgtgtccctgctgtttgataccatctccagcatgtgaacaaaggtggttaagtatgtattaaatgaaggagtgcatgcagaaatttctattgactttatataactatgcaattacctgatatatatatatcacaattttgccaattaagtcatattatcagtgtacaaagaaatgcacaaagcatgctatttaaaggaaccaggaaatcaataatagtaatctaaaatggagatttcacttatgtgaaaataatgcccattgacatgttttaaaatgaggatattgaatgtcaacttttcttgaagtggtggcaaatacatgtgttatgtggccattttggaaagaagaacatctccttgaagtctttgttgacccattccaaccttgtcatcagggtgctactttacttggtcccactagtgcagccggcagtaggtggggctgcaattttccacctgaaccacgtgacctgagatggccagcatggagcacacatgtatggtcttcgtgagacactctgtggtaggcaagccattgggtgcagatgatgattgagaagaccctctgaaagcacaagagatttgagggaaaaacccctctcagaaaacatctaaagaggaatgtctggatttgtcctctgtcattttacaggaaaagagaagaggcaatggcctgctctttcatgagcacatggttggaattatatgaatacactttgggcgtctgtgaagaaagcagcctcatctttgaggctttggataaactgctgggagaagccattgcagatgagtggaatagcctttggagaactccccagtgaggagcttgagtcaggtcagctcatcagaatgtttgtgagtgaaaaagcattgctgaccgtttgctctgctgttcatgcagtatttattatatcaactttacctggaagcagaagatactttttaataaaaacacctggtatgggctgcactgtgtctccccaaaattcatatgataaagctctgtcatcacctcagagtgtgaccttatttggaaatagggcctttaaaaatgtaattaagtgaaaacagagccattagggtgagttctaacccaatatgactggtgtccttataataggaaattgggatgcacagggagataccagggatgtgcgtgcacagaggaaagaccatgtgagtgtccagtgagaagacagacatttacaagccaaggagattggcctcaggagaaatcgaacctgccaacaccttgatctcagattttcagttcccagaactgccagaaaagaaatttctgttattcaaaccacccagtctgtggtatttattacagcagccctagcaaactacagcagcccttcagaagcctctctatatcatgacgtggaaatgtaggaacaattactcagtgtttctattacctactcttttttgtttgtttccttatacatttcttcttttttctttcttttactttccttaccacttctcttttaccctacactttagctccaggtagaactccatgttagagatgcaattctcagggtttatttgaaggaggaaggaagaagaaagtcacattaatacattcccattcccaggctctcctcttacccactccccattccagccggggctgagaagggtgcatatactcagaaaagttgagaaaaagcactaggttttctagttatatttattttggatcctatcctttttaatttctatatttgtgaacattttataatttcacagggcatatgaataaaatgctttggaaagcattttaatcaatcattcacagaaacatgaactatgctgccttttctctacaaaattacttaatttggggcatctaaatctcttattttgaagacgaacaagagaacaaataatgaagcttctcagaagaaatgccatttataaattgagagtagacattatatttgtcttcaagatggaaataacacctttcccgtgagagatgtacacaggaataattagatcatgtttgtaaagtgtctgagaatatttcaaggtaatgattatcatggtagttatcattatttccctccatttaagattgttactgtgtttctccatcattatttgtttagtcaacatgctaggtcctaaggttacattataggtttttaaaaacaaaaattaattttgccctctgaaattaccttcatgatcaattaatgcaaaatgtgtgtgtgagtgtgtgtgtgtgtgtgtgtgagagcgagagagagagagagaacgtgtgttctttctgtaggcttccaatatcacaaagaatcttaaatgttttaatgcataagtctggaatgggaggcccatctgcttttataacatttgaaaggaaagtggcctcccatccttttctctgggatctcactgctctttataaattttaatctccaactcagacatcacttaaatattaaaaatgaccacggactgccatgcatgatgcacaattaccctgtcttgggaaaggacaaagaaatatcatgttcatccatcaccatctggactacacttaaaagtctgttctttctttgtgaagagtagtgaaacattaaaaaatcctaggagcatcttttatgtgacagcaaaaatgatggtaggatgcctgttctgtggttctgtatgttcaccagcctagggttcctggaggctacataattctttcaagtcccttctctgtgttagaaaagaaagacaggttggtgggtttgcttttatagaatcccaagtaaattcctcttatctcagaatcattcttttcagctaatggaaaataacctgtatttgattaacccttcctattgccttttaaatggcttccctgatacacactggacttcttaaatataactacaaaagtaaccaaatcattaaaaatgcagatagtgcacagggtgtcagttcagctattgatgtaacagtacttggaccgttcctgctcggaaacatgagagcaagagcatcatcagcatgactgacggtgaaagacaaccccctgggctttgcatatatctttcttttaaagtaaacaggtgtttctttacgtgtctctctacctgctcagggcttgaattcagggagagctctgataaccagaaaaagagactgctggaaggtaatggacacgtgggtcagaagacttaagccactttatagttctgacagcttgttttggggcaagacacttaaatttcccaagcctcagttgctcacctgtcaaatgagtttcctaactcccatctctcagagctgttgtggggattggaagaagaaatgctcaagtcctttataaaactatatgcatctttatagacaaatgtgccatattccattattgttacttgtctgaaggaaggcagtatatcaatacaatgtgagtatcctgatttcactgagtatatattctgtttgaatgagccattatcattcatttccccaagctgcttgcttttaagaaaagaaagaaacaggaagggaacctggtggggtgtctcttaaatgacaggcactaagctaaattctttcacatacctgatcttatttcatccttaaaataacactgcaaagtgggcattattaatcccattatacatatgaagatcctgaagttcagagaatttaagtgacttgctaaaataatctcacacagaatttaagtgactgagttgggatttgatctaacagtccagggaacattttactatagaaaatgccttatggaagaaagtagaggagttcagtatcacatattgattcgaagtttgagtcggaatttttttaatgcctagtgttatatagatacagtggtacctttttttttttaggaatgtgaaaatattgaggtgccataattaatatttgtattctaatactttctagatacgatttttgggttgtttatttctttggcagagccagccataagctctttctcagacccgtggggaccaagaaaacatgggaaataaaacaatcaggtaaaagcaggggatcatggtgtgactgttttggaacctctatttttttctatttaaacatttgtttaaaattttatcatatgcatttgagattagcaatgtcatgttataagatatatttagatagtaaaattattatagggaggcaaattaacatctatcatctcatctagttactttttcctgtgacaagagcagttgaagtctacttatttaacaaacatttctaatacaatttcattagctttagtccccatgtggcccattcgatctctaaacatgtgcatccttcctatctgctattttgtatcctttgacctatgtctctcattgcctgccccaacccctgcccatagtaagatggtaaccactgcttcattcctatcttggtgtatttgagctcttttcaaacatatatattttccacatataagtgagaccatgcaatatttttctttctctgtctggcttctttcacttagcataatgtcttccaggcccatccatgttgtggcaagtggcagaatctcctttcttaaggttgaatcataaggaatctctcctttagagtgtgacaagttcttatttccatttctggttgccaaaggtcaaccatccagttctgaatcaaacatcttggtttgcctctagctcatcacccttgaatttgggaaagtggcctgaatcatcacaagtctgtatgtaaagcggtctggaaaatgtatgctgctgttcatctgcggatgtgtctgactttcgattctttccaggcactcagtaggctttctcctccagaattatgacttttttgcaacctgacatacagtaattacaaatcaaattctactctcctgttacatatttctgtttctcttttctttaaaggttctgagagaatcgtaaagaataaaagatgaaagaccttagcgatcagctaagaaaaataaaacagaatggtgattcaattgatacatttttgttccctagtttgcatctgtatatatctgtttgtgtatgtgtgagaaagtgtgtatgcatgtgtatgtgacgccataagggccagcagtttttactgtcttgctcataaaatgatctgaaacttcttttctttcttttcccttttacatgcttttaccttatgtctagtgacaccttatctcttcccactcttaatggcctctgccactaaattcagtaacccaaagatttattcccaaacaagagttgatctctcttttttttgtattttggagatgtgcaataaacatttctctataccttaattggtgggaagtacttaacatattctctgatgcaaagtagatgatgtcaacaacttttcttctaagtatattggaagacacttcctatcaacgatagctcagaaaacaataggttcgaattcctagatctatgagttgccagtgcacagaagaaaatgtaggcattttcttctaccaactgaaacgtgggtcttagaaaatacctgagcttaaagctttaggagggttttgcagtgtgccaagttcaaccccggcttaatgtgaatttctttaaaatttctctgccgaatggttacttgtgccacttctgagagtttcagctattggggaactcataatctcacaatccaggtttagagtctctggcagtcagctcaggctgttaggttctactcatttgtccaggccccatcccctaggccagtggtctccaaactttttggcaccagtgactggttttctggaagacaattttgatggttttgggatgattcaagcacattacatgtattttgcactttatttctattattgttatgtactcaccataatgtggaatcagtgggaaccctgagcttattttcttgcaactagatggtcccatctttgggggatgggaggcagtgaaagatcgtcaggcattagagtctcataaggaatgcacaacctagatccatcacattggatattaatactattgtacataaaatttgagttcaagtttgctatatatttgtaacttggactactggactgttcttggatggagaagacactatacaggccccattagccatccctacccgcttcttccaagccacagctaatctgtgggccatactgtcccacgggactagtgctacttcttaaggggtttgggccaggtgatgtgtgacagtattgtaaagggcgtcaagaaggcaactcactctctgttaataactttcaaacctggctgaaatgaatgaacatctagatgaaatcatccacaaaaaacagaatgcttacaagcttaagccattatggtctttgttggggtggttaacatagcacaagaaatatttaacgtgacagaaatatttctcagcaaatgtagccactgtccaaatgaaaaacggattcactaaggagttctagctccatgcaagttcgattattaccaaaacaaatctgtttaaagctgaaaattgatggctttagtgtctcttgttcctaaaaaaaaatccgctatatgaattgggtgttcctaaattacagtttaatgtaattagtcatgtgtgtttttgccccaagcttggttgtttataaaataactccaagttagggtaagaatcttgaaattcagagtgttctcttacccttaactaattgtaggactgacagaattccaagctcccgaaatagggaaacattccctgtagacttgaatacctaagaaataaggctttgtcaagtagaattggtactcagcaagtgtagatacctcctgctagtgtagatggtttagttacagtgggaagtatgtgggcacaccaggttctaagactggcctgaggactctgataacactttgtaaatatcaccagctgtgtctaaattagcctcctgtagtgtgggaagctgagtcgtgaagcaactgtttgggcagtgataaccctataatttttaacagacatatcaatgttatgtcctagagaatgttaacatgtatataaagggtaaatgtatacccaagtctgctccacatgcagaggggcataaatgctgcccagagcctcttaagatgctgctatgattcatctatgaatgcaggttcacttactgagtgttacttttatgcatgtaggtaaaagtgtacatcccacttagtcttcatcctcccaggagcctgctgcagtaggtattattttctctgttttagagatgaagaatctgaggctcacacaatttaaatgacttgcttatgagatctaaaactctgtcacctcgctacaattacatgacccatggtttccatagagaaaaatctctgtggtttgtacagcaaaaattcattctgataaaatgtaagctcacttagcattgttttatgaaaagtgtaatggggaaatgtctctcctccttaaattaactctctggatatgatataatacacaaaatactatattgttctttcagagaatgaatggctggctcaattttattcttcctggaattttatttaaaaaaatgcatctttatgcaaatcctctattcgtgatttatttcagcctcattgggaagtgggattctcctcattttggtggcaaacatctgtctctctgggcagcaaatggaaaggacgctggctctacagcaatgacaataacactctcataactcttttcctgatctcaggatctcctgaatggactctgttctgaacatagggtttgaaagttgacgtttgagcaaagtggtgatgcaaattgagtaacagtctaatgatggcctcggtttgcacaatacaaagtgatggcagttgctcaaggcacccctcatctgcctgttcctctttccttctttctgttgtgattttttaacgagatctcagtaaacacggccctccactgaccgtaaggtcccatgatttacttgctcttggccacctcacagatcctgtgtgcctcagtttctccttctggaaaatgggcatagtcaaaaccaactttctcttttgtgctattggaaaggtataaacaagatttttaagagaagttatatgcttacatatagtaaacttagttttggcttgagggaaattagctgattggtggaattcagatggagcatctccttccctcactgctcctgaacacttctattagagggtaagtaggctaaggtgggtgctgacaatcttgtttgtctgtctgccatggctttcttgtctctcataaatagtaaccatgcatcacgatgttgtgatgtttttcttcaatatcagccatctggaaaatctctctttccctcctattgtcaataagtcagtggcctatcttttttatttggtcaaggcctggtgcatattctattaagtctgtaggtttgaactctaaaatattttgggtcactgttttgcacctcaagcccaggctgaacccctaacctggacctctaggaaatcttcaaagggaatgggatggttggaagactgactttattagtgccactcatttctttagtaagtatttattgtcaacttatgtatcaggcacagttctaggcattgcaaatgcagaaaaataagatccctgatctcatagaatttccattctggcaaggggagatagtaatcaaagtaaacaaataacaaatataatatgtaataatttcagatactgatatgagttatgaatataatgaagtctggtgactgggaggccgagaaacccctctgagcagttgacatgtgagctaagactttagtgaggagaaataatcggatatggagggaaagtattccatgcagagaaaatatctcatgcacaactgtgtagagaacagaaatatgcctgtgtcctactggcattaagctttgggaggcaagtgtgacaagatggaaagaggattgacttgggaatcagaacttgtgggtcagggtgggaatcccaacttcaatttctccatttcttgtaaatgggttcatgagtagctactgcacgaggctgctgtggggcttatgtggatataaaacaactattcaccaattgggagaccatttggtcactcagtgctgctaaggtgttggtcaggaaagcttcaatctttgctttgtctaatcctaaggcatcacatcaccaagaagcccattggtcagtaggtaacatcagagggcagacatggagtatctgatggttaaggcgttggttctacaactccagaagaaaaatgagcaatgctttatggtgcagcaggagccttgggttctaaaacagtctctctgtgatcttggaggagactccctctctctgttctcaggttcttatttgttaaaaaaaaaaaaaaaaaaaaggcaaggggaggttagaatcactgctcctttccagctcggggccaggattctaagatgctctatctaacaggccataagacacaacacccagccagacctgaccaggcaaaggcaaggcaagggagaagcatgcggtgggatgtatgtgccaaggttggttcacgcgagtggcttttcattgcaggagttggaaagacaaggtctttatcaagagagcaggctgtgaacagcaagaagtaatgctgccagtcacttttatgtggctcctctctgcctatggagagtgtttgtgtgtggtggagggtggctatggtttctcttccttccacttctttgggttaggctgcaatgtttcccctactgaaaacagcatacaaaggctcccgactggggatgaaaagtcccctcatgcctcacaccttgatttgcaagcaacaactaaaactgtattcacattgcagcagcccatgccaacaaaagagctcttggacccagtgatggcacattgtttgcagagcagagctgctgccaccccagacaaaactgcgttagagacacgacttcgggcatacaaataagagtgctgaatcattctagagcccttcaatacggtgttttcctcaagattttataatacgcaatttaagagaagaacagaccaatgagccaatattcttttcagaaacatcagctaaagcatatccagaggccagaaaataattgctttttttctcccaccctctcgtacttccacctttgtttctggcctgccttgttctggaagtggaaactgtagctacccgattcaacattttctcctgctactgctgcatttttagatcgacagatatcctaaatttgctttgctcacctactagtatgtccctagaatatctcccataaatagtttatatctggaacttactctgtctttcttcttagtcatgtcctccgcttttcctcttaggatcatcattatcagctacataacagtgaaattttactaagaatacttaagaacactgagagaaaatgtcattttatatttgcatgtccaatttgcaaatacacagataaatatatcttatgtgtacaaatatgtgaaagttcacatctccatgtcaagtgatatgaagtttgacatagagaaaacaaatgtctcaaactccttttgaaacatggcgtgtgtatggtgcgtgtgtgtgtgtgtgtgtatgtatttatatagattgttttctagatcagacacagtatgatgatgtcttttaatccagttatatacggattggaaaactttaattcacaaataaatgtattcattctttataaaacaaagacttagcattgccaagcgctgtcttagtgccaagcactgtcttaggtgttagagaaatagcgatgaacagggcagatttgcggttgttgttgcttttttttatttagattcttcctacttctaagaggacttgagcagatctgttcctattaatagagcataagatattttaagacaaaaataggacaaaaaatgtctgaagcagaaataaaggatgcttttagtcacctgagttgactgaattttgaacacgtagattaaaaaaagactgtgctttccaatggccaaagcaatttagaaaccattgaattatatagttatgatcttccagttgcaaggtgacaaaaattaattttctagggaaaaaagcttctctttaggaatttatcatgttttctttaaagtttagtgagtggcattgtgaggttttataaaagataaagtactagctttcaaatgtcatacattaaagataaaaattaaaattacagataagttaaactccaatgagggcagttttaaaagaggctctgataagaactttaagatttactttgtgatatccaattctcatcaaggatgaatggctattgaattcacttaatgtgaccattaaacagtgtattttaagcaccaaatgtcttaagtgacatattgtgaagtcagtgtaattacacactttaacatgtattctaaggtaggtattgcatcttgattaaagttagagtcctaaatttctttctttttattaataaaaaggaaattctttattgggggcatgacatgcacagaaagtatgtatttcttgaaaggtacttgaatcttttgtatcactctcttacataaattctggtgcagcaaacaaccttccaatatatagttgtttatgtgcaatgaatacaggttagaaaaacctccaacatagtaaaacaacagataaatagagttaatgtgaggcagaagaacaggcgtgagacttgtagtttggatactacctctgcagttttttgttttgagacacagtcttgctccgttgcccaggctggagtgcagtggcatgatttcggctcactgcagcctctgccttccaggttcaagtgattcttgtgcttcagcctccctagcggctgggatttcaggtgtgcaccactacgcctagctaattttttttttttttttgtatttttagtagagacagagtttcgccgtgtagaccaggctggtctcaaactcctggcctcaagtgatccaccagcctcagcctcccaaagtgctgggattacaagtgtgagccactgcacctgacctcctctgcagttttgaataagatgggtctaccaagaaaagcagggtggcagcttgggtgggacactcagcaagacctggatgtgtaataattacacagaagccaggcatggtggtgcctgcctgtagtcccagctactcaggagggtgacactggaggatcacttgagcccaggagttcaagggtacagtgagctatgacatgccactatgatgtgccactgcagtccagcctgggcaatggaggagaccccatcttttttaaaaaaatagaagagagactataactgagatttcaaatttccaaattcaattttgtcagtacatttcaaaccgagaaaatgtcctaaatgtaatgaactagcttacattttaaaaaaatatcacttacaaggatggattggataatttaaagatacctgtgaagtaaaattagtagtaatttgtgtgataatttagaactctaaatttcaaatagcagttacacggaaagcaagttggcattttatttatgagaatgaagggtctttaagagaccctttagtatttccatgtcctaaagacaactcacaaggtcatctcttctaatgctattaactcacaggggaggttagaggtcttgtccagagccccataactaattggtggctgcaccagaattcattgaactcaagtatctagagaagccaaagattccaacaaataaagaatttaaacactttatttgtcatccatgttatatgtactctgtatcacagagaatgggaatcttttaactctacactgaaacaaggaataagagctaagttggatggcagcagtgttgctcatatctcctgttggtttcaaataactactatttgacctttgttcctacctttttcaagcatgccagtgattccaagcctgaaacaacctacctacctagataactaataatatcacagagaaagagcaggagcttggagaaaaggctgggcattgattccattttgtttcataagacctgacacaatttctagctccagatataaatacaattcctacaccacaaaaacattccttatgatgggatttagtctggactttctaggaaatccagtaactgatcctgcctactttctaggactgattctattcttcctggtccttctgcacttctgtcccaggcttgcacactcatttccaaacccttaccttccccatgtgtaactgagattaaaagacttgttaacttcatcccttttgtcctgaattaactcatctgaaatgtgagcacttgaaacctaaactaaagttgtaggaggaacacctaggattgagctgaaagcctactggaattagactcacgatgatggggtttcatattccagctaatcacttgctagttgtgtgaccctacacaagttacgtaaccactctgggcctcaggatccatagttgttaactttgggaaaaatgacatagctcagaatataggtgaagaacagaaataatgcctacaaagtaccagccatgtcatagaagccaaatggtaacattaaacaaaaagtgggccacaatttttaatttatttttatttattcttttttttttttttttttttttgagacggagtcttgctctgtcacccaggctggagtgcagtgttgagatctcggctcactgcaagctctgcctcccgggttcatggcattctcccgcctcagcttcccgagtagctgggattacaggcacctgccaccatgcccggctaattttttttcttttcttttttttttttttttgtatttttagtagagatggggtttcaccgtgttagccaggatggtctcgatcttctgacctcatgatccgcctgcctcagactcccaaagtattgggattacaggtgtgagccactgcgcccagccaaagtgggccacaatttcacactcatatgtctttgacaaagttttcttttttgtttttggagttagggtcttactctgtagcctaggcagtctagtggtgcaatcacagctcactgcagccttgaactcctgggctcaggtgatcctactgcctcagcctcctgagtagctgagactacaggcatgcactatcacacccggctaattttttatttttttgtagagatggggtttcactatgttgcataggctggttttgaactccttggctcaagtgagaaactttcttaggacagttctacctacttttgctcatgagactagcatccttcttcatgaacctcagtcaacatatgattttagacaaaggaaaattatgaatgttgatatcacataagaaaaagggcaaaatgagaaatcccattggtaacaccctcctcctttttttggttgtcttctagacacactgaggctatgtcaaatctgacacagcagaattattattattattattattttttgagatggagtctcgctctgtcacccaggctggagtgcagtggtaagatctctgctcactgcaagctctgcctcccgggttcacgccattctcctgcctcagccttcctagtagctgggactacaggcacccgccaccacgcctggctaattttttgtattttaagtagagaggtggtttcaccgtgttagccaggatggtctccatctcctgacctcgtgatccacctgcctcggcctcccaaagtgctgggattacaggcatgagccaccgtgcctggccctagcagaatttttaactgcttaaattggattttcagatgacctaaggctaccacaaggattaagtaatgacaatttccccatagtaatgatgttcaataacagacgagatgctgaaaagtctcctgcttagaccagatttcacggcaatcccttgaaactcatttgaggtaccatttttattaagacttttagagtagattagccttcaggctgatagtcaagtgaattattgtccaggggaccactgagttgacagtattttatattaaataattgaggatattaatccacaaagcatgcatggatggactgatgacagaagcgtcctttaaactgaactagtatccatattggactggtgggctaaggtgacatgccctctacttatttatttagctggaactgggtcactttaatttgctgtgaaatgtagtgagtgtggacaggtcagcagcatgcaccagctgggcctcatgtagaatgtcttcccttgtactgtagaagattccactggcattcccgagatccaattatgtaacaggaagataggcacttctgaatcatcatctcacttggctttctttgaggctaaacttcaactctcctctaatccccttccttctagaagaacagaagtgaagtgtatgctgctattgtgctgaatatttagtttaggcaagccagaggatgggcaagatatgcttttccattgtcaaaatccaacgggccatgaagcaaaatccccatcagggctactgtaggactataatggccatcgacagagctcccatgtttcagtattggatggtatcttagagctagcctagtccaactctctccttttcctgatgatgaaaccaaaaatcagaagtgttaaattctttgccaagattatacagttggtaagagacagaaccaaaactgctggagtttttttttttttgagtcacttttgagtattctttcgttataaagatgccaatacatactatgtctgatatgcaaatggatatgtcaaaagtaaaacaatttcaggaaactctttaatgctggatatttaacattaggtaaaagaaagagggaggagtgtgttgacttcaaagaatgtcacaaattactaggcaggataagcctatgggtgcacctaggaaaacaaattcttccctttgttcttcagggaattgactggcatcctccccaaggaacttgtgcactggactataaggagacctaacaaatattaaggaaaaaaaaaaaacatttctatttcaagctgcggctccaatatccaaacaaatatctactatataatgtgcatgtctatgtatgcatgttttgtgtatctttgtctttgtatgtgtgtatgcctctgtgtacgtgcatacctgatttgtatgtgtgtgtctgtgttcgcacaatgcatgcatgtctctgcgtacctgtgtatacgtgtgttctacatgtgtgttcactcaggcctcatgcacagcaagcaagtgcacccttcatgctggagagactgttgggctgatttgttgcctggtactgccccttaacagttttgcttcttgagcaagtagttacattgtttttccaaacctcagtgttcttatttataaaatggtatgcatgataccatgaaagaaagaagttaaccagtgtgtttttagtcccatagctattttattaattaaattgaattaactgcatttgcacaaaatttgatcatattttattataggttctataatagaattgcctcccaaacaaccaactttggcgtttccatgtacagatggcctttgtgaaaatgcatacggtttaaattaattcttatggcagctctatgaataaagcagttatctctactttacatatgagcaaactgagattctgaggtgtgagcgaactgagatcttgaggtgtagtaatcttcctggagtcatccagggaggttttggaaggcagggacacaaacccacacctgtctccaaagccagccttgcaatcattctctcctttgcctcacctctgcccaaagctgttgtgaagaacaatatggtggttgtggaactggcactggcatcctggttccctttatccagctaatgtttgccctcttctctgacacacttgtttcccttgatacctcagctggcacacgattttttagagtcgactcaccattctgccctggtagaaggagagagatttgggaaaaactcaaactggacagggaatgctggcttcatggagaagggcatatgctggcacactttaacagcacctcgtggtcctggacttgccttgcaagttttgacagccattgaactgcagaacccactgttcctagtgttcaacccaggaagaaacagaaggagaactgccaggatgtaactgcttaatcgcttcctaatctctggattctcataaatcctttaactcttcaaatatggaattaaaagaactgggttggcagaatcattatggtcacaggaggcccaagtactgagctatgaaattcagaaaaagcagagggacaagaagattgccacagggttgactttgaaaccagtttgaatacagttactgagaaagaaaagcaaatccctatttacaaaattattatttttgtttagcgagatatattgagttaattttgcacagaaaattgcatagcaaagaaacctctcagtagagccctttaaaagcaatttaatatttgtaataaggcaaattgtactgactctcaactatttagccatgaaattttaaaatccaatgaaagtctgacttcaataaatgctgctttacaaattttattgcctgtgtaacagcctaagaatactgacattctttagacagttaaatttaatcataaagacaaatactcaacttttgaaactgcccttcatgtaattgcgtataatttggtgcttttaaaacatgggtttgactttctgatatgttgtttctcaaaattgtaaataaggtcaatttacccagcagcctgcgaatttctaagcaattgtgccttatttccaagcggtcatttagaaacataaagcacaatatattgtatgacaagaagacttgagaggtttcatatctcagttattaacaattcttcaaaagctctaggcaggagttagttccatcatgaaatgatgacaccatggccgcaggtaatgtgacgcggccagtctctctgtgagagtagggagcaattttcctcattttgaaatttccttcttctaaagggcagtagatagcacactggaccagtcttcattagatataggatctaaggtctgttctaaagacatgttgcctctctcagactcagattcttccttaattatcgtaagataacgataattataatattaaacacaacatatgaaagtgtttgcaagtcaaaatccacctcttttaagtaaggcagtattaacatctttatagttgtttctctgtatacctattctcaccagaatcaaacacatgacactggccttgttggcagcataatcccattcactgtttaaagctgcccttttctattgctatagactggtcatagaatgtttccttgttcttgagagtcataaaactatgtgaatgaaccaacgtaaaccactcctctgctagaaaagcaaatttggccttaataggtctattgatggggtcatctcggccatctctctgaaattgcagactctatacgtatttcctgttcccttccacagctttgctttcctctatgacaaacttatcatcataaatatactttactttaatgtatctgtctgatttactgtatcctccattagactgtaagctccacttgggcaggggtatttgttgcattcgctgtcatgtgccttgcaccaagaacaataattgacatagaaaaacgaaggaatgatggccagcttatggttgttatacaaatgctcatatacctgcagctaagaaaacagaaatgattagaaatggttcagtataaggcttaggatgcttttaatgttttaattctaatatgtcaaggcccataaaagagtttgttcatttttaatattttctactattggcttcgtcagcagtttcttattctagaaatttttgtctgcttagttgtgtctgtgaagagggagtatagctcatgcctcatatattaagcttagatttatagaaaaacataagaaataaaagagagtttacccctccttctattagagcttatatgcaaattccaaatccactctcctgagcagttacccaccatttaatgttcataaattcccactatatattcaattgcaaaaaaccaaagcaagattataaacacactaataataaacaggcataaaatttttactaccctctcttctcacagcacttgggagatgtgtcaaattaccctgtggcagactggaaaaagggatttggggtagaaatcatggcccaactgctagtgacgcagtttccaaattttacagcttgggaatcactacgtatttaggaaactctacctttgttaattcgttgcaactgtagaagatgagcctggagggatctttaaagagagccagtgtagatggagcagaagaacaggaaaaaaaatccaaggacggggttgctttcatgaatctttaagagggactttcctgtatcgttatacaatcacacaaagagtggacagggtttgacaatacaggaagagcacacctctctctctatttaattccctcatgtttctgactccgtgagtttgaaaaacacttcattttgtaggaacttcctaaataaaactctgtactttgcttgtgcaagaagaaacagaatgtaattctatttctatttctagagccagtgcaaacacgtatttgttgcatgttgttgaagagagtgtaaaatgatgcagatggttgtggtcaagtgtcttagtgtcttccctttccacctaggattttgctgctttttttcttgaccttgacttggccacctttgtgctgcttacagggaattttccagacaaagcctagtgattggctattcgtgaattagagacacaaaacgctttaaatttatcttgtctatttccagaaagatgcaatatagatggaggaaaatgtcatgtgtgaagacatttgcttcatctagatagtcaatttagtctttaaaatgtgcatacattaacaaataaacttatttctcccttaattttgccatggaagccctttggtgctttgccatagaccaagtagccacagtaggaaaactcagctcagattgggcaattttaatttataatatgcagagaaaggcactcaccagcactgacagtgatagcttcaatgaactgttctctccagctgttagtcccaaccacaagggccaggtttgtcttcttaatgagtttgtccacagtactctagaaatgttgaaaagaaaaatataaatgctgggttcgctaaggcctcaggaaatccaagaccttgttgattttgaaactccagagttatataaagggtagcagatgttaggctcaaaacaacagtattgacatcaaacactgttatgattatgcaaacaagcatggtccttagttggaaacattctgaaatggaaacttctttgtagcaaatacaagtctccttcactgactaatgaagaatagcctcagtgtttagaatagcagatgctgcaaaagcccatccatccccctgaatgctttgccaacttgcttctctgctggtttcatctgtagtgtttcgtctgcaagtgaattaacatatgccctattcagcactacatatctgcgaatagccggaagtgacagattatggaaccaaaaaatattgctattgtattttgtttatcaatgaaatgtagccagataatggagtctccaggttgcctgctgcatggtcatcaataaatggatttgtctctgggtactattttgtcagcctcttgcctcttagagaatctcatgctcaccctattcctattgcaaacaagaatacacaaaaatacaagaaaagttcagttcttatggtttagggcacgttgcagtttaccttgccctaaatctcccctgctttactggcactgtgctgcataccccttatttttctttggaactttttaagcaccttgttttgtacaatcagtactctctagctttctaaattcagttaatgtaacaacaagagcagccaaacattcacgagaaaactaagtaagcagatggactgaaagcactactgcaagtcatggcaactacagggagaaaagtcatttccaagacactaaggctgctcatcccaagaaactaccacagtgactagtctacgaaacatccacacttactgtcagagcatccttgaatttccactaattgcaaagaggcagaaaacacattatttgtcataggtcgaaatctgtatatgttttatgcaatgtacttgagtggactatggtttaagagagcacatttccaactaactgggagtaagcaaaatgctatctaaagggcttgtattaaaggccaaaaccaaatcataatatcaagcatgtttgctcaagaagagtcattggaacagacttgaaacattgagaagataataagcatgaaagggcccatctccaactggctcactctgtattcatgacattattcttgaaagaattgtatgtccttacggtgatgacctttcagcttccagctttgtgtctagaactgctggtgcccctgataacagctgtaaccatcactgctcttggccaccataacttgaagcacttgaccagcatccatctttcttttctcaactcagccacatctcatcaagtactctgaccatcctcactgctacaaattcaaagtgccttgtagaatgtaataagaaatgacctcgatttttcctaatgtagtggaaacttgggacagttctctccaaagaggcactctgtgctgaatccatgacagagtatcccatcacctgggaaataaacaattgaacagataaacttctctaacattgagcacagactttcctcaagaaatagctgctaaagaacaaatgtttaagataaactaaacttctgtgtgtaaaactcagggtagattttaaactgtagttcatgttaatcctgggggattatagtatagccagggttcttcctaggacttaattttcatatgtatccttccttgacctatgggaaaaatgggagtgaataaagatatagttcagacacctgaacttggacactgttgtctgtatttacctaggaggttcctaaatgcttgtgatcagtttttcactgcactagattttcaaaggcttgtgaaaacctcaccctcagcaatgggtgttagtaaaaccaggtcctcagtcacaccatagtaaataagaactcagtgggtaaagcagagtgggccattgaaaggtaccacccagatttgggtctctggtacagttctgggagctctgagtaagttctttaaaatacctatgttctagtaaaagagatttcttaaataatataaaatctaggctgatacgtaagggcagttctaaaacatgcccctaacgtgccttgtaggtattaatggtaactatactgatgaactttgaagagatgactggaaataatctatggaagctatcctacaaagataagtaccccaaacaactggtttcatgtagagacttggggcactttcaaatggtcagatcattatagtggttaccagaaagggctttggacccaagaaggctttgctgcctggaagactgtgcccggccttgcttaacttaatgcttcttatgggaagttactatgattgctcttcctgtcatgggtgcatggaaggggaaggtctgagatcatcccataagggagagaacacacaattccccaggagaacccaggcaaagggcaggggcaagcttgcttcaggaataccaacccatagactctctgctacagaaaatggcactcagctctctgattccaaatgaaaagagggtgaatgaggaagagggaggttgaacacacatggagaaaagatgagtagatgggtcaccagaaatggacagtctgagattccccgacttctggaattacagggaacttgtgcacattccaggcatggttgtgcaacaagccaagttctgtgtcatacaatgggggtctaatgatcggggtctgcctagaaagcattggttccactgtttacccccggaccccctcctcctatggaaatgtgtgaaagaagagttaacagacagattctcagtggcctaaaggaaaaagattaattgcatttttatcttaaaatattccactttaatttcaaagacattttgttttccacctgtctcctatcaggcacctccatttgtgaagtaaattaaaaaataattaatggatccagctaaaggaaaagaggggactattatgagaagtccagataaaatctgaaacttctaaattggtggtctgattctctcttttgaaaccttcattctggtgtttcaaacaggaacagtgtctgcttttgaaaagtaagcaggtaaaatactgctgtgctctgggtttgtaattctggaaagcaagagaggggatgcacatttcatatcccactgcagaactgaactgtttcttcccctgtggtcttcccagatgctagaaccatgtagggtagaagggatgggaggggacagagggagcagctaaggatcaacaggaaatttcacttcaaagtcttaagctccatccccaggcccacacattcaacttctgcaaaaatgacttttatcatctagagaactgagaatccaattttatcagctcaactgtaaactccggttgcaggcactctgcattcggtatattgactgtactaaaatgtccttggatctgaagaggatgattaaatataaatgagagcttgtcaatgggatgttccatagggagatattactatccccctgcaaaacaaaagcctcctaattttcagcagtgtgaatgccttgctctgacagatttattagcattttcaaatagaacttggtttcttccacacataacaatctcttaggattcacctttgcatgttccttgctgcccctcagattaaaccttccctttggggcacctctgaccttgtgcagtcatagatgtctcctgctgggccctggttcggatgctgtttggtttacaggactccttggttcctgattaactctataattccaatttggccccaaaggctctcaattcacaagccagttcctgaaattacatctactactctttccaggtggatcttaagctttggccaaccctatgaacagtttctgtcccaaggtgagactggctcctggtgggcagtgttggtgagcataccttgaattcataggattcttcaatgatcacttccaacttggtgtgctctcccaggatggggcgccccatttctgcaatgcgcctctcctcttcctctttgctggtcagtggctgcttgtcatcatattcgtctgtgaaacggaagtatcagagagtgagcactgtgttctgtttaatttggaaatccctggatcctgccataagaaagccaaggaggaaggaagccctaatgacctactaaagccccctgggtgagatcacgatgctggagggaagagccagacagacacttggcatgtaaggcagcatatcactgtgagagcaagtgattataacatctcacaatctaagctcatgcaaaagttcagttgaggaaaagtaatgtatggggcatatcactgagaaaagactctgcctgtacattgtctatggtaagggagtcacgcagctattccctgtgacgctggctcagttggctgtttgtacacattctttcagcacgtgaccaaagggaaacacaattgaaagtgctagagtgaccctcagagatggcggagtctggcctcttcctcttcactttctaggggcaacagaaaatgcctgaggcccaaagagatggggaacaggaaattctgactttagcctctctcttgccaagagaccctattgcaagttaaacagcaaaacatccattccatatttctgtgagacgcttgggctccagtgctgcttcagtctggtgcaaagccaaaatttgttaggaaaaccttggccatgttaatcttaaagtaaacagggagggcgagggtgaggcctttcgggagttaaaatactcactcaccatgtgagcacaattatttccagaactaccatgtagcttacagtccaggagaggacggtgggtgctgaggaaatgttaatggatccaagagcccattaatgaggggaagctcacagttggctctctctttgtgaaggtcattaggataaatcccagactgaaaaggccatgcatataagaagggcaaacactggtcctataattacccttatcctttaggcccagaatgctgaaacaagacaagctacttcttctcagatttaagtggaatgaacattgtctccaatgaaacattatctgatatggaaagacctcagccctgatggcctcatttctaggacctctggacaaagtgcctccaacagggggctgttgactaaaaagacatgcaataaaagggatgtttggtcctggcttcctgcctggtgcatttaaatattagcttctgtagaagtccatacctcccattacctccaaagacccatggcctcccccctgctgagggaccacgctatggtggctccattgttgctttggcagctgttgcagggaatgaatggttcctaggctagctgctcgttgtgagggcagggagtgaatgagctagaggcagtgccagcatttaatatttcaagggtcaaaaccaacaaaaggcaaaagcagaatgtagcatattgattaattctttagtatacattttatagtgtcatcctaaaagcccattttaaaatctgctttcctagcctcagagattacagggcaccaaataaattagttgcagactaaaaataaatgattttggactggccagaagctgctgaatgttagcagaggcaaaggagaggggcaaggagattaattttaactataaaagtggcaatattttttatagtaggattgggaagttatgacccaagggaaggcaaagagttctggttctccaagatttgtccttgcaaaattatgtatgtctagtcaagagaggtggctgagatacatgaagtgcaatttatccagcactgaaattaataatgttgattaccactgctttgtgatccttgaacccaggataatgttattagtagttttcatagcagtagtttatgctagcatctttgtttgaaactttggctgaacatggatgagttgaagacttacacagaacaagaatggttttctcagaagaaggaatattacaacttggacatctatttaaactgtgaagctattgggggagaatatttattatggccttctttttgtagtttacttataaatgacaagctgcttttaatgggactcaaggcaatctacctagaaaaaatagagaaattacaaaacaaagctgatgtggtagcattgttaagtgcagcatttcatgaaattaaactggttttgatcatggtattaaataactggacatggaataagcaaatgaagtcaaatcatacaatgagtgaaaaggttctttcttttccaaaaatccttcagtccttctgatcaggaagaaatgcttaattcggtgctgttaggtctgtaactagttcctagtatctcgacttttgtaccttttaagataggtagtcaaaatagttctcaggtgtagagcacttgccatcatctagctagaatttaataacttttttccattgtaaaaattttttaattttactttctatttgtggcaaacgatactagttttcctgtgttagtgacttaaagttttcttttaaaaacaaacttaataaagtataaacatgaggcaattttaaaaattacattaagtaaatagtatagttggtatgcaaccaaagcagtatgggaatgacaaaaattaagaaatatagtgttaacttatttcatactaacctaaaaaacagtaaggcacactgtttctatcatttgctacactcttgcttcaaagggacttagatttcttaattccacacttttatccctttatgtattcacctggacaagcttcacaattttcattttgttaaatcttatctttcaaaaccccacctcttctggcaggaaataactccctattgatgagtgagaaggtttatgaactaccactctaaccttatattaattccttaatattcgttgtgtgtatagaccatggacattttcatagactgtttttaaattttttaattatctttacatataaatatccagcacataaactcactgagatagaacaataagtttcattgtgctttgaaccatccttgtatcctctggcacctattacaatatatggaatatagtaggtgctcaataagcatttgctgtgtgactctccaactcactgttaataaagcctcttagttgctcaacccatacaaaacggatcattttttcattgagcacatctcattgtactccataccatgtcagcacttcctcctctactttccaggaacttatgatgtaatggggacaggactagacaatgggcaacttctaggcatgataaggactaggggaccagggttggggaacaactcagttggcctaaagggagtcagggaaggaagccttcctttcctgaaggaagcttcaggaaagaggagctatttgaagttggccttgaagcacatatagaagattgccgcccggtgaaggtgatggtaaggatagataggaggtggtggaatgcggaagttcattccaggcagagagaaatcaaagtacaatggtacagggtcatggaagggtcagggcagttttgacttaagtatcataaacttttatttatatgtaactgagaaatggcagctgtatagattctattattgctctacagttatactgataaattcacatttatggtctagatttttgactggcaaaaatgagagccaagtctaatttttaacaaaactgttttctgtctttagatactttctgttgaatacggaaatggtttaacagcatttttaaaattttaatcatctattttgtttccttttctcttggagcattggatcaaaagcagatcattttactatggttgaggtcagtttcatttctttacttctgcagagtgagataatatgctgtggttttagttttctcagatggaaaatatactctttctcctcctgagtgcacatgcacacttttaaaattcaccatattttattgagaagttgggaataaattacataacatcatagtcttaaccaatccaaacaacttaaagatcaaatgcataattaacagccactgctaaaatcaatattgacaggacataaaacagtcctggaatagaatcaccagtgggggatctcccttctcctgagtaattgattttgcaagcaatagcaaataataaaagctaataggtacctggcatctggggaaagcagcattttgagaaagctgtttctaacgctctctggttcaagctgtattttgaagcagagtcagtgtaagaggtgaagtgctgagagtgggaaaacaacacaacccataaggtccatctcattatcaagatctctacctcaggggacactgttgagagtcttcaatgtagtcacattttaaaactgtacaaacaacgtagaatttggagaggcggacaaggccagtggtgggacaatttgctccagatcattttgatcctccactcagaactatgctgacaagtcagaaagcagaggtctctcctgacaatttttagcatgtggctggcctctttgattggaggctaaagtgactgatacagacccaaatatcattagagatgatatttgggctctaaacctgtattagatctgggatagctgtgtaatcctctagtcaccctgtcaatgtcatttatttcccctgtggagaaaccccacagatgtactatcatctgggcatatctggctaacatcatgttgcctgggggcagcaagggcaggctctgggaagaaatacagctcagctttaaaagaaacttcatggttgggcaccatgactcattctggtaatcctaacacttggtgaggcagaggcgggtggactgcttgagcccaggagttccagaccagcctgggccacatggtgagaccccgtctctacaaaaagtacaaaaagtagctgggcatggtggtacacacctatagtcctagctactcaggaggctgaggtgtgaggatcccttgggctcaggaggttgaagctgcagtgagctgtgattgattccaccactgcactccagcttgagtgacagagagaatccccatctcaaataaaataaagaaacttcattacacttgggataaaaactgatgtgcgagaagaaatatttccaagaaatctggaatacattaaaactcaggaaagagaggccatgggatcagtcttctctgcaggctgggctggtccctactcagtgctccttttctgccctcacgtgcttgtgttttgttgtaatccaccgtaccactggctgccagagaagctgcagcattatttagcaatgttttacagaggagaggggctaaaatgcatgactgtaatgtctctaacattaaagaactctgggaggctgtggttttcaaggatcatgatgaaatgagtacctgcaatggtgattacagtagagagaatcggatgttctctagcatgaaccttcctgaagacaggttggcctagcaaaaggacaggcagaaaaatcagcagaatggattgcattgatttgctatcagagctttgtggaattagtaagctaaacatcacacccagatgcacacatcacaagcaacgttagtttggggattcaatgatcataggtcacccctaggtaggtcacagaagggagctctggtggaagttactgatggagatcactgctcagagatgagcgagtatttcatgagccaaacaagactgtgtcaacaaaccacaagccccatggtagtgagtacagccagattcctacaggtatcttaaatgatgtgtcaaggtccttcaaggtaccgcttgcagaagcatcatggaacaacaaaaggtatagtggcaggtgtcgtggttggcaagccagtcttcatgactgaattgaagtaataatgtttttaagtcaaccattatagaaatagtgtactagtgattgggaagcctattagtgccaacaatatagccttgtgtaggccatttctccagtttctccccatgtaaaatggtgataatagtacctgctctgtctaagacaggcagaatgttatgtacgcctgtaggttttgcagaggtaggccatcgtcacagcaactgtttggataacctagggttaacctaggcctagggggttctcattgaactcctggttcagctgacttccagattcacttgctatttgcctctaccaagagctacccataactgacctgggagtcatgagatttgggattcagtgccacctctgccatatgcttgtcatctaaacttgggcaaggtctttctcctctctgactctcaggcttctcagttataaagtgaagctgaatttgaacaggctttgttcctccagcctacagactgaagtgatgaaaacattttcaactgtcagaattttcatagtttggcttccttaaaaagtcttgtgtcttattaagtctattatgtgctgagcataataggattagaggagtaatattaaataggtatactgactgatttttaattagagaactctatatcttagaagttttggggatcaaacttacattcttctctccatagtgagccagaatacttaatttattaaattattcatgtttatatggtccagtttccccattctggggtacttctcacttttcacttaactggaagtcataatgatggaatttattagatacatgtgggttttgagtagaaaaggggttcaatgtataatttcaagatgcaggtagaaataagctagaggagaggaaacaggacagtgctgggattagaacagtcatcattaatttcttcaaaccttcatttcctcccctatgtgtgagaacaatgtcttactctataagattggtgataaagtgatatgatgaaaaagaaatatttacaaactctaatgagttataatatttagagtgttaccttgtcgtatgactggaaggtcaagggggaatgagatcataggcccaaacaagggcctttcaatgaggcaaggtctgggaacaataggtaaagatctgcagattccaaaagcacctccaacacttaatgtccatcactaatgagatctctgaaatattggtattaggctgtggatcagacgattttttcaatttccatatattctgcttcaaatttagattttcacactcagctgcgcaagtccatgtaaaagctgcaggcaaagtcccagggctagattaattcttcttactgcccctgcatctcaaagccttgactttaaagcctccaactgacttccaagaaaaaaagttctttagggcttgaagctgcttttcgctgtagacctaagttttagaactgtcctcaggagcatcagtagagagtggctcctaggcattctggtttgatttaggaaaagaagggtcatgtaaagtgagacgatttcttagaaagtaggaatggacaggccagtgtagaaattcccaagttttggaacattctcttgttctaactgcattaatttcaagtcttaggaagaggtgatggtaataggaaactgccatttcagattacagtttcagccataggaagaacttaatgaactaactacatgaaatgatagaaacctttgtaggaggtgattctgtcatcttggatgccagttgtggccgaggcaggaaaagttggatattatcagacagatattatagaatttgatgtaaagaagttctgagaaaagaaaactaggatcccattacctgagatattaaaagggaggacagttcaaatgacatagaaggaaggcccttaaaacaaaatttgggccaggtgcggtggctcacgcctgtaatcccagcactttgggaggccgaggtgggtggatcacgaggtcaggagattgagactctcctggccaacatggtgaaaccttgtctctactaaaaatacaaaaaattagctaggcgtggtggcacgtgcctgtagtcccagacactcgggaggctgaggcaggagaatcgcttgaaccctggaggtggaggttgcagtgagccgagatcgcgccactgtactccagcctggcaacagagtgagactccatctcaaaaaaaagtcctgacacattcagtaataaaacagaaagatattcaaacacgtcaatgtgtttttgacgtgtggctacagagcatcctagtagccacaagtttttagttagggtctctttatcagatttcacaggatggaaggtgctgttggatagtacactatttctataatggttgacttaaaaacattattacttcaattcagtcatgaagactggcttgccaaatttataccttcttcaaatctcccagggataactcatttatccttgggtgatagaattagagtgtttacaaggggacttcaagcagttaaaatgatggaatgagaaaaaggagataaaagtttaaaaaaaggagtataaattcctgcacttgacttaaaaaataacctttagtagtgcacagttggggacatctgacccagaagagcttcagatgaatcagatttaagaaatccaacacaaagacttgtcctgtttaacattcttatccctttcaacttctgtgtgtctcagagtctatgaatcattttgtcattaaatgccatgtctagagagaagcagtggagagcaacagcccatgtgaaacggcccacatgaaactgcacatatttagaaaattctacttcggacagaatcacattggaattgcttgttcatgagtttacactaacagtggattaagttcatcccaattcccaacatagtattttcatgatcagaaatttgaagtatattttcttctaaatatttttgttcagatctctgatttcaaaattttgatatctgcacaatatattggaaaattttgatattggcacaatatattggaagatgtcacatactgatatagaatgtaggccattaaagatatcttcaacctacagcttcagacagacctactgtttaaatatttatctctctaaatgtgcacagatgactctaaaagggtgagaagatatttagagacaacagaggatgctgtaaggaaatatctttgttttgtacacaagaatatagttttagagttgtgctaaataatgcaatcaacacaggctgagtaccattctaaatttaaatgtttgaaactttttaattttgacattttgagtttttatagaatactttgtaatatgcttcaagtggcagaaatattactcattaccatgttattaatactaaaacctaagtccccagagaaaccctcagattggtgtggtgggatgaggggaaggctctgctcaacatgatattatattatgtattataaattatatatttacatacataatttatgaattaaaatttatgtgttaaagtgatgtatttttacgtattttctcaacatgtatttttatgtattttctcaatatggcatttatgtgttattaggatcctgagcttggaccacggatccatcttggatgtcagcttctatgtttctctgaggctagcaattgtgtcaccttattctagagctctttggagcctctatcagggaactgtacatcattagcactatgtgaacatttgtaaattggtcagtgtcaaaatatgaacagttacagtttttccatatgaacagcttataaacacaacacacacacattattaatttgtaaaacgttaaatgtgtaaaaccagcaagagcacaccatgtgccacagttaaatattaatgcaagttacataagatgtaggtttggattgatggttaagggtatttggggaaaaataaggaacattaaaaaaataagtcttaccaaacaggtattttccttcattaaaagcaaataaaaatgagaaattttttttaatgtaataacatctggtgagaacagacagtaaaagttagatagcattagacttgaaaaattcatacctgttattgtgaagccacctaaaaaagaaaaaaacaacaacaaatgttataatttgacactctacataacaaataccagtgacatcagactgcctgacaacccacccaaggtacttgccaaattatatttacaattaagaagactaggaaaatgttcatgactgaatcactaatcgttcttttaagattatgagatttaatgcacaaatttaattcttgtgcatacctaagaaatcaccgatttttcaaaaggttgtactaaattaaaaatgcaatataaactatttgaccttgacaaaatgaggtcaatggccctaaacaacaatcttgctagcaagtcaagagaaataaaagtcacagagctactgtatcacctgacggaaatggaaaataatctagaaaaatggaaaggaaatgcaagaaatgaaatgcttaccaagctcattcaataacagggctgtgaaggaaacagacaaagacaaacacagaataagagaccagatgaataatgaaagtaagaggaatatcagcagaaagaaatccaggcagatctgattacagtggtagggagccactgctaaaaatgggtataccccaaagaaatatagtgatgggaatatttctgaataaacaatcccaactgaaatttctgaaaatgtgtgtgattgaatacatacgtatatgtgtgtgtgtgtgtgtatatgtatttcaccttatatataatttctttacatttaataagacattgctagtatatatgtttatacctagtatgtaaatctagtttaccaaatacagtggaaacattgtatgaaattcattcttaacttgatatgagtgaggcttcctcattaaatattgcctcggatttggtcaatccaacatatggaagtcttaaatcacccaggaactcaggtatcacaccttttattcagtaagtacaggtgaaacatcctgggacattccattttgggttccctgcctggaaagaaagtttagcccaaggtaaagcactatcttgggatgttctatttggatgatattttgtccaccaagaattgcttatgttttaaaatccttaaagcttaatagtcccaggaattaacacctacttgtgtccttatctgtgacttctgtacattattagataaccagaatccttctagtggacatatcatcccaggaaactgacagggcattgggttggggggagggggacgtataatttgtctttcagcttatgtgctttaagcccagaatgtactgtagcactttattttagtaaaagcaaccttgctaaatatatcaaattatttcctgagttgaagacgggaatgttacagttacttttttgggcccagttttctctctaatgatggtggcattagaggatactttctaaaaaaagtcagtaatttattaatagtgacaagaatccacttggcgggtgtgaaactggatagtgctattaaggaattttaatttgctgttacatgagagcatattttactaaaacggcaattgtaagagcagaatccaagatgctcctccttgagataaagttctttggaggaatacattgagaagaaagtgctttctcctgtatgttaatgaggcattttggatcccatcttttaagaaatcagcataattttctggtctctttttcttctgtctaccatctatggagcatattaaataggcttcattaaaataggccttgagtgctccttttcccatcactccaaatactccaaatactccatcttgaacttgattaacacagaaacatacgtgttttttccccaccagcggactgtgaggccacaaacatgggatgaacgtgggataaattttcctatgtgtctacatagcaattagtcctatatattttatttttccctctacttgtaaaagcataaatttcttacaaagtggcccatctcattatatcatactgctctcaccaattgtttgtatgcaactaataagagctattaatatgtggtctgctcattttacacaataagtaaatcaccagaattccttttaaaatggccaccattagaggataattatatgaagccctatgaacaattcagaataaaaaatcctctgtaaagctgatacaagattgctgtctttcctatgaaatatatgccatatattaataatcagcaaaatcggcataatctagttataaaggacactacttttattttttcttttttttatatgtgttaataatttactaattctgtaattatcaagagattttggagcataaagctaggtaggctttggtttcatagatatggtgccttttaaatgttgtatttgatgatataaaaatatgctaaaatgagcactagaatattgaaaatactactctttaaggatctttgttcttattaaatatttttaaactgtgttctccaaagaagcctaattatttgaattctgaagtttcctgttagttgccattagggtcatctactaatactaataggtattaagcagtttcttttttccagctttattgaggtatgattgatgaggtattaagtcgtctttatcactaaaattttagggaagatttaataattggagtgacattttagaataaaccgtgagtagtgaaaaactaaacacattcttttatgtaatcatttctgaattacagaaatccctttcagtgttattaaatctggttgcaatcaaggttagttggcatttcctgaagaaagtgggcgttgcctgttgcacttgtgaattagggaagggaaatgaaattgctaaagcttcaaaggcaatgaagtatagtacttggaagccgaggaagaggagagagttaagtgtgagagtagggagacacggagagagaagagtacaatttctcgctggtatgtctttgtttactctcacacctttcattcctcttcttatccattttggttcctcaagcacaagggagaaactgcactctttctcatattcctcacggtcaaatattctaatggtaatgatcttcctgtgggaacacaagacaaaggcaaaacaaatggttggagtcacacgctcatgctcttggtgtccaccaagctgaatgttactgtgatgttatggagggagaactggcagcacatgggcctcctgaagtatgtaaaagggcatcttgggtactcttggctggcccccattaagttttctttgctaatttatcactttcacgaattattcccgcttcagttagcagtcagtaggtaccccattttggggtattttggcatggcattgcatggcatctgcagcaactttcccagaaatggatgcttgattgactgccctgaaaattaatctctcagacgttaatgtgcagcgcacctaacgctggctgatgtagctacaggcctgcctactgtggctcagcatgagatctgtgccctgttacataggtggagggatgtgtgcattgtaagtcatgttctgaagagtgcaggcatccaggggtggcacaggccagcagaagctgttgggctcagccctggagcagctcccccacctttcttctcactcatctccaccaggcggggctctccaatctcaaggaagaaggtcttgtttttctcatactcctcatcatcaattaccttgactgatattgttttgctgaaacagagaatagaaattgacgaacaaggggaagaggaaagagaagagaaggaacatagagaagaggaaagcaaggttaaccagctgcactttcagacaaacagtaatcgagaaacttctgtactgtgagttttttcttcaagaatgggtatcagataggtatgaaagatcagagatttcacccaatgcatagctcccctgagcagggccacagaattattttaggcaaaatatagcattcagtattaataggtttgtcatcatcataaggaggaaaagcagaaaaacacagatcacaataataagaaaagaaaaacacattaatttagtaaatgccttaaccattggattgtctaagctatgccctggaactcactcctttagaacaagtcaaaaaatcccatcaagatattaatagaagttatctctgagcaattggcttacaggtcattttttttccttcactgtgctttattatagttccaaatatagtatttttatcataaattgttattaaaataataaatgaataaaaatatcacaaagaaaatatagtcaagttatttcaccccacccaatgtcttagaatcaaactcttattcaggttagtcagattctccagctagaccacagcaggaagttgttcacgttttgtttgtctttctaaagatggaagctgtggcctcacaacagctgttgtgaaagtggggtggcagcaggtgcgagtcatgatgttgtagttattttcattcttccaaagttgagttttaactttctatgaaacatgccatttacactactttcaaacatcaccgatacaccaaggtgttttgattagaattcttcctgtaatccaacctttaacagttcttgccttatggcgctatggctatgagtgactgacaggcaggtaggacaaatgcaaatattatgcaaatctcaactttccataagcattcttgatgactctgaaaataaaccaacctaatgttaccttataattaataagggcttaaacaattcatatactacaactaacttattagaagcctcttaaaccctgatttgtcttgaaaaaatgtttccagtaacattggccaagtacaattctgatcaatgtttttgaaacaatgagtgtttgtagacaacggaattttaacagcatggccattctttaattttggtggagttttttaggtcttctggaaggaaattggcttatgatcttgtttttattttatttatctgagccattaagtttcattagatctatgcatactaaagaatatcagtcttctttcctaatatgaaggagtcataggtagaagatgcttttaattctctgaatttcccagcgcctaatgccaaatgcttaagtcttgctttttggcttagcattgtagacctgagaccaaatgattggttctggttccctgaaacccaataacgtactctctgttcctcagctaaagaacattcttgaatgatactcacattccaatttctcactcctaaaaagctgcagctcatgaaactcctttctatctcatttctgtcctcaaatactgaaatatgaacacactagatgaacagctataagtgactaaagccacaatcatcttttaaagagtggttagatatttacaaaactaccaacagtatgataatgtccagttacatgtatactgtaaacagctccttcctgacttttagaattattttttaaatttgcatctttagtataaaaaattattctgctgtgactaaactagaatatttaatttttccctaatatccaaaaattataaaatattagagaaggcacaggaggatggatgtaaggaatgattgattatttgataattagaactgaatttgatgttgtaaaatagatcaaatttgctctacacaaaactgccaaatgtctgtcctctttgtcaacaaaacttacgcattttgggtattaatttccatctcacagtcttgcaatcttaaactttagtggtacatttctacaaaaacaaacagcatggtgagaccaagggtaggaaagtgttgatggacaataatagggccacgctactgttctctgcacttgatggcccaacatccattatcaagatgcttcattgtagggtacatcaaactgaaacccctcattgtgagagtcacgttgcaatattcttgttagcattacttaaaaacatctgacgttatatttctccatcttgtatttgcaacccaccctgcatctcatcacatattttattggattatagaagtaaagcacagtggggatggtagaagtagccttgctaatagggtgaatgtttgtgtagaaaaggtacctgtttcatgttcacaaagcaacttattcacaaataaataaatcaccaaacaacatattgtttctaatccttggtgaatatcataaatatttaaatcttttaatagctttattttctttctttttttttgttgagatggagtctcactcttattgcccaggctggagtgcagtggtgtgatctcggcttactgcaacctccgcctcccaggttcaagcgattcccctgcctcagcctcctgagtagctgggattacagatgcccatcaccatgcccagctaatttttgcatttttagtagagacagggtttcaccatgttggccaggctggtctggaactcctgacctcaggcgatccacccgccttggcctcccaaagtgctgggattacaggggtgagccaccacacctggcctattttctatactctaagtagctgatgggtgtgggaaacacagttatatagctccacacaatttgtttgcatataaaataagcatttatgatttatcactagcatatccctagtcataggatcacaattcttagaaaattttgaagtacttgataactatgatactggaaaaatcaaagatgaagaaaaagaaaaaagtacttttgtaggtgcctggcaaagacatctaaaacagatggaatttgcataatggcatatcatttcaaaatcattagtaatggaatcaataatgctcctgacaggaagagccactaaattatatattgatttcactcctcttgcacagtaaagctattaataggaaacttgattattaaaggacatttcagtggatctaaagtggcaggatgaagtcagtccttatgaattagccctttaaatcaacagaggcaaaaatcagaaggcactggtaatgttcaccttttgcttcagaacagaacaatttctccccttagcaaaggtagctgaggtgaaataaaccaatgtaatttttaaaggaacacatccttaggatgtctccttttcaccttccagagcctaatgcatgaaagatactgctaccacttcttccttcacaggggatagtatggggttggtttggtgaagatgtcgttattttggcttgataatcagcagaagcatgttcctcacagttctgcagtagaaagaatctcaaggactgacggaaccttgaatgtcctccagttggccccattgccacaccaatcccatgtccacaggacttttgcactgtcacaaggactccagctccctgagaacctacatccattttggctgttctgttctgtttaccaacgggaaacatagctgttgctacttcttttctttaaatagacaggttaacaaaatcaagactggaactgttgggtagacacagtccttcatccaaatataattcttgcatttttactgcactgataaagaacaaatagaaaaactggtatcatgcaactttcaactattataattattataaagacaggaaaactcacttcttttttacagcttttcaaatttgagcagtatactataaaaactgtggtttctggaaactagcaaagcagttacaaatcttacgatagcattgaaatatttcttaatatggccaaaatttttatggaagtacattttggttctatttctaaaaaaaagaaaaagaaaaaaacattcggttaagaaagatcaatttattcagtggaaaaatacagatcattccttttgaagttggcagtgccttttatttgatgataccaaaccaacatctatactttacttcccagtctctctcttatcttaggtgtctcaaaggacctgaacatcttcaaacagactaccaaggagttcttatatctggttttgactcaggcagacagtcagaaaagaaagaaagatgtggctttattaatgagggttgaaaaagaaagtctcttcaaaatatattttagtttctcattgttaagccaaagtggtaccacagtctctttttcaacttaagcctcaatttgtccttctatggtttcttttctttaagtctgcccttgatgttgggagaagatcaggaaaggatgaaatggaggattaaagagaagagactcctccattttagatccttacacaaaagattttagtgaggatttcacatatttagatgcttacagttgctttttgtcttttaaggtttaccctctccttagatattctcagaggccagtggaatgataggctctttgcatttcttaattcacagatcttcataacagccctagaagtaattcctactacctgcgattgacagggaaaacaatgactctcagagaagttggtaacttccaaggtcacaaagtgagtctcctgtgactggcttcaggaaccaaaacctttcaatcatatgactcaaaattagccactaggtcccttattcattcaactgtgcagtatttttatggccactttaaaggatctggatcattaataacgagttttattgtttcgtatttacattaacaaagaatgactgtatgaacaatgatagaatttcaattctgtttttaaaaggactgcagcacacgttatattccatgatggctgctttaaaaagttaaatcattgaggagataaaggtttaattaaaaagagcgatgagcatgcaatggctcaccaactctgaggactctgaatagttttaaccagctgtctcagcatcagcctcacctaaagtgggggacttgttagaattgcagaatcataggctccatccaggcccacagaatctgcattttaacaagatccccagatgactcttatgtatgctgaagtctgagaggcaccaatctagagtggacaatgggttcttgttattaagttggatgataaaccaataggctggtagtagttgggcttgtgttttggacccagctgcatattagaatcacctgtgggattttgcaaactagaaatacctaaacccactccagatcagttaaatcaaattctgcttgtgggagcccagcatgaatatatttaaaaagtttctggataagtgcagtggctcatgcctgtaatcctagcactttgagagatcgaggtgggaggatagcttgagtccaggagttttagagcagcctgggcaacaaagtgagaccctgtttctacgaaaaatcaaaaaaacaacacacatgcaaaaaaaaccagatgggtgtggtagtgcttgcctgcaccccagctacatgcgaggctgaggtgggaggatggcttgagcccaggaagttgaggctgcagtgagatgtgatcatgccactgcactccagaactgcgagacagagtgagacactgtctcaatcaatcaatcaaccaataaaaatgtttaaacattaaaagttttttaggtgcttctaatatgcagccagggcttgctttaaaaggatacattaaataataatatacataaaataaagaatatatagaattgtgagacagtaatagtccaaactaaattttagatctaattagcaaggtaggtggaaacatgggaagatcattttgttttgtcttttactcctgctcttttctggattataaaatgtacttaaagttgttttcccctctcaagaaatgacggtctctgcaggcaaccttaatagtataggtgagaaaacacctttagtattcaggcatcagcgtttacactcatgcacagtgatttccttctcaagaaagtgatgggagctctggcgatacgtttttacacaacagtgattatatctggaaagtagacaaactaagcatttcagttgccgcagaagacagtaatgcctcatgtccctgccacagagcctctgagccatgtcaatgaagggccatgtcgggaactggaactttcccacatgtaagccatcacaatcccagactccagaaagacctgacccaggactgaccacgcatgaacctggcaagttctctgaccacaaggagtttgaaatttaatccacagtacacttgatgttaaaagcttcaggataaactcctcttacagcttacaaagacaaactaaccaaaaacaaaaaaaaaaaaaaaaaaaaaggaaaagaaagaaaaaaagatgggcaaaggatctgaatggcatttctccacagaagataaacaaatggccaataagtacataaaaacatggtccacataattagctatcagggaaatggaaatcaaagcatctgggagataccatgtcacacccactaggaagactacgataaaaaagacagacaataacaagtcttggtgacaatgtagagaaattggaaccctcatatgctgctaataggaatgtaaaataatgcagccactttggagaagccctcaaaagtttaaaagtagaattaccatgtgaaccagcaattccactatatgccaaagagaattaaaaacatgtattcacacaaaaacttgtgcatgaattttcatcgcagcattattcataatagccaagaagtggaaacaacttaggttcatcggctgataaatggataaataatatgtggtgtatccacacaggggaatattattttgcaataaaaaggaatgatgtagtgatacatgctacaacatggatgaaccctgagaacatcattctaagtgaaagaacccagacacaaatggctacatgttgtgtgattacatgttataggaaaagtccagaataggcaaatccagagacagaaagcagattagtgattgcctcaagctggggacttagagataaaaggccgggtggggtggagggagttggtgactgctgatgggtatttggaataatgaaaatgttctaaaattgattgtagtgatggttgcacaattctgaggacatataaaaacccaactaattgtatattttaaatggttgaatcctatgttatgtaaattatgtcttaataaagctagcatttaaaaaaataagctttaggctaaattctagtctttagaaaaggctgtttccttgggtgagaaaaggttgtcagaatgtttggagttttcagtaaggagtttcaaattttgctagtacagccaaatagaaaactgtgatttccacagttttcatttacatgaaagctaagcgccactgctgtgtctgtctgtaccctactcctttcctcaggattttgcatagaatgctggttgccccctccaggatcaaggactaagttgtactttgacacactaagcagttctggtggctgttacctcaggctggcttccttgactcctttcttttccccaaaatataaggtattatgaaaatgtcagaagcagcttttcttgcattgtgtttactataaaagcaaaggaaatgattataatcataaggaggcctgctgcctttgcaaagtcagtagctctgttcatatcaccttgggcattctctagttcttttgttggcatttatttcttactacctacaggagatgatgagcttgccatgggttgcctttgtatcacttggtttaaattcctggtgcatttttaagcctttttttcctttcaaaagttgattggtgagttgcttactgatttggggttagggaaagggaggagcagtcagagaagatccatgcatatattatcattttctgtaagtgacccaaaccaactcctccatctagtaaacatttcaagtggaataaggacaggttgctattcatattatttctactaatatttttacatcatttttagattactggtgagatattttgggcatggattcatttggggggatagtcataaaaacaggactgaatcatgacttaaatctattgtttcctttctcgaaatcttgagagaattaatccagaagtcaacattacccaggtttgtaacttggctctgctactttctagccaaggtatttgggtcacttctggcatccttctaaacatcaatgttgtaaatctatcaaatgaagataatagaacttacttcacagtgattatgatgttcacagtgttgtgatgatcaaataatggttatcatcatttatcaaatatggataatgaaattcgcaggttattgcaaagattaaataatatattgcatgcaaaaattattttgtaaagagctaatgaaatgttaggtactattattcttattagttgaaaaggagtggtttgttttgcagttcttgcctgcctgtttacccagttactaaaaggagcaaattggcagatggtagagttgtgggtcaggaaatattcaatggagtaataagcaataccctcaaatccactctcatatataactttggatcaaatcccatataatggggcatccaagtccagaatccgaaactcaagaacgcagggagcacagctctgccaggttctcattcaccactagcaggatacgcacagggatctgaagtcatgcttttcctggagctcctgctatgaagcctagcctgacaaacggtggtggtgctattctgtaatttaaatagactccaaggacaagagttgctaaagtagctaaaccaaagtaattctccaggaggccttgttgtccgtgccctgatcttttggtattgtcaaatggttattgaaatcattgcttcaagcagagcaagagacagcgacagctaaaatcctgctgttcccagggagaccaagggagctttagagagttctggagttggggttttctaacataaccttgccctattttactttcctctgccaactatggaaacttaatggcaaccagttcattttgtcaaatgcaaaataagaataaatttagttctttagtctatgattttagcaatcaattgtcagtgtcagtgtccaaaaaacaaatatatgagctacttttctgtccctagaagacattctggttgactactcgaaagagatactacagggatccatagttattgtttttaataaataataggctagtctgtctagtatccccacaatgttctatgctattatggtaggtttcagagaagatcaggtgagtaagtttgctaagacaaaattacatgggtgtattaaaaattgaccataattttgtgatatataaaatgtataccttaccattgcctcactcttctgcagttgataaacttcagccttaaggagggtaaagcaataaggacctggggtctgttacctacacatgcctgctgagaccatttctctgctcagtgaaaattaaagtggatcaagcatagggtaccatgttgaaatatggcaaaatagatgcaaattgattttttattgcttaaaaatactggcattttgcaaattctatgagagggtcacatttaacaaaacgatggcagattcttggcatcgtcaaacttattagttaacattcttataagactacctatttttctataatctgagatcttaactgtactccttaaatgcagattctctagaaaataatattttaacaaaatgttcaaagtttaaggtaacgtttaaaatgatttgtggcaaagagcatcttttctagaaatgaaacacatcaacatctttgtctggttcagttttagaaagatcagttctccatttgccactgcctattacgagaatttagaatgacaatgaaattgatgctgctggatttcagactgctggttgcccaaccttttcaaaagctctcttcgtcctgaacattttaaacattcctggaaggtcatcagactcgttccagagattatttctacctttggtctttcttcctatgttacgtttcttttttcaaagtaaaaagtgtcaaggaaaactctggaaggacttcactcctggcatgttataggacagcagctagaatatgctgaaagcatctctgtcagaaagaggtcagctttaaaataagaacaccaggaaatgagctgggctttcttaagtcttaaaattcatattctctttctctgttttccctccttccctctctgtgtccctggccacaaaatgcacagtggcaaatcaatctctgtctgcatgtactcttgtaaaacattcttaaagatggatgccagatattttcttgaacatggctaaaagaaaccaataattagtgaattggtgctgatttttaaatttcacattttaattttatgtctaatattttattggtatttcacattagattaggagacaagagaataggaccttaggtattagtaaagctaatttactaatatcaaggggtagactagtagaaatcaataccagatttctttttttaaataaaatttttgatgtatccctttggctgttgcttttcctgataacctggataaaactaaacttgattctaaacagagttctgtccttgtctatatgaaacatcataaattgccagaaggaataatagtccgtattagccagtttatattccatgggttctttctcactaaatacaatgtggattgctttaggataatgtatattcttttaaagcatcttcctgcatattattatgtttattatcgagacggagtctcgctctgtcgcccagtctgtagtgcagtggtgcaatctcggctcactgtaacctctgcctctcaggttcaagtgattctcctgcctcaacctcctgagtagctgggactacagaagcatgccaccgcgcccgaataatttttgtatttttagtagagacagggtttcaccgtgttggccaggctggtctcgaactcaggtaataccacccaccccagcctcccaaagtgctgggattacaggcatgagcccctgtgcctggcccattttcctgcatattaaagtaatacttgctaattattgcaaatttgagaaatgcagaaatgaagaaaaagtcacccataatcctatcactagaaattaacattttaaaatgttttgttttagcttttaatgaagttgccaagaatattatgaatttttgatgttcttctatggatgagctacttgggcttagctcttttagaggccaaagtttattttcccgacaatcctcctcacatgcttgggccccactctggactcttaatgtagaaggtaacgttccccatcttctctttctattggcttgtatggaagttcttgtctgaattctgccatatggaaaatgttcacatacatttttaaaaggagaaattctctcctcggtcattactaaccttttggctggttttgctggaaaagttttcaggattcatctgccaatgttgtttccctagaaggccatcctggctacctcgctaagcatcttatttgttctgtaacaaaaaattcttcatgctaaatcactcgcaaatgccatgctgcttagcgcccttctgctaatcacccattcccaagtttgtcatcaaaatagcattagttattttccactcaacttcagccctcatcttcccaagccctccacttttcattctagaagcacaatctctcaatccttaatcacagaaatctccctgttcacttctcattatacacatacgcaaactgagactcagtgaaattaaccaatgcctcaaagctagtggatgccagaattaggattaaaactcatcttcagactccgaatccacatctgttatttgtttattctgccattatcctagtgtttttcttctcgatgctgctaaaatctaattcaccactcttcatagaaaacttttctttttctcctctctttttaattaagtaaaaaccgatgctgataacagaaagaaatgcatgattttctttggtaactcagtaccatttcatcattgtccatcacgctgagggatgccttataaattcaatggctcatgcaatgcaaacaaatacttcctttagtaaggatggctgtgttgaatcttggcctgaaagatctttgacctgaaacaaaactacaacatccacagaaacgctacataaagtgtacaggtaaaataatagtcaataaaaatcaacccctagtcttattattattctcaagtcttctgggcatcccacttagcagttgcctgtctctccactttttcttccttcttcaaacatagtcatggtatgcagcccctctctaccactagacgtggtcaataactgtgtgtgtgggtgtgtgtgtgtgttttccccttagaaaatctatttgcacttttaaaggaatattcattttctaattcaaaagggggtaattgtgaaaagaactggctttacaacaatgtggtaagcttgtaggcatagttgagtagtgtgcctctatatggtgaaatactccttgaatgtctaatcccaaacaagtaattaaatatagtataaactacaaagtaaaagtcactaccgacaaaatatcaagggcatcaatatgcctcctgttttctgctttctgctgctactttctactccttgcaaggtccagtgatgtacccactaactgtggactctcaccgaacttttcactatagcacttacttgaatgtttaaatcttttctgggtattccatttagcttaaaaaaacatcagttatcattttggagttcatattcttgatagaagggatccaaacactttataggtaagcatcacaagataaaatcagcaagacaatttagctatttactggtacttgcaatttaaagcttaaaatcaaaattaaccaaaaccagaacagactttattgggtttaaactaaaaatgtgttttgctttctttcccttttttgtttcttgtttatgatggaagtttccccagctagactttatagaaccagagcaggtttgcaaaatgcaaataatgacactgtttaacaaaattgaaccactggaccaaacagtgagaaagtacttgctgagcaattcctgggttaattacaggattctgatgagctacatttaatgtgcccattgattgtagacgaaaatctgtaagtaagctttgaaaatttttttaaattttattatggatcatgtgtagttcagttagggctcaaaaaagcgaatcttcacccctatttcagcttttgacccagacataatcttatagggaaacgttgttttgaggatttttattagtttgtaaattttgtaggaagtctgtgcttttgttcagagaatcatgtaggtagagaggacctacgggatctagatttgcatttgcaatagagttacagcttttagcagcattatttagtcacttaacatttcaatttaaatatacaataagacaaattatatgtaacccacaaggttaatatggaaaacaaataaaataatttatataagagatttttttcacactttaagcattttcacatgtgctttcattattattatctaacttaatcgcattcttgcaactgagcaaacttagatttcttgattccaacaatctttctagtaagctaaagcttcctcagctgtaattcaaaaatatatatggggcattaatatgaatattataatattcattttggaaaataagagttttctgtgtgaatgaaaaagcaatgatttctgacacctatccatggatctccttttagagttttttttacatttatataactaaagcctttcaaaattgtagcagcagatacaattgactgctagaacatgagcaaatactttattaaatatttatgacaatttcttattgaattttaacatttatattaactttaatcatggtacaattaagtttaacttacatagaatactaacgcaaatggagaaatacgggaaagctttgcagggcatctcaagggtgggtctatgtataatgaataaatcctattcaataaaatatacagttttactttttgtattatttaggccaggaaactcttagaagattattatggattttcccctacatattaacttgctgtcttggtgtaatatttgttggtcctgaatacttttttttattgagttatctttgagtttgtagaatcatcaaaatcctcttaatagatttaattaaattgctttcacaaagttagacttcctgagatagagattcaaagtttggtgagactggtaatggaacagaagagaatccatggaaatacaatcctgggtcttcagaccccctaagaatgtcagctcttcaggcagtactgtctgtattcaacagtaaccatccgccacgggataggacagcattaagtatgtgtgcattccccgtgacagtgagcacagtgctggcacatagtgtttgcgtaataaatggttttggttgactcactgtctgtacttgagtttgtgccaatcaatcaaggtatcttacatttcttagtaaaaggcagcttacatatgttttagataaaaagatagggttcttaatgttgatctcaccatgacagtaagcaaaatgaatggtgtgtaggtgattcaagctcatgacctggacatcatgaggaagggcaagatgaatttatcagccacgttttagattcctgcaatatgttattccattcagccattccacaaacctttactgagtatccaatttttgtgactggcccacattaggcattggggataaaaagaggagtacgaattcacagcttagagaagggataggcatgtaaaccaaagattatgcacctctatgtgtgttaattgtaaatatgggctctgtgctgtgtgagcacagtgggtggggaaataaacagagacttggaaaggcatggcatgtttaagaagcatcaggttctatctgacttatgtttatggtgtgcacatgtaagtggtagagggttgatgggaggtgagtcaagaaagagagcttggagacaggagaaatgctaaatcatgtgggcataattttgcaagaaggagccaatgggcctttttgattatggactgctattatccaatttaacttttagtacaatcactaactctagaataaagcttgtattgtagtgaaggagagggggcagggaagcagatgtggagaagatattatctcctggactggcagagcctaaagtccctgcctgaataattagccaggtacccctccagcagcatactttaaagaagtgtctggccccctatctccagtctagatctgtcaaagctgaataaataaagaaaagttgctttaattacttttctgaaatttctccttcctgaaaacttgtctgtgggttagagaaaacaagttgaaattgcatgaaatgctttctctgagttcctctgccaagatcaatttcttgtagcacgatggaggtagtaaaatacgaattctgctagagaaaacatcatgagattgtaaaactgacctgattttcatgaaaagaaaatctatctaccataaattcagatctgagcacatatttcattttatttttatcaaccgtgagtaggtttggcaagccttatgacaaaatgatatctgggcatatatgttaagtttttaaaggaaattatcaaaaactaaggtctcaggttaatgatttacatggaaaattgctatcacattacattatcttctacagtatttgcaggagaactggtgagagaattacaaccaagatgatataatgaaatgaaaatttacaagttgaggtgtgggaaagggtaaaaggataacactgagcgatcactaagaaaaatgactcaggttactcagtaagcaatgtgtgtgtgtgtgtgtgtgtgtgtgtgtgtgtgtgtgcgcgcgcaaagaaaacgagagggagaaggaaagagaaatttaaagacagagatagaataaaatgtcttgagttttatgataagaaatagccacttaatattggaggcaaatgaggtctaaaaagattggaggcattaataaaattaataacaccagttcctcgcccttctttgtgttaagcagataggagcagtgagaggttgaaggccaaggtgatagcaagggtttggtagcagcaattatgtcatatcctagggccagggcctaggaccacacaatgggatgagacagactggaagaggccaagactggaactcaacccgcccactggagtagtgcaggtagtaggatatcagggagtctgtacaaagccaccaaagatggaaggtccattccgaagaaacaaaacacagaacccagaaaatatggaaatctagattatacagaagccaggtaaaccactgggtgagatgggcaagaaagcatggagctgagtgatgtagaatggaggataaaacaggacagatggctgctcatagcatcatgtagcagagttctgtcattatctgttctccaaagggactgatcacaagaagaatgtgccttcatttaggatgaactgaagtcttgaaatcaacacagggaagcaaaaaccagttagaaagtcaaatatgactttcaggcagatttcaggaatctagtagtttactgcttttgtttctgagtatctggaagaacacatgtgatatgcagaaatttgatagtaaagtatctggtaaatgaaagactggacttttggaactggagaatagttcagagaccgatgatcaacaagcttattgggatgctgaggctcagaggagagctaggctcaggcttgtgaagttcctcctgcttaaggtcacggtggagtggggctgagaaaattggttgggatcagtccagacttgtggagaactggaggaaaggaatgaagctgagaaagaatttggagaaaaattgaaactttctacctgcttcctctcaaatctcttctgtatgactatatctttatgattatctataacttctattaattatttaagtaaatagtgtttgcaagggtccgaacatgggagaaagataataatatgggaggttaaggaatcttgtggggagaagataataaattcttatcttgatatatttaatccaagtcatgatgggaaatgtcttatagaatgtatattaacagcgtatttgtacataacagatctggagtgaagacgaagtatctggatggcaagactctctgtatatttgtcatgcattctgaagtggtaattgaaggcactgatgtgagctaatagacttttttccaaaggagtgaccttaaaagaaaaatcaaagaaatgtgaaatccaatattgtaataatatcactggtaagagtgtaaaagagtaaagggaggcggggagaaagggagaccgagaggggtgagttacaggaaggctgagaaatgctagggtccttgaagcttagggtaggatgtctttcaacttgaaggaggaagtgctaatatttaaaaatcaggagactaacaactttatgggggtggggggaagggtcacagtttgggctgagaggaggctattaaaaataaaaccaaatagctgacttgtgttgtgatttgaggaaggacaaggaaaaattttcaagttgtaatgttggtggtggtacgctcaaagagttttaatacaaaagaggagttgaatgaaatgacacatggtaggggcagttgtagtgagtggtgactttccagagaagttgtcctgagaaaactcaagcatgcattaaaacttaagaagtgaattctcagtaaatacaaggctcatttcaccttgagaaatgagcctctgaccttgtgaggtcctcagttttatggaaggaacataatattagaccagtgggtcctgagatccagctggctacttgcatttcctgtgaagctttagaaacgaagattccttgtcgttatcatcaaatcagagcctctgcatgcgtagatgaaaggtgagcatggggaatctatagtgctgaaaagctcccctaatatatctaatgcaatgatccatcaattggtgttagggaaatattctactagacctgcacctactcccaggttaagaggcttaacagcaaatatcattaagggccttaaaaaataacccttttctttcattatctgtctcactccccacatttaaaccgctcatgaaatttacacttttccatgacgctttcttagattgatcaggtgtcatattcaggggatgaaagcaaaaggtagttctttgtggctcttgtggattcttcacactgtattttaagagagaaattttctatcaagtctactctcagtgcattgattagtggtaaaagtccatttattatctcacagaattactaagtctgtagcatattctgcagagggggtgttctttatggtagatcgatttgttctgtaacttgtataattttccattagaagatgtcatggaagtgctcctgttcatatcccacacatcagtggctgcaaatcaaatgaagcctgttacttgttactgtagaattggaccaggtttgtctgatactattccatgccaagccatttgccccagttcccatttgggggccagatgaaattattttgagtgcatttcgatagtgatatccctcctgataaatttagcatttactgagggatccactttctacgcatgcatgtaactgctattttccctgagctcagagatcgttggcagaagtgacagctggtgcctcgggatggagctataattttatggtgcagtgtctacggctggaaatgcaactagcaaaccacaaatgccaaacacatcataaaggaaaatgttccttaggaagtacttgccaatttctgagcaattaattagtccctaacatacacactgacttgtatgaataaaacagcctaggaaattaatttaattaagcagacagttacgataaaattaggtgctttccccctttagcaaaagatctctctttcatacccacttctggcttgcatcctcactctctggtaggtctgcttccattttccaaactcttataaggactctaaaggaaattcagtattcttagaatgagaggaaactgactggttattccaagtgaaactgcttgtctcccagacattttcctgttgaaattttccccagcttgctacaccttttctccactttctatggaaccaagagagtggtagtatctgtgaggttcaagataggatctattgacaaagctccagagtggtagtatctgtgaggttcaagacaggatctattgacaaagctccagggaagaatgactgtccagaaatgctccttgggaatagcttttgtggaaagaaagcagtgcctccaccccacatctttagttctggcagctccctatagcgacaaagtgaatatagatcagaaggacaggagtgcatatcagaatggaccagatgaggaacagcagaggaacataagattcagggcagctccaaacttctagaaggacttgccaactctggtcagttgaaaaagtcattatatgaatatcttatttttctaaaatgaatgtgtgttagattaaatgaaagatataggaagggaacatgtgaacattggtaaaatatagggattagaagtaaaggagggattagtgttttggaagataacggtagcaaaaaacctcaaaacaattgtgtttgaaatcacatacacactggcctaattgactggacattcttacatggaatgctactaaccagagttcttgtttgcatttcccaagcctagaaagatgatatataattatcaccattatatatttatttagtgtgctctctgagatgcccaaaacacttggtgacatatttaattaattcatatcacttctataaaatatttcaggtatttaatttcagttgctataagaaaaatatttattgatttcttttttaaaaaagactgcagttggtaaaactgacccagagtataaatacagaatgaaacctgcagtgagaaatgaattccacagtaatacagataacaaggagaataaaacccaaagtcagagaccttgatatttgattatcttcagttgtttggaatgcatggtttgagcatgctcatgagaacactggcatgatactgggtaggttccctctttaaggcactaactactctggagagtgactccaaaatgtggtttcccactcctcattactatgacaaatttcacattaactcaattgtcagaccctttccctgctgatacagggttgaagggttggcttggtgatcaattctttgagctttcagagagattttgcagcttaatggaaagctaatttaaggaaaaaaaaaaaaagaagttgaactaggatttgctctagggaccataacatgaatgttctattgtaagcttcttgatggaaggcattatattttaaaatcctatagtaatacaattaataaatacagaaaatgccagctgatataatagaaaattgttcaagactccaaaaattaatctgatcccatttcaaagtgaagctaaaaagatgtccatgtttttagttgtggaatttagagtatgtgatggggcctacttggaatcctagtagacagaggaattaaataataaaatttgcattactcagatctatcatagtggtggaaatggacactgctcaccttgtgagccttgaatgaatcaatgttggatcactggcttgcaatggatgaagcttggcaggcgtggtcttcctgaagtggcactcctctagaccaacacatgatactcttattccatcataatcatactacagagaatagacccccataaggaccataaatattgtttgtctgtactgtactgcaggtgatcaaaactctggcaaccaataggatttattttctagaggacagatactactccaaaacaatactagatcaaaaaggaaggctttaaaaattacacagaagtgtttgtggcaaagatccctctttgtatgtgtaggactataggtattaagattcggaagcaagcagaacaagttctgctatactatttgccaggaatctatgtcctcaaaattcctctcctcatttagaaaaacacaattacaaaaactcagccatagagtttgcagtttgacatgttgctgattctacatgataattgatcacttcaaaactgacaggacttacattaggctcttgttcttagttttagttttaacaggggaaccaggaaagaaagaaagattgctcatcagtggccatatttggcaaaggcaagactctcttcccccaattcattcatcctgatagagattgacacagaccagatgttattccaatgttaaaattacattgttttcataacaaagtcagcttatattactcttcaagagatcacactaatgctcctttgtatactgttatgaggagggtgagttagatctttccagaggacttgccaagcacaaactataagaagagttaagattttctcaaggcattcactagctggcttacaatctacatatctatgtgtctctgcagcacatagaggatttcaagtcattgatatatatatatatatatttatatatatatataaatatatatatatttttttatatatatatataaatatatatatatatatatatatatatataacctcttttagtaatttctgatacttagaagaaattacaggtacttgttcttcaggtaggttgagagctagcgatttcattggctagagcttttttgttgcttattttctttgtcctttcctctcaggtcatggtgaccttaaattatgattccaatgcttaagagttttatgtgtgctatttttcccatgtaacatctggaacttggaaggtaaaaattccaaatcaagggccagaatccatatgggctcagcacatgtaaaccataattttggaagcttagtccctcttagcccccttatcattgctgcattcccacttactatatcacctctgtggccttgatggcaagtttgggaactgagaactcctgaaaatgccaacaagcagtcatcttcaggggattctaatagtaaaaggccaaatgaagacattccttgctgaccaagtcaccataactcttaaactattgccgtgagccagaagaaggaatttttttcttttagctttagagactttgtccttaattgacttcatgcttcttattactcacaatattcatttttatatagtcggtttatattgtagaaaacaacccacttaaatatttatatatgataaaactggtgagtatgagtgagattataaaacaagttaatatatttaatattacaaagaatgctaacatttctttatttccacacaacactctcttctcttcttttattctcttctctttttgcctttaagcaaaataaaaaagactcaaagtaagggcgagaattataatgccaaaatactcaggaatatcattcaaatcttgaacggagacccccactccctcaaaaaaaaaagaaaagaaaaaagttatccataaataatgtacttctccttcaagattactaggttatgtaagataaatgccaccattttctcctcatgctacttaatctaagaagtcttatgattttctgtttttcaatttcttatgttttcaatttcttgtgacttgtcaaaggtatgactggttgggttctaatcaatatttttctactcattcaacactatttggctctaaaaccaaaacaaaattcaatttacaaatatattatttttgtggtaaattttagattgtctattactccaaaccagagattttaatgctaatgtttgttttgaggagaaatgagaattaagcttgatcttgatgatcaaccacagcaaaattatctccagttaggaaacaccagtctaaattgaaggtatagtatgtctccactttccctgaatgactacatggtattttactaagctttgcctttgtaagtacacacagaagggttcttgactattctggcttgaagaacttatgctgaaatgagtcatgtaaaccatggcagagagtcacaaaactggaaacatggaaggctgtatggtcatagaaacaccttaccagtagagtaccctgaagaagacttcttgttagcatttgcatgagttcttggtccccaaacttaccatcaaggccacagaggtaataaagtcaatgggaaagcagcaatgataagggggtcaggaggtcataacacaaactattggaggagttaagattttctcagagcattctctagctggcttacaacctacatatctatgtgcctctttgcagcacatggaggatttcaacactgaacatttgaacattagatatataaaagcatgtgtatatgcatgcatgctggtgtgtgtacacatgctggtgtgtgtacacgtggaggtgtgtgcaccctagaccttttttgctatactatccttagaggatgtgtttccaaagattagatcagcaccatggagcaaagtgcaaggaatgaaaattaatccagtgttaacagctttatacagtaagaagagtaggtcaaaatgtttaaaattctcattgggatctatgaacaattttttatgctatcctctccacctcaaatgtcctacttccacatccttgcacgtccaaatcttgctcaatccttttagatatagctgttaggacaccccttcacaaagctatctgtgatttatcactcagaattacctcttttctgaatttaccatcagatttttttctgtaaattcacatggtatagatcacttcctgacttgtatggtgattatgtttctacctgattgttaatagtgaactataaacatcttcagaacaaaatccctgtctgcttcaactttgcatttctgaatagaaggggaaacaatcaagaaatatttactgaatcaaaatatataatggtggccatatattttatcctttttttctaagctaatagcatttctcccactcttaaaaggcatatgcagaaatcaccaagggtgatgtgacagcataacattagcaaagtttaaaagtacacaagagctaaactgtggatacccacacaaacagggagagacctacttcctggtgtcaatgaaattacagctctaaagagccaatatgtcatttaatttaaaagtcactgttcatgaattgcaattaccctctggcctgcaagcatgtgttcatagctaagaaattttctctatgcccaggtagaatatattgctggcttttccaggggaacctaatgccaaatagaatggcacctacataaccaacttgaggcatgctttaaaaagtgtccctgtgataagccacaagaaatgacagactatgttgaggaactcagtgactctacagccatgctaggcttggagcccactcagacaacaacatgggattgttgtttttaagccaattgctcacagtcgataaaacaaaaggattaaacttttgacagactttccctattctcaccaactggctaatgctagtgctgctttgctcaggcctccttaagcatgtttacttgcaattccttccaaatgtcacttactagaaactgcattcctgattctggaggtaataatcctggagacacagctttcatcagctaatgggtagtgactcagagtatatccagagacaaacaaattaaagagcatggaagattggagcaaacagctaaagaactttgttgtgatatatttagaaagcaggcattctgttccccaataacattgtgctaatattggtgctttccatttactggatttgattgccagcaaaacctaaacagaaatgttttacatccataaactactcccaaatcattggtctgaaaaaatgccattctgtaatatgcctactgctaacacttccattagttgctcaagagaaatgcaagaatagcttagaggagtcttagccaaaaatatataattctgacatatggagaaaaccaatgcaataatttacaaaagattaactgttaaagtgctgctaaaggttggggggattactttaatcaaatgcctgcattctaatatggtgagggttattttattttgagacagggtcttgttttgtcacccatgctagagtgcagtgacatgaccatggctcactgcagcctcaaccttctgggctcaaatgatcctctacctcatcctctggagtagctgggactacatgcatgaactaccacacctggctaattttttaattaaaaattttttttttgtagagatgaggtttcactatgttactcaagctggtctcaaactcttgggctcaagtgatcctctagccttggcctcccaaagtgctgggattataggtgtgagccaccgtgcccagctggtgaaggttgaaaacaattttacaaaccacatttaagtgaggaagaaaaacatgtagaaagatccctgtgttctttagatgacatttgaaaaatgcacacatgcttttaaaagccatttgttgcacttactcttcaggaggtatgcttaaatgtctgttcagaaaacatcttaaatttgggatacattgttctgtcttttaagattgctttagactgctacttactttaaaagaattgtgagattactctaggtgtatgtttataaaaaattcaaagttcagaaaattcctgtaagccccttaagagcattttaattgtagcatttttcctatgatcctttaagaaaatccgctacgggttttcagattatgtttccaccccagttgagagtaaccacaatgacaactatgtactgcaatttgcagcagaaatgactacacatttctgcccttagctgaaagaaaaacaaccatatggaccttgttcttagccagcgctccattagctaattaaatttacaaagcccaaccagtaagagaacatggattagccccattctaatgactctatccctttggcggagctaatgttgtcttgtttcagagcagactagagaaacttgacttactttgaataggtcagacaggttagtccaacagaaatacaatgcaagtcacatatatatgcaaaaagataaaggtgaaaatttaataataacttttatttactcaatatatccaacatatcataatcttaacatataattaatataaattttaagatttttatattctttttttcatactaaatctttgaaatctggtatttatggttactgcacttcttaatgtgggttagccacatgtcagtgatttaatagctacgtatgactagtggctaccatattgaatggtacaggattgagtggtgagatgtgccattccatcttctttccattgttcacactcataatctatttcaggagtacagtgcttcacttttcatacgtgcatatcagctgggcatatagtcattttaaattctgaattaacctgaagatgaaagaacagtggccaacttatttccttttaagaaaaactgtctctagttaaaaatacaacatgcataagtatgtgaggtaatgtataattattaatagctcaatttagcctttccataaggtatacctatttgaaaacatgttgtacatcataaatatatagttttcatcaatttaaaaataaataaaaacatcgtttataagtctaaaaagtgctaggggcaaaataaggccctctctctagcctattgacccattttgaagtaaatgattacagctgtggaatgcttcaaggaacttaaggtatgatgtgacagcttgagtttgaaagtcttctctcgttcttttttatgactgcatagtattccatggtgtatatgtaccacattttctttatccagtctatcactgactttgcagggacatggatggagctggaggccattatccatagcggactaacaaaggaacagaaaaccaaacaccgcaggttctcacttacaagagggagctaattgatgagaacacatggacacacagaggggaacaacacacactggggcctttcaaatggtggaaggtgggaggagagagaggatgaggaaaaataactaatgggtactaggcttaataactggatgatgagataatctgtacaataaatctccatgacacaagtttacctatgtagcaaacctgcgcttgtacatctgaacttagaagttgaaaaaatatcttgaaaaaaaaaaaaaaaagaaaaagtcttctcctaaatttaggcaacattctatttcagttgagctgtgtataactggcccatgggtgcagggatcacgttttcctacctagaaagggaaacatgatcttacaaaggaattatttgtccttgtatgatttggtgacacaaaaattctcattggggcatgaaaataaaatatatttaatgaaaagatttgattggaaaaagtaaagttacagaaaactaggttgttttcagagaattcaacaaacttagggtgaataaacactaaagttctacttcacaattataattgaatcaacaaatggatagaagctatgaagaaccaattaggttgtgtccttacctaatttctggaatgctagtgtgaataagcctgtgccatgacaaatatcagaactgtggacaattattgaattttagtcttaaaatcagggtactttcctcaacttctagaatcaaaagatgtcacttcatcatcttggaacatttattttaatctgtcctgaatgtaattatttgatcaagctattgtcacaaaatcctattaactcaaagagtgattgcattattcactccttactcatttcttgatttcagtgcttattaaatgaaagttttcaggcagccaaaatgaaggataaccttaaggattcttccttctttttaattttaggaattgtatactgtagtttatcataacaacatatctaggctgcagaaattcagggaaggcctgaaggttttaataaaaattaaaaacaagacccatcaaatgatccaaacacttcctttgcttatcttaaaacacaagaatcagaaccagcagaatgagctttaggcctgggaacaaaatgtcagagataaaattggtatactattttcacccctacgatctacatggttgagggggtttgaaggaagtgaagaatcagatatgtttctgaaccaggactcaaaaacaagttttataattgcaatatcttcttaagagctcggcgaaaatggttttcattttcttcttagattcttttaagaggtgccacattgtaaatgatcataatggcacaaaatgtgaattcatgtggaaaaaacaggcattaatgattctgaatacagaaaagctggattctgaagggaagaagtcttaactaatttacttcaaagtattttccttatgatgtatgaaaaagaatgataagataaaaatctatttaattaagaccaaaaacatctctgtaggtttaaaataaaatttgtacgtggtaagaaagcattgtgtcatggttacttatgggcattttttcttggttagtgatacataaaataatggtatatacaatcaatgctgtcttaggttcaattaaagatgatgtgactcctacatctactttatttcctagggcctttttttccaagtgatatgttccatccactgggagcaattttcagctggccagacaccttcccattatccccgaagcagtgtgattttatccttttacatgaacaatgcccttagggagaatgacaaagatactggctttctgaatggcaatatattggatggtcttatctataactttctcatttttcctatacaaatgttgggttctatttcttgaataagttctacagaactcatgattacagtttcataaaaaaaaagtgatccaaggtataataaaatatttttttaaccttgggttttcaatataactactcgaaatgactttaaatgctacacaaaatatatttttatattaaacaaatccacattaagaagatgaaaataatataaaatgattgcttaaaaaatatgggcataatgtccccatattacagattctggctccaagtttctaagtcatataatgggaatcatgtcttctggaatatttggtttaacggtgtgtagtgccagggctagaaaatgtgttaagttggtgaaacaactaccctttccctttttttagtatttctagagtgttaccctttggggctcccaccagtttggaacctgttttacttagagtgttttctaaaataaggcaccaaaatatgtgctagggctgcacatattcaaagtatgctgcagctctgggaagttgggcagattgaagtaaccttagggtccgtgaaccagacctccttcacagccacagcactgcaagagcttcctctcttcttgtaaaccaagctatcaaagataactgttacatacatgtatattcacctctgacacctacagccaaggaatgagatgagaacatgaaggaagaagttaggcgcaggaaaaataaagggtgttagtagtgtccagcttgtagaaagaactcaaattatgcctcagtccagtgagcactgaagaaaattcctcaagtttctctctgggcctcttgctttctagttccagctctctttccatagtcaaggttccaaaggcccacctcctctcctcatcaaatgctttttgcaaaaacagatctaaaatctcagatatacacatgacagataactgcttgaatttctcttaggaatcactaggtacttctaaatcactggagagtcaatctgaagtcagatgcatactccctgaatattagtctttcaggtatcactgggcaggaaggggagggaatggagagagattctgggccatgtgtgtaagagggagggcagcttgtctgagaatccaacaggaactcccttttttctaggcatcgtccagagattttggttacaatacttggaggtaaaattatatagagggtaatggttttctctttggcacatcaatcaactctgctctatgatcctataaacaggaaagagttgccaaatttgggcaccagaggaatccttggggctctcagcagtctcctcttcttaccacaatgcaaagcaaacaagagttgaaatgagaaaccagagggcaattagtgtcctttttttccttctcctctcatgtatccatttaggctttaatgcactttaaagaattcagaacactgagcaccaataaatgcttacttttcaagggaaaagaatccaagaatgtcaaatttggaggcctttgagatggtttagtccagatgtcagacatcattcatttagtaattatttacaaattcagtaattatttacaaataccaattatatgccagacactgttctgagaactagctacagatcagtgaaacaaaagaagaaaaaaaaaatccttgtcctgtccttgagatgagacaggtgcatgtaatatataataattaaagtatttagtatgctagatgtgctatggaaagagtacaggaaagctagggagatgaggagtaatgaggtgagagatggcagttgaaatctgaaataggatcatcaaggtaggcctttctgagaatgtgacatttgagaaaagagtgtgaggaaatgagcaagttagccatctggattatttgaaggggaggcaggggcaaagacagtccagacagtacacatatgtgctaagacaggagcgcctcacctgtgtaaggtttaaggacatttctatggctggagaaaaatgatcctggaggaaaggtgagagttaagagtagagtgaggggaagtggttggtggggccagatcacatgggccatgtagactcttgaaaggacttctgagggaaatagggagccactggaggattttgagcagagaagggatataacttgacttatactttacaggatcactctagctactctgtggagaacagattgtagagataagggtgctaccagggaggctactgtggttcccggcaaaggatgatggtgcctcaggacaggatagtaacacttaggaagacagagtatagagtgatagacgctggcccatgggtagatgtggtcatgggagtctgcggagagtctcttctgattgcttctattttctcagggagacaggaagcaaagcaagatcatcagctgacagtaagacacaggaggggaggcactggacatctgaatggggagaagaaggcttgactgaagtagctaagacagtggcagaggaaatggactagggaaatacagattgacttatgacatcatcaagtgcctactacttaatattgcctctgtatccacagctctcaaatctccaggcagcctctattgattgatctgagttggcagatgagttggcaggtgagagaatgtatatttgctagttctaatctaatctaattctgctttagtaaactgaggcctagacagtgccttttaaacatctatctatctttggggagggtttaaattatgaattaccaatcagctatggctccagtaaggaaaacatatacagtacctatttaaatatcatgtagcaagagggcctgacaactaatgctcttgggaattgatgctataagagaagggtatgaagagctgcagatgagtgcctgaaacaagagctttattaacacagcaggaagaagatacctgctggctggattttcactgaactcatagctctttgcatttgggctcaaggtcttaatcttctacaagtagtgacttcagtttctaaaggtttcaaggggatcatccagtgcttgtcttttgaatagactggcatgacttttaaacaggacccaaccaaatcacatttgatttcaagaaattgaagggataattaagaaagtgttagtcactactgaatgtagtgtatatgctttcttcggaattttaaggggggagaaaggcccattaagtcatcttaaaagggctcttgctgtaaaatgaaaggtggagaaggggtaaatctgaaatgcaaatgaatttcctgtttcaccagaaattcagtattatctaatgaatgctgagtaattgaagcacttattgtcatttctgcacccacactgggaaatggtttctgacctttagattccctactcttctgaattgcttctcatcagctctctctttattctcactcccactcagtttacttcttggaaggcctgttgacctttacctttttgtcatgtacagaatacagaatggttatgtatataaggtatcattaacatcataaggctacatgcaattataaaagaagatgagggataacttacacaggacatagtccttgctagattttatcaagaccctcattttctagtggtatatcacctttggaaaagccaggccattctgaagtaggtctttgtctttccagtctagaaataattgttatgtcaagttcagtgataaaatgaatggctgccattggctgaggacccactgtggggcatggagctagtgggcatctctccagtcatctcacaacaaccttgctcatctcttccttttaattattttactgtgcatactcatgagatctgaaactcatgtacgttggcacctttaacataactacactagttcttcctataaagttttctaatgatagtggaacttttaaattcagtttagtttttgacattttatttgtctttttgagaagccagtaggacttcaaaatgttgggcttttccaatagacagctaaaaatgtagacctgaagtttacaaaaatgattagagctaaaggtatagatgggaaagtcatcaatgctgaagtgatagtcattatgtggaaatttagcaaaggaaagatacttggaggcatgctaagtggttgaaaaaggcatcttggaagattttcatgtttaggtggtgggaagagaaacacaagccagaaaagaatccctcagggacaatgagaaaagcagagcagcagaccctgtgaagttatggaagtgaaatgaatggatcctgaaggtatttcaaatggtttggactatcagggccaaaaaagaacttctggaaatctggacttggacaaaatcagtcatccttaaggggctggattcagcaaagaggtagatgaaaaacccaggttctagggtcctcttttatttcatgggagtgatacagaatccggatcactttagaaataaagcaaaataatttttctgaagatgtgaacagtgaagtgatgtgtctgtcacacactaaaaacataaaagatgatgcatgaataaaatagggaacagcatcactagttaatgcccacataatatcataattctatacctaatccaaatttgatgaacaaaatatatttagagcataaataaaacattttcaattgttcataatatattctccaatgcactgtatttgtcttggtttgaaaaatccataaagattttatgtaatttaaataagcaatgaagagaggaagaggaggaaaaggatttcaatatggcccagagagagagacagagaaagagacataaatcccagttaatctaagggaagacttttaagtcatagttcctcattctggcgacttatctgttacttatttccaggtgctaaacagaagagatgcaatatcttttttttttttttttttcctgagacaagtctcgctttgtcgacaggctggaatgcagtggtgcgatcttggctcactgcaacctctgcctcccgggttcaagcgattctcctgcctcagcctcccatgtagctgggactacaggtgtatgccaccatacccagctaatttttgtatttttagtagagacggggcttcgccatgttggccaggatggtctgtatctcctgaccttgcaacgtgtctgtgtggtcctcccaaactcctgggattacagatgtgagccaccatgcctggccgagatgcaatatcttgaaggcatcagggatcctgttgtttctcttcagatctataaatctgctgccttctgaaggcattaggagcacctcaaagaaagcaagatggagcattaacaagtgaagactcttcttcttttcttttctttcttcttgcttgctcttttctctttctgcatcaacaatttcaaattcttgggcagagtattgcttgaactcagagttcctgtttgtgcaacagtgctgccttctgctatcagccacatgtagacttagttgaggagtcctatgtgtagattcataaatttagggcaacaaagcatgtgtgtgtaggggggttgggcaagagagctaaggctaagtcagggccagaagttgcctgtaagtagctctgtaaagcacccatgtctgatttgtggaggtgacatcatcattagctgcagatcaatactgaccagaatttaaggtactatgccatagctttaagtcttcataatttaaagatgactaagttgtctcttctctgtaggtctctactttgagttagatgacttcagaaatgatcacacatttcatgtcaaatttccaggcctcaaattcctgttcccagtgatatgagtacccacagataattcactggtaagatcaccgagtgacccaggaatgaaacctaccattgaagatgtttatttagagctgtatccactgtccacagccaagggaaatagccttttctagactggatatatttgaccagtagatggagtaagtggatcccagaaccaccaactaaccacccagaacctgctgatcaatgctgttgtctttcaatattctatcaaaaagggacaatgccatcaccagcaactaaatcttgagcttaaggtgcatcttcggcaggtgaatgtcatgtgtgacagttgctcatggatgaatgaataaccgaaaggggcaccagcagtagcaaagtactaagatactgaggaaacttggggtacttaaccaaagtcccttcatttcttcacaattatgcttaacaccaaccagcccagcatctgacaaacaatcccaaggacattttttcccccgtcatctcaaatattttttcaaaagtgatcattttactctgtgttttggtagaaggggcgaagtccactttgcagctggtacaacagaaactagagctgcatcaattctctcacactgccaagcctttcttctggcagaagcgctggggatattacactggggataattcatcaagcttgctttgggtgttccaaatttgcaagctgtggctaatttccagagacttcagggcaataatctctgctttcctaaaagaaaaacagtaaccacaccacctttcaattaaatgggtcatggaaaatgaatagccacagatgatcacagatattcagaaatcctcagaaaacctaagtgtgtagccagtggtagaaatgatgactgtgtggctgaagaagtcccatttgatgagggctaggaatctggcatctgcgtctgcctccacatttgtttctccccatacattttccatgtatgaatatgcacacacatgcacatgtgaagcctcacatgttcaagaccaaaacatattgctggatattaacaaaaggaattatagcctcttcagctatgaatcaggtgaagttttcctcacagtctctggagtctgctttgcccacagaaaagcagacttccttcccaggtcagtaagccatgctggagagttgccctcaaccccgcaactctccccaaatatatctgctgtcttttatgctttccaggccccgtgttcagaagttgtttagcagatcatttctttgtacactatctttttttttttttttcctcttttctgagatggagtcttacactgtctcctgggctggagtgcaatggcgcaatcttggctcactgcaacctccgcctcctaggttcaagtattctcctgcctccgcctcccgagtagctgggattacaggtgcccaacaccacacctggctaattttttttttttgtatttttagtagacacggggtttcgccaggctggtctcgaactcctgacttcctgatccgcctgccttggcctcccaaagtgctgggattacaggcgtgagccactgcatccggcctgtttgtttgtatattatcttaactcatataatggatcagtatttttttgagaatttccaggccaacattcagaagaataacatatggtaggcattttaagcaattaatggataaaggaagggatatttgagggctgtctcatcccaaactaccttagttttttactctggattttcctttctatggatatgtcaatgattttaccggatcaattctcatggagcagtggactagtttgggatggtccctactttcaatttcaggaacactgtaaagtcaaacagaaccttatgagttttatatttgctagttctttttgtgctatgtatttattatatgtgtaatttaatagtttcaattcttttctctgctaaagtatttatgagttgtagcacagagaaagagctcaatatatgctaattattattattaatattattatctttagagataggatcttactctgtctcaggctggggtgaagtggtgtgttcatggctcactgcaaccttgaactcctggactcaagctatcttcctgcttcagctttcctagtagccgggtctaaaggtacacactgctatgcccaactaattttttaaaaaatgttatgtagaggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcacggtggcgggcgcctgtagtcccagctactcgggaggctgaggcaggagaatggcgtgaacccgggaagcggagcttgcagtgagccgagattgtgccactgcagtccgcagtccggcctgggcgacaaagcgagactccgtctcaaaaaaaaaaaaaaaaaaaaaaaaaaaagttatgtaaagacaaggtcttgctttgttgcccaggctggtcttgaactcctggcttcaagcaatcctcctgtatcaatgtagtgttggcattacaggtctgagccactgtgcttggcctatgttagctactattattattattaccttataattgctaaagccatctacctgaaaatctattccaatcattccatagttctcagctccaaaaccagtggagatttgttttttcataatcctaccaaactcctctgcactggtgtcatatctgacaaaatacccagaattaattgccaatgggtgatcatgggttgacatataagccttcccagtgtatgcttttttttttttacaattttttaaaaattttactttaaactctgggatacatgtgcagaacgtgcaagtttgttacataggtatacgtgtgccatggtggtttgctgcacctgttgacccatcctctaagtttcctcccctcaacacccacccaccgacaggccctggtgtgtggtgttccccctccctgtgtccatgtgttctcaatgttcaactcccccttatgagtgagaacatgtggtgtttggttttctgttcctgagttagtttgctgaagatgatggcttccagcttcatccatgtccttgcaaaggacatgatctcattcttttcatggttgcagagtattccatggtgtatatgtaccacattttctttatctagtctatcattgatgggcatttgtattggctccatgactgctattggaaatagtacttcaataaacatacatgtgcatgtgtctttatagtagaatgatttatattcctttgagtgtataccctgtaatgggattgcttgatcaaatggtatttctgattctagatccttgaggaatcgccacactgtcttccacaatggctgaactaatttaaattcccatcaacagtgtaaatgcattcctatttctccattgtgtcgccagtctctattgtttcttgactttttaataattgccactctgaatggcatgagatggaatctcactgtggttttgatttgcatttctctaatgaccagtgatgttgggcttcttttcatatttttgttggctgcatgaatgtcttctttaggaagtgtctgttcagatccttcgcccactttttgatggggttatttttttcttgtaaatttgtttacaatctttgtagattctggatattagatctttgtcagatggatggatcgcaaaaattttctcccattctgtaggttgcctgttcactctgaggatagtttcttttgctatgccgaagctttttagtttaattggatcccatttctcaattttgacttttgttgccattgcttttggtgttttcgtcatgaagtctttgcccatgcctagatattgcctaggttttcttttagggtttttatggtttggggttttacattaaagtcttgaatccatcttgagttgatttttgtataaggtgtaaggaagtggtccagtttcagttttctgcatatggctaaccagtttttctaccaccatttattgaataggatatcatttccccattgcttgtttctgtcaggtttgtcaaagatctgatggttgtagatgtgtggtgttatttctgaggtctctgttttgttccattggtttatatatctgttttggtaccagtaccatgctgttttgattactgtaggcttgtagtataatttgaagtcaggtgcatgttatttcttgacctgaatctttcctttgggcttcagtttttattaggcttttcctttgtcctgtatagtttcttggatgcttctcttctctacactcaaggttttctttctgttgttgttgtgtaggcaacacaatagatgtcatcttttgggaggcttcctaatgctgcttttggtgttcttgtgagctcagaggattcctactttagagtgaactgtaatgtcaacctctaccctagacaatgagtaggaaccatattcaatagaataagaaggtgaggctttgctaaaattatcccatctgtcagtctgtgaaaccagtagtttgaagattgtaatcacaacattgacacacataatgttaatttcaagcagttacataacttaattgataagtcaatctaaatcatacctgcatggcaacagaactagggttagaaagtgaaaaatattgttaagtaaccatatacttctcttagatttgatctggcagcagacatttctgtattctgagataaaatagctgtggtaaacagattgtgtgaaggcatgcatttgcatccaggcctacaggaccaatattaagagaaagggaacaattaatttgtctcagtggggtagtaaagagacacagccttcagagtactatgggaggttatatttcaacttcttacagttagtttgtaaatctaactgtaagactggcattgttattaatgaaagtttcagctaagaatgaattagatctaagttacactttatcagtatttattcttcctgctacctattaagggcacctgaactgctaggcttacataaaaatgtcccatttcctgttgctagctgtgctttcctttgataaactcattacaaattgcatgtaattactgtattgtgaagaagggagtggcaataaattaggcacagaatttttgaataaaactaggcagctagaaagactgtttctaaataacaaaaaatttgatatgaccaagtaggttaaaattaccattacatatttgattggtacaaaattaattgtggtttttacaattactttttaacattttgccgctacttttactattttgccattacttttaatatggcccatttttaatggcaaaatctgcaattaattttgcaccaacctaatattatcgtatatggaattttctgtatataaagcaaagggaaaaaaaaggaggcatatagaccttagcttatgtactttatgattataaatgattacatttatctagtgaccataatgctttatgaaagatgaaaacattcttctgggggaaaaaaaaaaaactaattaacatccttgcttgcagagattggtagacctgtttcttctattttagatttcagcaggacacctctatcgttggatgaaaaatgctgacttgcatgttctgggaatctgggctcaccccgaggctaatagcacagtgccctggctgtgtgcccaacgtttgtggcagggagttacccctgagtgctttttttaacttacactaaagttttgacttagaaagcaatattagctagtgcttcacaggaaactgggctttccctctgtaacactcaaagtcaaatcctatttcttggtctgatataatctccataatcataaagatctttgttggagaagttaagcagggaagactacatgtaggattctcctaatcttggggaacccaagttttgtgcccctttcaattgggatgctggagcggagttgggtcatggagattaatctttagaggtgtgtgttcatagaggagaaaccattgagaacaaggaaaaaggaaaagtggagaagcacagctcttgtttgaccttggaggctttttacatggaattaaaattcagaaactggctgaggttacaaggagtaattgtggcaattgcctcatccctactgtcagcacatggcaaagtttgctatggacagaattgcagggagttctttcaaaacagttcaaaatattgtcaagattttcttcaatttctcatcaacctttaagagctcattgaagacattagatattttgtgcccaactcaatgttgcagagaatttcagggcaagagaaatagaaatgaagttgaaatatacccatgtagtttccttcagcgatactatctggtatataagaaaacttacaaacattttttaagaggcctcaggcattacaattataagtttttttcttctcttcagacttttattctaataagttgttagccaatcaaacaagcaaaggtgttttaaaatacttcagtttatagcaataatgatttttaagtttgagaaatagaaaagaatcaaatcagtatcttaattagcaaaacctagttgatgagagagatgtgctttgtttgctatgcatgagattgcttgaaaaatgtgatttagctccaacagagcctccctactataggattttttttttttttttttttttttttttagaaaatcaatacatctttctgtcaaaatttggttagggcaaaatttgactaaaattgtgccaaataaataagatttttttcttatctgagattgatacatctctatttcttatgtataattttttatctcaggccaatgagcccaaagtttcttggctcttgttatatctttgaacctgtgacctttcaactggctagcaatgggcatgaaaaggagaataattgttgctgaaacaaaataggcttttttttttttttgaggaaaaagaagaaagagaaagagacaaaggaaaaggagaaagacaagagaggaagaagcaggaggaaaacagtggagagaagaagaaaaaagagaaaaaataaattacagctatctgggcttccatgggagtgccaactctgacagctgagacatctctgacttggctctttcacctcttgtgcaagggaagaacagcactatttttaaaggaggtcattagtgagtcatgtttaagctcaatgcttagccatcatcgccatttgggtgcttgttgggaaggtcctaaattgagcggcctttgggcacagatctctgtgcactttgtttgccacttgctggctagctgatctggagactagttgaattttgcagtttttctgttttattttcctgacaaagcagtcgttccattaagaaaaaagcactcagctattaatttctgctaactcctaacctggtcaatgaattataagaatgtgcagttttatgtctattttagggcatggatgtgggggtggtgaaaagtcttcttggcttggagctctctctatttgtctcgctctttctagttcttttttgttcatccttttcctgacaggctgcttgatgcttacagaatgatgcaagattgtaacagattcagactagatgaggaagagaaagagcttagtaaaagcccacttcttaatagttgaatttttttttcttcaaaaaaaaagtcctatcaaccaaaaaaaagctcaggaccagacagattcatagccaaattctgccagaggtacaaagaggagctggtaccatcacttctgaaactcttccaaacaacagaaaaagagggacttctccctaactcattttatgaggccagcatcatcctgataccaaaacctggcagagacacaacaacaacaaaaaagaaaatttcaggccaatatccctgatgaacatcgatgtgaaaatcctcaataaaatactggcaacctgaatccagcagcacatcaaaaaccttatccaccatgatcaagtgagcttcatccctgggatgcaagggtggttcaacatatgcaaatcaataaacataatacaacacataaacagaaccaatggcaaaaaccacatgattatctcaatagatgcagaaaaggccttcagtaaaattcaacaccccttcatgctaaaacctctcaataaactaggtattgatagaacgtatttcaaaataataagagctatctatgacaaacccacagccactatcatactgaatgggcaaaacctggaagcattccctttgaaaactggcacaagacaaggatgccctctctcaccactcctattcaacatagtattggaagttctggccagggcagtcaggcaagagaaagaaataaagggtatttgaataggaagagaggaagtcaatttgtctctgtttgcagatgacatgattgtatatttagaaaaccccaacgtttcatctccttaagctgataagcaacttcagcaaagtctctggatacaaaatcaatgtgcaaaaatcacaagtcttcctatacagcaataatagacaatcagagagccaaatcatgagtgaactcccattcacaattgctacaaagagaataaaatacctagaaatacagcttacaagggatgtgaaggacctcttcaaggagaactccactgctcaaggaaataagagaggacacaaacaaatggaaaagcattccatgctcatggataggaagaatcaatatcatttaaatggccatactgcccaaagtaatttatagattcaatgctatccccatcaagctaccattgactttcatcacagaattagaaaaagctactgtaaatttcatatggaactaaaaaagagcctgtgtagccaagacaatcctaagcagaaagaacaaagctggaggcatcacactacctgatttcaaactatagtacaaggctacagtaacaaaaacagcatggtactggtaccaaattagatatatatatatataccagtggaacagaacagaggcctcagaaataataccacatatctacaaccatctgatctttgacaaacctgaccaaaacaagcaatggggaaacgactccctacttaataaatggtgttgggaaaactggctagccatacgcagaaaactgaaactggaccacttccttataccttatacaaaaattaactcaagatggattaaagacttcagcataagacctaaaaccataaaaaccctagaagaaaacctaggcaataccattcaggacataggcatgggcaaagacttcatgactaaaacactaaaagcaatggcaacaaaagccaaaattgacaaatgggatctgattaaactgaaaagcttctgcacagcaaaagaaactatcagagtgaacaggcaacctagagaatgggaaaaataactgcaatctatccatctgacaaagggctaatatccagaatctacaaagaactttaacaaatttacaagaaaaaaacagccccatcaaaaagtgggcaaaggatatgaacagacacctcttaaagaaaacatttatgtggccaataaacatatgaaaaaaagctcatcatcacttgtcattagagaaatgcaaatcaaagccacaatgagataccatctcatgccagttagaatggtgatcattaaaaagtcagggaacaacagatgctagagaggatgtgaagaaataggaacccttttacacttttgttgggagtataaattagttcaaccattgtggaaaaaagtgtggcgattcctcaaggatctagaactagaaatgtcatttgacctagcaatcccattactggttatatatccaaaggattataaatcatgctactagaaagacacatgtacatgtatgtttattgcagcagtattcacaacagcagagttggaacgaacccaaatgcccatcaatgatagactggataaagaaaatgtggcacatatacaccatggaatactatgcagccataaaaaaggatgagttcatgttctttgcagggacatggatgaagttggaaaccaccattctcagcaaactaacacaggaacagaaaaccaaacaccacatgttctcactcataagtgggagttgaacaatgagaacacatggacacagggaggggaacatcacacaccagggcctgtcagggggtggggagctaaaggagggatagcagtaggaggcatacctaatgcagatgacgggttgatgggtacagcaaaccgtcatggcacgtgtattcctatgtaatgaacttgcactttctgcacatgtatcccagaacttaaagtatatattaaaaaaaagtctgagtgtcttaagtattagtcattgctatttggatggtttcttttccagggaaaatattaaaactgtcttgtacctctctattccttttctttctccctaggttttggaaatcactagtgggtaaaaaagaccaatttgcaactaggctctcatgctctgttgaaaactatgtcacaatatcacaatactagatgctgggctcaagacagcaaacagaaagcagtaagttacacatataaatgacaaatatctgattcacttcaattaagtaactatttttttttaatcacaagaactgctttttcccgaatctgttggattgtcagtgtattagaagtgagcatgttctaatttataataggagaagttggagaggatgagcaagaggtttgccccatttctgtaaccatcagagacaaagcaggaggagcctccaaaaattagagcagaccttgccctaaaatgacataagtagctatttaagtgatgtgggcccagcatggtatagccataaatacatccaccacaactgtattaaaaggcctggaatgttcgcttcgtagggactcatacatgatgttgctcggcagtgaaatgatagctaattgtctagtgcggtggattactgtagccaatcacttagcaccatactcttttaattgaatagcaaacgtataggcttgggatgagatgaggctgtctagtatgggttggcatcctggggaggtctgaaaagacagaggcccgattaaaaggcttcaggaggcagagtcagagaggccaacagtgtactttgtctctcataagatttgcttggaatctgctcaacgctaaaagcccctatttagaactggaggttcccaagagatacatttccatcattttgtgagaaaagaggcagaatacgagggagataacacagacgtcatagctggagaataagaatgatttaatgtgttcttggcactgtgctaagtggcttgaggttcacacacctcatctgatccatggttaccatggctgtgcagctccatcatccacggaaatgaaaaaaatacataattgcctacctgtttcaacccatcacccactagacaaactgattgcttaggctttgagttagagctaggcaagtgatatttttaaagctgcacaagtgattctgaattattatcaggcataaaatttgcttattttttacaactcctcaaacaggaatattgcctcatcttctgcagaagatgagttgcaatctatccatctgacaaaggtctaatatccagaatctacaaacaacttaaacaaatttacaaggaaaaaacaaccccatcaaaaagtgagtgaaggatatgaacagaaacttattaccaggcttgagatgtgcttaatttttacaactcctgaagtaggaatactgactcatcttctgcagaaggcgagagtaaagttcatgtttgactgatggagagctagaacctgggcctatcatttctggtttcttggtttttccatttaagacaacagcttccctgaaggtttgaagtcttaggttttgagtaggtaactataggacttccaactgtatcccactttatcctctgagtgattggtccaaaagaaaacaaggaatctacttactgtcagcaggatatacagaaaacagcataggaattcacataccagtggctttaattatggctagttgtgtgactgtgggcatacgaccttgctaagctttcatttccctatttgtatagtggaaatgataaaatgataaacagtatctcaaatttaatttgaatattcaataaggaagtatacataaggtatttaaaatagtatttggcacacagtgggtacccatctatgtgctagttcttgttaccatattaatggctactaatagttttctcttggctagacaatggcatttgtcctattctcttctttttttctttaaacaaaagaatgtggtgactggagagaaggcactagaggtgggacggagttaaagactataatgaatcttgcagaatctctcttgcacccagtaaaaggtgcctaatttctgtgtaaagggctcacgatggaaatcaggttaaaacaaggaacttaatcttaaagccgcgcttgcctatgtctgttaaatcctttattttttcttagacagtgttccagtgggagttggggtggctgatggagacagatggggaggtgaaagcccctcccaaagttgccttttggtgacaccacaacttaagcatcacactttaccttggcctcacttggataaacagattcctctggtgtaattttgtgagctgccagacacagacaagtatgtttatcacttgaatggcaagcttcagcgttagagttgctctatttatacactgctttgcagacaatcctgatgcttttacataattggtgagctccactagcttagcaggcaagtaaataagatggtaaacaatactcttttttctgcacaggcttgtgatgaattctcaagccagctttgcttgcaattagtctggataacttacatattttacattacatgagatgacagttggttttattgcttttcccctaaaagtcgggccttgctgtgacagctacttcacaagcacaggggagcctgctgggcaatgggaagggcaaaggatggcaaattggtctggttccattattgcaatgtaattactcaaacttagccttgctggatttgtgcaacttctctgtaattacataatgatccaaggctcaagagaggctggaggtttggatgcattgcatggcatgtatattcattgtgctgcaaacttccatgacttctagggtaggcattgtggtccgtaagaaattataatgaaggcttggaaatgtatagactgcatgcaggaatcatgcatctgccaaggcacagggaaagtctagaatgccaaggcacttgagaataatctggtttctgtacacagatcttgcctctaaatccttgctctacaaaggagtcaactacagtcactcaggattctggaaagggtctagattcttccaccttgcttccctccactctagaggcagaagagaagagccaacagtgtaggtattaagacagacttacattttgtttccttcagagatgaagtggaagcatctttgactaatgtgtacacacttgaatgtccataagagaagcaaatgcaggcatccaactgctaatgaatgatctaaaagattacttggtagcttttagtataatcctgaaattagttaatggaagtgccactaatgagcatctattaatagaaggcaagtgtagtaacactgctaatgtaatggcctggagctataataaaacatgtgaacaaaacacatctaatactgttctatgttaaaatagctctcttgaaaaacacagagctagaaaatgatcacaactaagagacattttaacaacagggacattacttgatgggactcaccatcaagttttaaatggggtagtggacagtaatacttccagaccctctttccccaggggattttcttgattattctggctgggtatcaaaagttctgatcttttcttagaactctttatataacaaggaactaatatttaaaattcaacatttaagtttgtacttctttatggttctttgttttgtgagttaatatagtctccacagcaaaattatttccaacctgaaaacaggggacctatctatctgtaatagaatatcttccctactgtttttctttctcaccactccagcttgagattgaatgagtaccacactctgtgatctcacagagtgttctgttttcctttctttataccctagtcatagcatatgcaaataaccacatcctttgcagggacacgggatagctggaggccattatccttagcaaactgacacaggaaccgaaaaccaaatacgacgtgttctgacttacaagtgggagctaaatgatgagaacacatgaacacagagggaaacaacacatactggggtcttttggagggtgggaagagggagagcatcaggaaaaaaattgatactaggcttaatacctaggtgatgaaataatctgtacaacaaacccccatgacacaagtttatctatgtaacaaacctgcatttgtacccctaaacttaaaagtttaataataataataataaatctccttgatgaggttctttggaattaggggttctgcctttttgtctctagtcatatgcccaggactaaggcactgaacaatgacagcacggtgctatatatgaccaacaagttagttgtgttgtttagattcagtttgttcctgtatcttaggagaaactcagagaataatgagctactccctgtcttcaaagggcttcaagtctagaaatggttattacccatgttttacatacgtaaaattcagatcatgctgatgaatgaatacccacaagtggaaatgtaatgagaatattcataacgtgggcttaaatttacttttctcttttctaatgcaattatttatttaattaaaaaaccatttgtcttgaggactgcctttcatcagtgcaagtgttgacaaattcctgttcactgctatggaatacagaatgatgaaagtcagtcatcccatatattttcattgcagtgtaaaggttacccaagctttgacatcatatacataatatttttccctgcctgcagcagacattagctgtaagtatgcctatgcaaagatcacatacacaccacaagaatcaaatatgcttatgtaagaattcttatacttaaagcagtatagatagatttagtcttcatgtttatggctacatgatgtggaaaaggctgcggaaatgctgctgtctacattggcatgacattggaattaaagccaactggaggcagctgcagctgtctacgaaacaaatctggggaattcaacagtagaagccaacggctgcagccaaaatcccacagtggaaaaagccctgctgtgggacctggcattggcagtcatgtgttggcatcactgaacttcatttaatgaaagacccccaggtcttcactgtgggccaactccattactgccatattctagtcctcattaaaggtttgggtggcagggagcttttctatgcagatatctgctgccatctatgttgaacgcagaaatggtaggcgagcctcaaagcagtttaaaatccacctgttttgatgcataaatagtcaagtaactagacttgatcaccaatccaaggtgaggtgtcaggggtggaggagggtggaaaaaagctatacctattgttagagaaatttgcagaatgttttgattatatggaagttattcactttacagttccttttgcaaattacatattttactaaattgtctccttttattaaccataagaaaggaaaagcaagcataatcttttcatatactcaagccatcattatggttaatttcataatggtttacatgcagtgccaaaatgttcacatgctagcaaattatttttattttatacataatctaataaccataaccataaagctgaaatgatttctagctttcattttgaccatgtccctaaaagctgtttacctggctgctgatcacatgtaaactgaattggttccttaacaaagggatgaaaattgagtggaagaggtatcaattagagaaactgaatggctcatgaccctactaagttgcaagaatactattttcacaattgtaatgataaaaaataaaaaaatgaaaatgccactgttcaacagaaatatattttcctataaataaatatatttgtaattacagataccaatcacaacttgggcattaattaaacagagaaaacacttaaaaaaaatctgttgttagagaatctccttaatttttttcaaagctgaatagaacttgtccttgcattaaactctcttctgtgttatctgtgcagctgcaaaactttattcattcagtcagtcaaaagttgatattgtttgcaagactctccaatggcaaatctcctaaataagtccttacagctcttcatattttcacaacaccacatcagtgtcattaatgtgcatcatctccacgttccatcctttcctggaaaggttcattatgatcctccaaacataacctaacaactatacttttctagagtgcttctggaactagccaggcaaaattcgtgtgctgtatcttatatcttactttttgccttcctgtattgtgtgcttggttctttaaaaaacagttatgcacatgtaaaaaaagtattaggcaaaagtatgcaggttaaagatatgtacacctaagtctagttactgatgattatagcaatagcaaaagataaataagttcatatcttttttgatggaatcacatatcttttatgttgttattgttctatgaaaaatcttagagatcaactaaaccaaaactcttattattcaaatttgaaactgtagtccagaaagaagaactgattggttacaagttccagagctggcatcatcagagctagggctgcaatccatctctagatccccacttgggagctttttcttaggctccacgctgaaagacaagccatcctatgataagtactgaattataggaaggtctcgctagtccagaaacattacaggttactctaaagattctagttttgctagatgtgtcttgtcttcccctacttttgtttatagaaatccttggctccaaataaagcctgtgacacataagcttcttgctgttatcacttttttcatccctttaacacttcctggaatgctgttaccttcactacctcattctaattccatcagtgcttctttataagcagcccacaggatggctttcattataacagccacacattgcaccttggctcaagtgagaaatgctgcttagatccacaaggtaaaacaaaataaacagttgccttcacctgtttcacaatcttcattctacatcaactcttaatcactataaaggatacacatgataggcgtgtgcaaattagaaatggttcaaagaataaaaatgctactatgtgatcagtttttctttaaaattataattaattatcatttagaattaatgaacatatatggatattcatgtaaaatttaatgcaaaatgttgtaagcaaatccagttctgctctataccatatttacttacagcttacaagaacaaaaaataaatgtactttcataaacagattactatgatggttctgttcactctacatttaaaacagccactttgtcattttttgaaaacttgcctcatatgggagggagttctccacatgcagatgtctgctgccatctatgtggaaagcagaaatagtgggtgtggtttgaaacaagtctcttttgtgtgatgcacaaatactcaagtgtccagactttatcatcaaaccgagtggtaagttggaaatgaagcccaatttttagtgacctgccacctctcctaggccttgcttgattctctgaacgggactcatagcttctacattctccctggcctgctttgccttagggcataagataaggaatgctcagtttccagaagactgagaaatgccacttctacaagagaggtgctggttcttggcacagttgctttctgagctgaaaaaaagtgccatgacatgtacagaactacaatggagttaaattctgaagagtgtaatatatgtatgcacatatattagacacgggaaatgtgcatatgtaagaaatggaaaatgttcattggacttatggcattcacatctaattggggatatacctgatccacatctacaggtctttagggttgctcaggatttcaaatcttcccatttaatctttataggtgatactttggagggtggctgcccatttctctctaaatggctatatctagtcccccacttttcacactcttttttttattttctttgagtctcagttgaactattcattcttgtcttccagaactcacttcaaatgggttttccatctatcatgagtctagtgttctcacctttgtcttacaattaattcttctgcagatcccctcacactgatctcctcccctgagctttggacaattatattctctcatctctttcacataaatcgcacttggaagacaaactcctcaggttaagctgccatctggtgtgtgtatttttcatcaagaactagcaacacccacatcaatagcatccacctttaccatcacctatataagcaacttactttgggaacctatttccttatttcagcattctcatttgaatcaatctagcctaggttagggacactggaaccaaacttggctgtccctggactggcctgggatacctataatataggagggactcgacgaggaactggaggtgtgagagcaaataggaataagatacagtttctgagatgaagaatctaataaaatccaatagaatggggctgtgtcctaagatgaagcaggccaggaagattttagcaggaaatgggtccagttcaaaaaatcaagcaaggcttgggagaggtggtagatcactgaaggtcaaagcacaaaggatcaggatctagtaaacgggctttggaaacggaaaaccttaggagaccctgaacatttcaaaaagacatttgtgctctaccttctttcaaactcttaactctgggcacctacactgtagagatgtaacagaaggcagaagaaatcaggggcatacaggtaggtgtgtcatcttttggttggcacatagatgttctgattacagacagattgtattattttaagagagatggggcatgtgaatatggtgcaagttattttttttttgtcttcagtttttttttcaagggatagcaaggtttatatagagtggtgtgcctttcgaatggcctctatttacacaaagagattggggattaggggaggatagggaagggaatttaaccttacatcctcacattgaatggcctttgtggaagcagtcctaataattttccattactgtccaactttgtattctgtttttttttttttttatatactttaagttttagggtacatgtgcacattgtgcaggttagttacatacgtatacatgtgccatgctggtgtgctgcacccactaactcgtcatctagcattaggtatatctcccagtgctatccctccccccccgccaccccacaacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgctgcagtaaacatacgtgtgcatgtgtctttatagcagcatgatttatagtcctttgggtatatacccagtaatgggatggctgggtcaaatggtgtttccagttctagatccctgaggaatggccacactgacttccacaatggttgaactagtttacagtcccaccaacagtgtaaaagtgttcctatttctccacatcctctccagctcctgttgtttcctgactttttaatgatcaccattctaactggtgtgagatggtatctcatggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttctctctgacggtagtttcttttcctgtgcagaagctctttattttaattagttcccatttgtcaattttggcttttgttgtcattgcttttggtgttttagacatgaagtctttgcccatgcctatgtcctgaatggtaatgcctaggttttcttctagggtttttatggttttaggtctaacgtttaagtctttaatccatcttgaactgatttttgtataaggtgtcaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtatcagtaccatgctgttttggttactgtagccttgtagtatatagtttgaagtcaggtagcgtgatgcctccagctttgttcttttggcttaggactgacttggtgatgcaggctcttttttggttccatatgaactttaaagtacttttttccaattctgtgaagagaggcattggtggcttgatggggatggcattgaatctgtaaattaccttgggcagtatggccattttcatgatattgattcttcctacccatgagcatggaatgttcttccatttgtttgtttcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtgtaagaatgcttgtgattttggtacattgattttgtatcctgagactttgctgaagttgcttatcagcttaaggagattttgggctgagacaatggggttttctagatatacaatcatgtcttctgcaaaaagggacaatttgacttcctcttttcctaattgaataccctttatttccttctcctgcctaattgccctggccagaacttccaacaatatgttgaataggagtggtgagagagggcatccctgtcttgtgccagttttcaaagggaatgcttccagtttttgcccattcagtatgatagtggctgtgggtttgtcatagatagctcttattattttgaaatacgtcccatcaatacctaatttattgagagttcttagcatgaagggttgttgaattttgtcaaaggctttttctgcatctattgagataatcatgtggtttttgtctttggctctgtttatatgctggattatatttattgatttgcgtatattgaaccagccttgcatcccagggatgaagcccacttgatcatggtggataagctttttgatgtgctgctggattcgttttgccagtattttattgaggatttttcatcaatgttcatcaaggatattggtctaaaattctcttttttggttgtgtctctgcttggctttggtatcagaatgatgctggcttcataaaatgagttagggaggattccctctttttctattgattggaatagtttcagaaggaatggtaccagttcctccttgtacctctggtagaatttggctgtgaatccatctggtcctggactctttttggttggtaagctattaattattgccacaatttcagatcctgttgttggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgagtcttctctctttttttctttattagtcttgctagtggtctatcaattttgttgatcctttcaaaaaaccagctcctggattcattaattttttgaagggtttttggtgtctctatttccttcagttctgctctgattttagttatttcttgccttctgctagcttttgaatgtgtttgctcttgcttttctagttcttttaatggtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgaggggttttgagtgagattcttaatcctgagttctagtttgattgcactgtggtctgagagatagtttgttataatttctgttcttttacatttgctgaggagagctttacttccaagtatgtggtcaattttggaagaggtgtggtgtggtgctgaaaaaaatgtatattctgttgatttggggtggacagttctgtagatgtctattaggtccgcttggtgcagagctgagttcaattcctgggtatccttgttgactttctgtcttgttgatctgtctaatgttgacagtggggtgttaaagtctcccattattaatgtgtgggagtctaagtctctttgaaggtcactcaggacttgctttatgaatctgggtgctcctgtattgggtgcatatatatttaggatagttagctcttcttgttgaattgatctctttaccattatgtaatggccttctttgtctcttttgatctttgttggtttaaggtctgttttatcagagactaggattgcaaaccctgcctttttttgttttccatttgtttggcagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcaatggtctttacaatttggcatgattttgcagccgctggtactggttgttccttcccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaacattggcccccactctcttctggcttgtagggtttctgccgagagatccgctgttagtctgatgggcttccctttgagggtaacccgacctttctctctggttgcccttaacattttttttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagcttgttttccaacttggttccattgtccccatcgctttcaggtacaccaatcagacgtagatttggtcttttcacatagtcccatatttcttggaggctttgctcatttctttttattcttttttctctaaacttcccttctcacttcatttcattcatttcatcttccattgctgacaccctttcttccagttgattgcatcagctcctgaggcttctgcattcttcacgtagttcttgagccttggttttcagctccatcagctactttaagcatttctctgtattggttattctagttatacattcttctaaatttttttcaaagttttcaacttctttgcctttggtttgaatgtcctcccgtagctcagagtaatttgatcgtctgaagccttcttctctcagctcatcaaagtcattctccatccagctttgttccgttgctggtgaggaactgtgttcctttggaggaggagaggcgctctgctttttagagtttccagtttttctgttctgttttttccccatctttgtggttttatctacttttggtctttgatgatggtgatgtacagatgggtttttggtgtggacgtcctttctgtttgttagttttccttctaacagacaggaccctcagctgcaggtctgttggaataccctgccatgggaggtgtcagtgtgcccctgctggggggtgcctcccagttaggctgctcgggggtcaggggtcagggacccacttggggaggcagtctgcccgttctcagatctccagctgcgtgctgggagaaccactgctctcttcaaagctgtcagacagggacatttaagtctgcaaaagttactgctgtctttttgtttgtctgtgccctgcccccagaggtggagcctacagaggcaggcaggcctccttgagctgtggtggactccacccagttcgagcttcccggctgctttgtttacctaatcaagcctgggcaatggcgggcgcccctcccccagcctcgctgccgccttgcagtttgatctcagactgctgtgctagcaatcagtgagactccgtgggcgtaggaccctcccagccaggtgcgggatataatctcgtggtgggccgttttttaagcccgttggaaaagcgcagtattcgggtgggagtgacccgattttccaggtgctgtccgtcacccctttctttgactcggaagggaaactccctgaccccttgcacttcccaagtgaggcaatgctcgccctgcttcggctcgcacacggtgcgcgcacccactgacctgtgcccactgtctggcactccctagtgagatgaacccagtacctcagatggaaatgcagaaatcgcccgtcttctgcgtcgctcacgctgggagctgtagaccggagctgttcctattcggccatcttggctcctcgatcgtcttctgtttcttactggcaatattccccaagctagagctatgcaatcagtcttctatattccttaaatctgtatagtctattgtaaagttaagtatgagtttctattatataaattaactcaagtattgttcagagattttacttatataaattttttttcatctggaggaaattaatgtatatcattatatatagaagccattttctcctgaaagtaacaatgtaggtactttgatgttatttgcagtgaaatttacctttacagggataactgcagtaaccttttaaatgaacatatgtatatatgtgaacttgcacctgttattgttgtcatggaaacagttccaaaacataagatacaattctattattgaggcagtatagttccccaaatgaattttaatgaaattgcagcagaaaaaaaaaaaagaattttatggaggcttctaaattatttagtaaagtttgccaactagaatctgactacatcataccatagtaatcttcacctaaaaaggaaacaacagtcagcaaatgtcaatcatgcaaaaaggggcataaagtaggtttatttaaaaagtgaacacagtaccccaattctagctttttagtgtctatctttaatattgcccaatcactactcctattgttgatggaagtatatttgaccattagctgtctgagtggcacacaccaagatcactgagttatctggatttttttcctagtttctgtcatctttgggctttctattgacatgaggtgaatagatttagggctagaatgttttaaatgctgagagacctaaaggacctctatttcaacccattgcattacagattagggaaccaatgcctaaaaaagttaggtgatttgtctgaggtacacaagtaaatgtggcagggctgcattaggggttgggtttctgactctcctcctcccatgcacagtcactgtgctgcctcgtgaaatacagccctctctgctgccagttacaactggtgcattctactccagcctgggcaacagagcaagactctgtctcaaaaaaacaaaaacaaaaacaaaaaaactggtgcattctttcataaaggaaagaaatcaaattctgaatgtgaatacctgaattttcattccccacttacattgttacaggagtgaagtacaatttgcttaatgaaataaaatttcagtatcctccttagtgtatgtatctcctcactaaatatgttgattgcatgtagattacttcttttacccatggaaaccgaacgaatatcttaatgtaagaagagtagttttctcaatttgtaaccactgcttcacctcttctgtaatccgaagtcatgtgaatgaaatgtcccaggctcataatgaagccaactgtgaaaccagcgcttacctccaagtcaagagcctgggaaacatctatggagcttagcttaaaactatctgatgatgaattgggactccagtatatcattttgtgcacacagttatggcataatatttgggggaaaggaagccttcacagttataaaatatgagtgggaaatgattatccctagatacagagagtacttattatgtaactgttgttaagggctgacgacatggcaggctctgtgccaagtcaagtctccgacggagcggaggactccccaggctctagaaggcccctgagacagtgtgtcatacagtgatgaggggtagaaaatactctaaccattcaggatgtgattgttttggcttcctctcggctgagcttttggcacttgaactggacccaatgcaacaccacagctgggaaatgacattatttggattggttaagaggagtttttgaagcaaaccccactgtagtattagagaaataaaaaaattcctgctatatccaacaagtcccagagaggctgtctctctattgttcacatgtttggacatgaatgtgcatttatgaacacttttttgtataaatacacagatatataagctatgcaaagccatataaatctgtactactagaataattcattccataaatatttcttgagcattcactacataccaagcacatttttctagtttaaaagtgaagtcgggcatggcagctcctgcctgtactcccagctacttaggagactgaggcaggaggattgcatgaacctaggagttcaaggctgcagtgaaccatgatcattgccattgcactactgcctggatgacagaatgataccccgactcaaaaaaaagtgacccacatgtgtatttgtcacttttaaaatagagacaataaatttcttccgtgatttttaaagaacttaaaacagaggtactattcaacccagcaatcccattattgggtatatacccaaaggaaaataaatcattctaccaaaaaggcacatggacttgcacgttcatcactatgccattcacaatagcaaaggcatggaatcaagtcaggtgcccatcaacagtggattggataaagctaatacggtatatatacaccatggaatattacacagccataaaaaagaacaaaatcatggtttttgcagtgatatggatgcaagtggaggccataatcctcagcgaattaacacagcaacagaaaaccaaataccacgtgttctcacttacaaatgggagataatcactgagcatacacggacataaacgtgggtataatagacactctggactacctggaatagggggcatgggttgaaaaactactttatcagtactgtactcagtacctgaatgacgagatccacaccccaaacttcagcatcacacaataaacccgcacatgtaccccctccgtcaaaaataaaagttgaaatttaaataataaattccttcctcacaggtattaaaaagcacaatgtgagtaaagtacctgatatgtgaccataaatacctgtccccctttgacctcttctttgccctcccctaaccttgaggtgtgattaaccttcctgccttttcaaattctgaagaccacaacagagtagggaaagaagagtgtgaaggtggtccatctaatcccaattcagagcctgggacagacacccatactgaatcctctactttagaaaagaactccacaggctttgagagtgacctgtcacttgtcatagcccctaaggactatgagctttttcaccataagcattgcctatttgttccaatctagtaagatcagatttatcaacagacagaaaaatagatatcagtttttttcttattctaaaaacaatatgtttatgttgttgaatactgggataaaatatagaaaatattaattattcataattcctaatccaagcagtgttccactcaataatttgatctatttcctatagtttgctactaacttcggggcagatctccagaaaataaatattgatggggctatgatgtctccattttgactaaatatattgttatataaagtggtaacgccttacaatttaagtgtgagaaggatgtgtgtgtgtgtgcgtgtgtgtgtgtgagagagagacagagaatatgaatatgaatatgacaatactttggagaaatgtgtccattagaattttaccacaagccagactgaaaacatcaaagatgtttaagtaaagcctgtttagttctttgtgaatgtaattttggaaaacaaactaaaacataaagataaaaggtccacatttcctttcatatttgcaaataaggcttatttcatgaatggtgaaatcgctttgtgtaatttgtaacctcattgttgtcctggattgcctgccatgctgcctgtgtttatgttgcttctccctatggcatgtgctctgagcagacaagggtataattataaatctccatccactaacaagaacaatggttgcatccagcaactcgactctccctttgtgaagctctacagggataccgtcttgaatgtcaaaggtctacaaatgtcatagaaacagctgccaccacttctttgcattaggcatctctttcaacatttactcatggtattgccttacccatctaggcagaagcaaaccaaaatccagagattttaaaatatggtatctataattacaagaaacaacaagaaaccaaagaggaatacaaatacaaccatgccttgtgtttcaagactttctagacttgcttagaaaaaaagagactaaatttttgtctctgggcaaagttagtcagacgagaaagacaaacttcacatgcaaggtatactttttgctgtctccatttttataaaagcaaagttaatgaggctttgatctttattccatagttattaagattattttcctaaatctgagatcattgcagagatatacaaggtagttctgccaaatcattcattcattccttcaccaaacgtggatacgagtgtctactgaatgtccagtaaaagcaggaatacagacattgaaggctcatttcattgcccttagtttctacatatcatagctgtgatgcatggaatattaaggaaacccctaaatctttaactgagttaattcacaacttaccagagctattttcaattcatgaaaataaaggccaggcgtgtaatcccagcactctgggaggccaaagtgggtggattgcttgagcctcaggagttcaagaccagcctgggcaacatgataaaaccctgcctctaccaaaaatacaaataaataaataaactgggcatggtagtgtctgcggtcccacctacttgagagctgagatgggaggatcacttgagcctaggaggtagatgttatagtgaccaagatcaccccactgtactccaaccttggtgacaaagtgagaccctgtctcaaaaaagagaaaaagaaaagaaagatttctcaagtctaagttcagtatttaagaaaaaataaaaagtaacatcatggctttgagcttgattttacctctgttttagactaagaagtctattcaaatggagcctatggccctgtaacctggctctgggaaaatgaacaaaggaatgcaacatcacatcagcactgtgtatttttggaagggtattgcatttttcctttgtggtggattggtccgtgcacttgaaaatacattcacagtgggaaggcaccaactctgctgcacatttatagttgaatctattttttttcctgacaaatattcaagtgggggaggaattccatgtgaatgctctagtgcctccttccctctgatgagtctaagtgctagataaacaaacattatttctaaaacctcaaggggaatacttgaaactggagcaacgtaagaggaaaagtgggcagaatggatagcttctagggagactgtgacatttctgagtaattactgaggggtctagggtctgggggacaacgctcccatcagcagcccttttgttattaaaaaaaatgaacatctgagcaatttaatggaaagtgctgtgaaaacacagctgcaagccttacattcttaccagatcacctcctctaagctttcctatgtagaaattttgaagctttcctggtatctcctcactagggggttaggaagtaagtaaatacactgcactcttggtttagtggtgggagatacattaggaaagcgtcagtgcacatgaagagacccacaggctaacagccatcatttactgagcatctactacgtgagtctccttctgagcgtttccacatctattatctctttaaatttcccaacaacactaaggtaatgacagcctttcctgctgacctatgaaggccaggctgggagttgtccgatgacttttcctgtataatgtcaccccaggggaagacgttactctgatttttccacctcatgtttttccctggcagttgctgtgagagaatgttgtttttggagctgagtaggcaagtggtgtgcatgatatgaaaaaccaaaaaaaaaaaaaaaaaaaaaatgcaccaaaccccacaaactttctgacagaaagcactcgtcaattttagcctgtctatgcaatgatcgaggccttttcctactgctggatatttctaagtgagaagatcctacctcagttttcagctgggctttagctctgcaagaagtgctgccccagtcagccttggggagatcagtagaggattagttagcagagcagccactggagggcactcctgaaatctagaggcttcttcctcccgaggaaagggttgctggagtccctgcctgagactgtgggtttaacaaagagaaggaatgtctgggggataagtcccagtgcactcattctctggaaaaggtctgctgtacatatttgccaagtgataaggaacctaggaaatcaaaaaccatttgacaatttacagtgttcaaaggtagcttcctgactcttgagttacataaatggctatgttaaaaataggcagccaatataattgagcaaccttaaatggcctaggatatgtaccatatgtgatagccatgaaaataatcaaaagaataattcagtataaattaggaatcattcccactccagtggactcagtcttatggaagtggcacataggagaaacttgggattctgtgatttgtgctgttcatgtacaggtctctctctccctagtgaaactcagctctttagtttgggagcctataccggatctctctgatatccctctccagctctaaacatatactacgtagtcacactgattgtccgttaaatacattcaagtcgttattttccttatgacaaaattcacagtgaaaggccacgtgtccaccagaagaataaggtgcaaatctaaagtgggttagtggcattttctcaggacagagtgcatgggaggacaacatagcaatcctggaagttgacagggtaaaacttttggacactctgactctgtgctgtatgtacctgtttgcttctgctttgaaaataactagtaatatacaagatccacttgaaccactgaatttagcaaaatcaggccaaaccagacgtctttgcattaatattgtcattttgttttatattacttaaaaagtcaaacttttttttttttaatcattccttctcttgactatctgctgctctcctgtgatgtatattgtgaaaaacacattttaaaaccaagacagatatctcaagatagacatcatgttcagtttctaagctacaattaaatctcgtagaatggtaagaggtttatatcagactgttgactgctttatatacattactttcattcgagactcatttcatggatgaggaaactgatgtttacataagtcaaggaacttgaccaaggttacatagttataagaagctgagctaggaccctacaggtccatctcagagacctatgatgttaatcattatgccatatgacctgtcttagactagtttaagaaatagcttctcaattaacctctcttcttttaaaagtgttcataggttttaattccttttttttctgcttaggcaatacttaatttttaaactgtgcacatagaagatgaaatggaaaaatgtattccagatgtaggttttatagttgcacatcttggatatggttggttacacatacactacaagcatgtggtacacatctatctcatttttactttagaaatacattctcaacaggggaaacttgaaatacgcaaactgtggtcctgattccacttcaaaacgtctgcttttattgggtttaccctgcaatcatgcaacttttggccagagtcaaatagggcaactaaatttttttcttgagttttacttggtatggttcactgtaaatgcttccaactagtcctaaagacagactttgttcatttgttcttctatgagttttattcagcagaaccttggataacagcagcttagccaaacactgtggggtaatcactctgctcaggactgattcctgtgcagtcagttcttctgcacatcttgccttcaaggtctgccagctgaatgcactgtgtttccaacattgccctccaaacagacctttcataaggaaaagtcactgctacttcattaattccagaagatggatggtgaagtcatattgctttgatatgctttcagactcaggctgttcatgggaagctagaactctctgaaacagaaaagtttttaaattctggctactttttcataggattctattatgacacctcagaggaattttttttatttaagtctgtcattttaaaggaaaatggttagatgtgactagggctgtgaaaacacagtagctaccagtgcctggcaaagtttgtactctaacatatttctgctaaaaaaaaaaagaatattttccattattgccttggattctttcatcttttcttacatgttaagaaacttaatatctgaagagtgagaaatagccattttagtgtgaaatcatgctggggtggaaaggccagcatatttcttatagattagtattataggagagtttggccattttcctgggcagaagcaaggagttggcaccttggaatcaactcttagccatctgaaggctttgagccttggtgagttttccaaccacagggcattagctttctgcagcctggaatggagcgatcactatccccagagagctgtcatgggtgcaggcagtgctcagcttggcttagttctaccatggtcctgaacagccaggctctaggttaagccaaatccagaagtatcttgttttatttcacttgccacgtgtttgagaaggattaatctcagaatatggcagaagccttagcaaagcaactttagaaaacagcatatatatgtgtgtgtgtgtgtgtgtgtggagagagagagacagatctgaggcatgggttttactaatgttattatttaaataaacccttccttatgctagagcaccagatggtgttacaaaaatgaggaaaaaaggctcagggcatataagtcacgtgtcacattagctgtattggcctatgttcaaataataaacattttaatcactgcagtttataactctattttaaattttttgttaatacattaacagtaactgcttacgtatacatagaattctaataaaaatgcataaataacttacaagaggaaagggacttagggattatccctggaagccctcatttcaaaggtgagacccagtagaaacccaatatgcacagaagttaagtgactttctgaaaggtcttgcaggtaattaattatagaacaggactccacgttcaatgctatgttcactattacctgaaatagacttggaggcaaaaataaacttatgtcagctatactcaatgctcagtaaagtggcagagcaatattttataagcgtgtgttccgtgaactcaaatgtgatgttaggtagtgattctgagtcccttaaaacagattgcttgatttatttaaggtatgttctctattacaccaaaaattgtttatggattttttaaaaactgcactccatggagtaagtaccaatttctacacttttgatgacattaagatatgttaagaggcctgaatgttctcaactatggattaaaaataaagtaccaattagttgggtcagttttctacagtgatttgaaattgatttctaagtttccctattgctaatggctgaatgtttatgttttcccaactccaaactcagaggttgaaatcctaactcccagggtgatgggatgagaaggtgggtacctttgggaagtgattaggtcactcttaagagtgaggttagtgcccttataaaagaggccctggacatctcccttgccctaccatcacaccacctgcaggcacagcgaaaagatggctgtctatgaatcaggaaattgtacttcaccagacactgactctgccagagcctagaccttggactttctagcctctggaactgtgggaaatacatttctgttgttataagccacctagtctatggttctttgttatagcagtccaaatgaactaagatatctattgaggctttattgggggaggtaataaaatatgtcatttttttctaggtttaacaacctatattcaattcccctttccgtgatctatagtatgggcataaatagactgtcatgtgtatccaaattaagatgatggtagccaggagaaagattgaaggtgggactactggctgttgatagccaagatctaattctgatctttagggatttaggttcgtttctggttggacggagttgtattatttatctatgcatagtgaagtaaccttgtgatcataatttcagaacaaacaaaaagtcttcacctcgtgatgtcttttaatttgattccacatcaccaggggcagaataagttttatttctagggacattcattgagaacaggatgacgtgctgagtttcagatgtgatcagcttgccaactgtccctgggtcctttgtgtcctgctgcaatatcttctaggaaacaaacacaatgacgtttgaagttcatcaagttcattgattaagctaagatctgcactactttgtcgaaatcttaaatagaacaaaaaatgtttgatgttatatctctcagagctgaaattaactgattaaagagtctctgttatgatgtctatcaatcaagtaaaaaaatagggttttgatctagaaatgcctatccgtttttgaggtatatactttcaaaaccttttgaaataaagagaacagtggttgcaaaacttttaagtatttttactttaaaaaaaggatagaaacaaagcaatgtgtcccattacatcagcatttttcaaaatttagtctctgtactttcatttgcataattttccactttctgtaatattttcataacccttagtgcttaaatgggtggagaggcctgtgccacagtctccaacaaggtgtcaagggagaggaggtgtttctcttctcccaattcacaccatatttagaagcactattctagatgattcctctaaaaatattcaagcttttaggatcttggctttgttttttgtaaattgtacttaaagtcagtgtgactattaccatcaatttgaataagtgcaatgtatttctcatgttgcaggtagtaaaaattgccaacgaatcacttaaatactgagaggactgacaagctataatttattacttggctcaaaatatgtctctactctgtattatctgcctagatcttacttaacacaggaagggtgtagacttcactgaaatgactaattgatgttcaatttgcagattttaattgaaaaaaatatattttgataagtagcagtacttgtttcaaaggaagataccgttatattaaaaagtaaacatccaaatctattggtctaggtctatactcaaaaccttccgggtgtatgtatgtgtgagatattttaaagtaattctaaccaagccattgttctgtaacctgacttaacaagctacagaacaattccttagcttaaattgttaaaggggacattgtgatgacaaataaataaaacgtgttagcagaataaaagttgtctggaaataagtaaatactattttataatttgggggaaagaaattcaatacagggtaaagagaacaggattttggaattaagctgagttaaaattcttgctctggacaacagacaaattacttaacatgtttgaatttcagttttttatctacaagttgggaataatatatgcattacgaagagattacaagtactaactggagaaaacaatctgagaccttggcaaataatagattatccaacttaattccaatattattaaaattagtgatcattagctggcactttacaacagaaatgatctgaataaattttcaacatatacatgctctgataccatgacaggaaaatgtaagtgcaagcgtgggggggcggtgtcaggagactcgtgtgtttataattctgatgcctatctctctgaagagtgactcttcgagttattcttttcaatagatgtacttatggaacataatttggtcatattgtagtgatctgctactaaagaaactttcgcctaactttctcctagccaaggatgtgagtctctcaataacccacatttacccatgagttatgttaaatgtgccttgtgttccactggtttagaatttggggtttggggaaaggcaaatgggatgttttcccagtgtactttagcacaatataggtgaaatcatacatgtatatgcaaaaaaagtacctgtaactgttctgtagttccaatgattgattggatcacaatactaaggagggtcagaatttgatgattattctggctttttgggtggccccaaactcccaccagctatcaaatgaaggcgtcgggggagaatatatacagtctacagaactcgggagagttaaagagtagcaagttccaatcaagaagaaatgttttattcagtaattactttgaagaatttttttaagagcccctgaaaatactggatttctgcaggggatattgcgaaaatactaaaatactaaggtgtgaaaatgattctcttttttgaattaaaaaaaaaatcaatagaaataattcagtgtgtgaggtagataagcttcagacaaagggaaaaaccaaacctgctagtcagagatagatataaaaaagagaaaaatcaacctctacgttatgttgccaaggagactgtgtaaacagacttacacaaagagaagtggctggctggcaatactgctaatgtggaaaatctcttcattgttgtgtggcatgcttcatctcagaagagcaggaaaaggtggcaggcagagagggagaaataacaagaatggaagagtcgttcttccaaaaagggccatctgtgaccctgagagataaacctggcagaccagggctcacatcttagtaaatcacctgtaaataaagcttgtaaggcctgtgcattgtctcatgattattttattaataatactttaacccttgcaatttgatacgctgtgcaaggtagtcttacaggggatcttttcattgagacgctcaacttgtttgttttgtgcttctcaggcaagggcagtgactggaagctgggagagagggtcaacagctgaatctcagcctgatggaggccaccatttaataagtaaatacatgcacggtaagcctcatatgactttcgtctctctattcttttagaagttggtctaatccaaccatatatacaaatgcaattatttctccttcaatattttcattcattcaatatacatcgggtattatgaataaagtccgtgtagatacaagtagtctcagttccccaaaatgtttagagtgtataataccaaaaaatgctattataaagtttagtgagaaaaaagtttgtttttatataaccatatatgcaatatgattacaaatctgctaaattgttgagcaaacaataaatggttaatcagtgttgatggatgagcaaactatgaattattttccctcttttaattttcatctccaaattttctataatgtggttgtatgaatttattcatatagagagaatttacaggtggctgaagtgaatctgggttcagatgttggacttcgcggtttattcttttacagagtttgagataagccagtgaagtctgacaaaatataaagcagctctttctgcatttgcaaatatgtgtgcagtttttttttttagatagtacatttgtattttgattgattgattgagatggagtcttgctctgtcacccaggctggagtgcagtggcatgatctcggctcactgcaacctctgcctactgagttcaactgattctcctgccccagcctcccaagtaactgggatgacaggcgcccgccaccaagcccaactaattttttgtgcctttagtagagacagggtttcaccatgttggccaggagggactcaaactcctgacctcaagtgatccacctgccttggcctcccaaagtgctgggatgacaggtgcacaggtgtgagcaatcacgcccggccaagatagtgcatttttaaatgtttctctccagacctgtcatcataaaagttgcttgcttagaagggggataaaataagatgcaaaccagctcttcttttattggagagtttcaatttaatcagaagctgaatgttagcacatatatatatgtgtgtgtatatatgtacatatacatatatatgtatatacatgtgtatacatatatgtatatatacacatttgattccaataatatatattttgagccaaattttatatgtatgtatatgtgtatatatacatacatgtatatgtatgtacatatatacatatgtgtgtatatgtatgtacatatatgtatctgtatatatgtatatacatatatatgtatctgtatatatgtatatacatatgtatcagtatatgtatatatgtacatgtatatactatatatgtgtataaatgtatatagtatatatacatatatacgtgtatacatatatacacgtatatatgtatatgtatatacatacatatatatgtatatacacacaaatatacatatatacacgtatatgtatacacatctatacatatttacatatacatacatgtgcgtatatacacatatgtatacatatatacatgtacatatgacgtatatatgtgtatatacacatatatacacatatatacacacacatatatgtgtatatatatacacacacaatggaatattgtccagccatagaaaataaaatcctgtcatttgcagcaacatggatggaactggaggacatatgctaatttgaaataagcaaggcacagaaagacaagtattatatgttctcactcatatgtgggagataaaaaagtggatttcatggaggtacagtagaatggtacttaaaagaggctaaagggcctggcgcggtggctcatgcctgtaatcccagcattttgggaggccgaggcaggcggatcacctgaggtcaggagttcgaggccagcctgaccaacatggtgaaaccctatctctactaaaaaatacaaaaagtagccaggcatggtggtgggcacttgtaatcccagctactcgggaggctgaggcaggagaatcacttaaacccaggaggtggaggttgcagtgagccgagatcatgccattgcactccagcctgtgcaacagagccaaactctgtctgtctccaaaaaaaaaaaaaaaaaaaaaaaaaggctaggaaggacagcaggagtgggggataaagaaacaaacgttggtttatggtacaagaatacagttagctaaaaagaataagttccagtgtttgatagcacaacagggtgactacagttaataataactgattttatatttcaaaatagctagaagaaaacttctgcatattcccaacacaaagaaatggtaaatgtttgtttgagatgacggatattctaattaccctgatttgatcattacacattttatgcatgtatcaaagcatcacacatactctactctagaaatatttataatcattatgtcaacaaaaaattaatataaaaaaagaaaataaaagctaattccaactgctaagtcattgataaattaaaaatagaaatgagattggggtcttaagtaatttccttacattaacggtcaaaatgaatgccacaccttgtgagacagcatgcaaaactcagtttcagagctggcatattgaattaataacatatcctttttctatcaaaatgctcttaagttgtaaatcatgcttttttgttttttttttttcaggctatttagatcctgcatcagacaggtcatcagaaaacatgaagctaaatgcagtaaagaattactctcttgaactcttgaaaatatcaaaaacatgaagctaaatgcagtaaagaattagtctcttgaactcttgaaaatatcattttcttatagaaatggtttaaaaatttcttttttattatttctaattttccttcagaaaattgtgagttttaacctacaacacatacactccaaggtaatgccactctaatgctgtctagttgatctgaataactaactggtcaattatcagatccaccaaactgtctctctggagattaacttctgccagcatattggtttctgttcattttcacaagattgacaggctcattacagcaatattaacatcttcctttgagcactcacactgtgcaattgtaattttgcatatgttgatgagcaggcaattacatcaaagagtgaacactgggctgatgtgcaaggcactatttaattataaaaacagtataggattgagccctgtcactgagtcttccattccttctatctcgcctgtttctaatttatttctctatttcttcatttcttccttgactgtcttcattctttgctttttatttctttctccttaaatgacagaccttttcttagatgccatttctctatgtctgcgcttaagacaagaatttttttcctcctagttgttggttaatgtctgcaaatgtgagagcatgttaacatgacaaacaacaaggaatttgaaataaacttaaatgaaacagtgtcttttctccccctactctcccccaccccccatggtggaaatgatgatatccttaccatctgcacacttgcaggctgtgagtgggcagaaaaccagctggagatgcagcccatggcagggatacagatcctcagcttctgggaggtcctagaagctcacaatgccacccagctattggactatcatctctcatcatgtatattcaaagggaaaatgtacaacatttcttctaaactattttgtacagagaacatctccactatcatcaaaaagaggctgatgtgtagtagggagaaagtgttctggactaagtgtcaggaaacctcagtgcttcaggttctcttgcaattatgagactggttctgttacttcacctctctggagtttatttttcttatttgtatagtgaaggcctccagctttagcatctcataattttgttgtggaaaataaatacgtgcagaattaagagaataatgaaaagagtttgagggtatctcctctgccttaattgacaaactatgttaagggtagactatcacggtatccttcaaacatatctatgaggcaaggcttgtggcagaaaaggaagcaaaatgatatacttgtcacatcaattagtcaagaaaatgtgattaccctgagcccaagaaacttccactaaaaagatggaaggaaagactacgtctggtgttctctggcaccatccttgagtccacatgtatttagaagtgaataactgaatttagggccatggtacagaggtgtcagtctgcaaactagaagagcaatgctgacaggccctgggactgttcctagtgctgtatgggaactcagaaatctaaccgaagccacaggatgggtaacgacaatgagactgtgacctggcaatatctgcataatcttgcaagaaatttctaaaaccataagacacacggcatttttacttgagtcctaaaatgaacatccggtgatattggaccttcccactcctaaccaaatgacgtcaacacactcttaaggacacatcacacactctgtggaagagggtaggagaggtgtggaatataaaattccttttttgagacggctgcctggattctaatggggttactctaatgtgttttaagaccaaggctcactggccaagatatactttcatgaattcaagaatgtatgatcattatgatgtatacatatacacatatatgcatttacatgacaaaaaaaatgccagaaggcatgtaaaagacagacagtcctcttttcaaagggtgcataatgggagtgattctatctttacgtctaaagtgttctactggacgcatttaatgttcttgtttcctctgtcttaaattattcgttcccttttggacacattattgctccataataatgctaagtagcttcattttgttgttgttgttttttaaatcacccaacctttcctaatgctaagccaggcaatggagggcaggaaaaaaaaatgtctttagagaaggctgtaggcctatcaccagattttgagctgggctttccccagaacacactttaggcctgcaggatgcctgaggccaagggtacttcctgcatccacagggttggggatgctgagtgcaatccctctattctgccacctgggacagccttttgcattactctctggctgccttcccttttctgaaacttgagaggggagaatgttgcttccctttagaacagtaggtgagcccatcagcaactcagccccaaaagtctctgcagtctcatctgacaaattataagattgagcctatcaagtaagtaaataaataaataaataaataaataaataaatgaataaaatgaatcataacaaatatacatatctgtgtatttattacatcttatcataattctcagcctgaatctaaatatacggtctactacaatctttttaattgggctttagctaaatgcatgatgaaaatcattttcagatcttagctcattggaaaaaagtaaagataaaaaataaataaataaaaagatcttagctcactgtcgtactctagtgccttcctaacacgcaagcatacttcccatgtcccattcacttgcaatcagctactggtggaaaattagatggtcccaaatcagaggaaaccgaagacatgataatgaaactcctgaaaaaatcaatgacgattatggaaattagctgtttaccaccttttttttttttgacctttcctttttttgaccctctaggcagcctagtttatggaaggaacatcatcagtgaggtcccagagaaaggaaaatgactgattacagagatagctattatttccagccactatatccaagagcgtatcagatcactcaaagcacattttatcaacactccccctgtgacaatctagtctttactggagttaattaaagcaattaattcccttccctttcaaagcagtgtgattacataaatagataatttcccaatccaaacccataaagcaagtgatttctctgcatgttcctcagtgtgcaaagcacctaactgaaccaaattgtcctttttctaaatttgaccttcatgaaattctccagtaactttttctgctctgtcttcctatctggttggatggcagaaccacatctccacatggacacaggactgcaagattaataaagcatttcccgcagcaaagatagataatgcctaaactgtaatcacaacgacaggagtagagtgaggaggaaaggagaatggcgggtgcctgctctgacaggcactacagttcccttcaacaatataccagcgtgggtgatgctgacaataattaagcaaacagaatgccaaacaattgtaagaaaagctgtcaaacattttgtgttattatcccctgcacaggcctgtaatttatcatcacagaaaaagcacataaagaaaaatctctaaacagtgacattttgttcaaattacaacccttggcttccctgactgcctacagactgacatctccaaggtcggatgtagtgctcagcaatttgttccttcattaagtgagcatgtctctgggatgggttctagccactgtgagtgctggcatgccaagagcaagaacaaagtacttcccaacgtgtgggaagccacttaccttcagacgtcaaaatgaaagaaagtaactgacattcgtatttccttctcagattggtcctaaagcttgaaatatgatctcctgcaccaaggctcctacctgtcatttcttcctccctctccacccaaaaccctgcttggggttctggacttggctaaagtgtaagggctttgatcttgttggtataaactcagtctttactggccgggcactggtggctcacacctgcaatcccagcattttgggaggctgaagacagtggatcacttgaagccaggagtttgagaccagcctggccaacatggtgaaacccccgtctctactaaaaatacaaaaattagccaggtgtggcggcaggcacctgtaaccctagctacatgaaaggatgacgcaggagaatcacttgaaccctggaggcagaggttgcagtgaggcaacattgcgccactgcacaccagcctgggcaacagagtgagactccatctcaaaaaaacaaaaaacaaacaaaaaacaacaaaaaacccaatcttcctgatgatatcccccaatggttgtaattgaaccagaaagaaaataaaaaaaaaaaaaggaaatacttttctcatccagtttctttagagtttagcacagttctatagattaattactataaattgtgagacataaagagacctcagagatgctgagccagtgagacaggtgtgagggtgtgaggtgttactattagtactttggagaaagtccataggcagtctccaacgtagatttctggatggctcagagttgaaatggaccctagaggtaatagaatcaatcttttcaagtaatgagagaaattctgtctgtgatattcctagctgatgttctgagctggaccacttccaaggatggagataatagaagccttccattacaaatacttggctgctgaaagacctaaacatttgagtcttcactgttttcaacagctccttccacacctgtccaacatagagatccacttaacagaagtcctaccctctagatattgccttatttgaaaaggtaatatcttttaatcccatttctttctatcccattgccagagctctttcccattgctttcttcactttcttcacaatcttttttcttttttaatttttaaaaatagggtctcattctgtgcccaggctggagcacagtgatgcaaccaagctcaccacaaccttgagctcttgggctcgaataatcctctggcctcagctaggactacaagcatgtgccaccatgccctgctaaccccatctcaatctttatacccataagagaaccttttcttagaagcctcttttcttagggtttggaggttgatttactattgccaatatagcaaatctttattttccttaggtttattttgattttttaaaacaatagtctttttactcaaactttggcaaagagtttgggctagtataccaagtaaataagctttaattttctcttggccatgtatcttctattagtttctgcataagaccctcagtgcttccatgtttactgctcgctgcacaggcacctctcactagatggcacttaggatatttttcaaccatctttctgaccaaaattgtatgtgttctatgtctcatccctaagaaagttgatagtgaactcaattggctgattacaagtacagtgtgaacaacttatacctgaacactttaaatatattgcaacctaacaaacacatttacatatcaacaatgactcatttccttagtccaagaaagtgaacacaggcttgattctctctcccaacaccctcccctccttttttctctctctttcattccttataatagacaaatgtgaattatcttcacaacctgttcatttaactctgtcaagctattcctcaaggacaaaccacaaaagggaaccagggaagggctgttcagagctcactgaaaatccagatcagctacagaggtccttagcccatagaagataggtctgtggtctcaacttggaatataaataacagcttctttaccaacctcaccaaatcgacttttaatacctttttttcccataggcttccaacctactctgattgacttaggctgatcagaaacaaaactttaacagtaacgtctaaaataagtgaactttgttttataagtcttccttcttgccaaagctgatgactaaataagttcaaagacatttaaattaatgtcagttatacccacagtcactggaggagaggtaataggaattcaagcttccagtaaagaaaaagaggaaatgagaaagaaaaagaggtgtctttcaactctagttgtgatatagtctgctgaattattgacctttcctttcaaagataagaaaatgtgtatgtggttttttttttttttaatttagacttcctacgtgtaactaaaatctctaaaacaaggtggcttattttacatatctgaagaaagtgaggcatgcaattttcccttcctcatagtccgacctaagagtgtgtggcaaactttgtagaattctaagtttccttcaagaacttttcatcttatttccatccacaaattaaaagggatggaattactcaatgtagccatagctaggaatacagtttagtgaagaacaggaagggagagagacagaaggactcctacagtttttctttacaatctaaatatgttaaatgcatgatggaagcaatggagccaggtcaaaatggcacttgctgtgttgtgaaaaatcctgactatgagaatcttctgtagtagaaaggcaggtcattctatcacaccaactggaaggccagtctggggcgtgcttgctggatgtgtggagatcaattacccacaagtccctgtggagtctcttccataagaaactggggaagcccaggccatcagtattctgcacacacactaacagcttgtgcttgcagaggcaatcatttttcagctcttttcagattctctttcttggttatttttccatcttggctaaaagggtttctcttttgtaccaagcaggggcaccaatctaacagaatttattagaaactgctcgattgggattttgctggagttctactgaggttgaaaatctcaaacaatatgtgatgaaaattttaggctgttttgggtgacttcaatcccaaggtctttcttggctgatttgagttccttctttcagagatttaggcaatgttagtttcagatgggaggtctggtagatcctaaaaatgaggtagctctatgtcagccattcagtggagaaagagcccatgctactctgtatgacaaaatactatgcctttatttgcatacaggtgtgaatgaattatttaaagagaaaaatgtgcgagtgggtactgcgtaagtgccacagtcgttgcactgtgcttttcagtaagtgtgaacattttccttcgcatgtctttttaagagaaagagaaaatgatgatgggaaggattttgggtaagacaagattacttttctactattcttatcaaaatttactattttgtcttcctttgtgtagtacctgtgtaatatttgctccacaattgtaagctccttgaagacatgaaatgtgtcttttcactttttttttttttttgagacagaatctcactctgtggccaggccggagtgcagtggtgtgatcttggctcactgcagccactgcctcctgggttcaagcaattctcctgtctcagcctccttagtagctgggactacaggcacgcgccatcacgcccagctaatttttgtgtttttagtagagacggggtttcaccatgttggccaggatggtctcgatctcctgaccttgtgatccgcccacctcagcctcccaaagtgctgggattacaggcatgagccaccgcacccggccctctcttcactattatattgccaatatttatgatagcttttggtttactgcaagaaacaatgagtaagtagtttgtctctttaaaccaatgctttccattcttctccaggtgagaggttggtatagatttttatgaggctttatcataactaaacccagtggtggactgaataagatcagctggtaaatatagtctttgatccactggaaaatccagcaatatctaacttaaacaacaaatgagcgaaattctaacatttctagtatatttgatctattggtttgtaaaccatcttgaagccatgatatagaaacactaactctgtatttttataaaaataaaacataagggtatgcatttattcattcaagaaacatttcttgagtccctaattgcactaggaactgttcttgattcatgatagaatgtgacagacaggttgttcatggagattttgctcgagtaatgcatatatggttggaactggtgggcacggagtccaaaatagcaattctaggccagcttgccctaaacaaatgatacagatattatatgagagagttgctaaaatttggatcatatttagctctcctcccacctctttcaaacacttactaagtttagggagaaatgtgggaacataggatgaagtggccacagaggtacccaagaatcagtacagtaacaatgtccttagcaaatggccctcccgtaattcctaagaaggtaaaatattttagcattgaaataacttcatgacatggctatgccaactctaaaatggtttcatcatgtaaacagtccttcagcgaatgacttacattttgaaaaacctacagagcagagtgaaaagcatgggctgagcagtcagctgatgaggatgactgaagccatgctccaccatttgctggttgattcaagaggaagtcacttaacctttccaagcctcagcttcacctgcagaatggcaataataatggccaacttgtagagttgttgtgaatacaaaaataatgcagtgcatttttagcatgatacataacatataatagcaacacagtgctagctgtaattcaattggaaaaaactactttaaagttcatatggaaccaaaaaagagcccacattgccaagtcaaccccaagccaaaagaacaaagctggaggcatcacgctacatgacttcaaactatgctacaaggctacagcaaccaaaacagcatggtactggtaccaaaacagagatatagaccaatggaacagaacagagccctcagaaataatgccacagatctacaaccatctgatctttgacaaacctgacaaaaacaagaaaaggggaaaggactccctgtttcataaatggtgctagccatttatggaaaactggctagccatatgtagaaagctgaaactggatcccttcctgacaccttatacaaaaattaattcaagatggattaaagacctaaaaccataaaaaccctaggagaaaacctaggcaataccattcaggacataggcatgggcaaggacttcatgtctaaaacacaaaaagcaatgataacaaaagccaaaattgacaaatgggatctaattaaactaaagagcttgtgcacagcaaaagaaactaccatcagagtgaacaggcaacctacagaatggcagaaaattttcacaacctactcatctgacaaagggctaatatccagaatctacaatgaactcaaacaaatttacaagaaaaaaacaaacaaccccatcaaaaagtaggtgaaggacatcaacagacacttcttgcaagaagacatttatgcagccagaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccgttactgggtatatacccaaaggattataaatcatgctgctataaagacacatgcacacgtatgtttattgcggcactattcacaatagcaaagacttggaaccaacccaaatgtccaacaatgatagactggattaagaagatgtggcacatatacaccatggaatactatgcagccataaaaaatgatgagttcatgtcctttgtagggacacggatgaagctggaaaccatcattctcagcaaactatcacaaggacaaaaaaccaaacaccgcgtgttctcactcataggtgggaattgaacaatgagaacacacggacacaggaaggggaacatcacactctgaggactgttgtggggtggggtgagggagagggatagcattaggagatatacctaatgttaaatgacgagttaatgggtgcagcacaccaacatggcacatgtatacatatgtaacaaacctgcacgttgtgcacatgtaccctaaaacttaaagtataaaaaaaaaatagagcacacatgtcattaatgaccattaattatagcaacacccagaggacagcagtactgtatcattttgcaggtaagaaaactgaggcttagagggtgtttatgagcacaggggaagatacacttcacctttctcttgaagttattatgttgccatgacttgctttggctaatgaaatgtaaatgacagaggaatgtgttgcttcttggtgaaaatcttcaagtcatcttctcttcactgtgccacaatgaattatgtttcagaaggcggattgtccaggatcctgtatcctgaattaaggacaatgtagagtagacgatgggcatgcagcatgagtaagaaatagatctttattattttaggtcactgcaatgtttacagttgtccattacagcaggataacatagcttattctaactttccaaagatgagaaactattaagatctagcattcaaactcaggtcttatggtattaaggccaatgcttttgtactaccttacagtacactgcttattagaaataaaacaccctgtgaatgtaccttccacttcgaagaaaatggacttttctgttgctctttgacttaaaaaaaattaaaaattctctgagcaaaggtcaatggaaaggtagcgaaaaagttggtagaggtgggcagataataaaactgatgagaaagatccattagtttagcagaaccctttatttcccataggttcatgacctgaagattacataggatggagggaggcccttatcataagcctgcaattctgtggctaacaaaatcaatttttaaatgatttatgtgatgtttttcaggaccaaaagagcagtaattcatttcccatgtggtacttggagctgctgcttagatgttgaaaaatgattaatctttatttacagcatggctcccttcatatattactggaaacaagatttgagagtgcaacacttctatagcatgcaattatttgctgaaggaagttccaggcataaagaaaaaaaaaatctactagcagccaaggatatctggacatgcactgaagtaaccactgtgaaaaccttccaaggccaaatgcttccaatctattcagtttgacccacttaacataaaaaagccacattaatttcccaaggggagccactcttctatcaaatcatactaactcctaacttcaacaatgggagaatgaagaattcagaattcttaggtttttgttcccccagaagactgagtttaaaaattttctagaaattggtgcacatagcttacttcaacttaagttgaaatatgtgtgcatttttaaaaattgctataaggatgccttttctgggccaccatatgtagacattcctttcttttaaaactacagaagtaccatattctcaggtctcctattctccatcttgccagcctgagcctaacaggtccaatcacatctaaggaacagtttcacctagggtaaagttcacatttttatgactagctatatcactctgaagcccctagtttagggcccacaataatttgataaggacaggtaaatttccatgtcccttgcatcttgtgatcattaaggttggggtaaagaccttggatatcaaggagatagagtagagactattcttagaccattggaatgagctctgcccattgcttctggacactagaatgttagagggctgtggagaatgatgcgtaatgatgcctgctgttttctctcctatcattttctaggacagattttcccaaggaaacagttaagagagccagactagtcagttacgcactccatactggagaccactcatatgcacattgtgtacctcatccttctccatggatcattgctcactttctctttattgggctaatggtattggttaaactgtaggctgatgactatggaccactattttctgtatcattaaacatggccatatcccttcaagtgggttgtgaataaaattggcactctgcttccaccccaagttggattatttaacaggcatgactggcttattaggaaatagcttgaactggtatgactgaggatgaaacatcttgtcaatacaggttatttgttaggtcccatagaactggatgtacaggtaaatgagggggtgagggctttccctcctgtttgtagtttgtatgtggggttcatcagcaaacttatgaagcccagtttattaagtttcttgggcaaaagagtaggcaaagctgttctaaatagagtaggaataaaagagggctggtaccacaataatggtgaggcaatttcattaactagagtataaacaagaaaacaaagtaacaaggagtttgttgatgtattagcaggatcctggatctttacttgcctgagttatctggatgagtcttttgtctctgggtaacttcagtcataacccttatcatttataagtaacacagggacctgtgctgggaaaatatggaccaatatcctagaaagttagtaacatatacttagtgagtaagcttgtaacacatacgagtgaccaatgttttcattaatattttcctgtcatgccaccattctgtgtactatgcttttcttcttgagtcctgtagttgcctctaagaatgacagtcctgggaaagatgctaattactcaacagagtatttaattgcttgtttgcctcaactcagttgtaagctttgtgaaagcaggaaatatgtgtattgactgtctatcccagcaataattgccatgcctggtatgcagtaactatttgtggaatgaatgaatgaatgggaaaaaattatagattctgtcatttattaatcccctactacagagtatgacaggttgagtgttgtgctacgtgtttcactaaccgtatttttgaatcctcataattctacaaggtagatattattttcctgatattataggagaataaagagcttcagtgagtttcaggtgtgcatcgagcacacaaggaactgttttgcagagagtcccttctctgtgacagtcagggcccctcccacatatttccttgagtagctccctcactgggtatgcaggatgacatgagggagatttgctgacagccacccttttctgttgagcacttatctctcggacagtgggatgagaagaagaaggaaaacacaattgttgaattacgatgggcattttacacattttatcacatttaatcctgaaaagaaatctctcatgctgacacaattcttttaataaaatgagtaatcaaaagttaggagatataaagtgactttctccacagtgaagagccagaattccaattccactccattgtgtgtgtgtttgtgtgtttctttcccctccagtgtcctttgagtgtagtaccattaaaaacttagaatgcttgataatggcagggaccaggtgattcctggtccctacaccatactcactaaagtgaaattcctgaaaatggctctaggaatctccattttcaacaattcactaagtgggtctaatgcaaagtaaagtttgagaaacattgaactaggtagagttgcctctaacatttttcatgcacttggataatactaggagccagaaggtctacaaatggaagaaatcaccctgtaccaagcactggtggtgcatttgcagctcaggatatggggaatgccttggtaccccccattaatgttaataggaatcatgtggataattctctatattccacgctgaaaagtgttccctttaggaccaggagaggctatatttaatcaaaccatctgaaatcctatgtacgtgtataagggcagaaaataggtcacagttggtaggctactttctgggaattattccattgtatcagcaaactccaaagtcctcaaagggctcctgctctcctggctctcagtgagtgacagcccaagaactaagagaggtcagagaaagtccaacacttaaggaaaaaaagttccaatcacaataaaacacataaaacaaattatccccaaaggacaaagtgtggaataaacttgttaaaagctattaacctctcaaaataacacatttctactccagagtaacctcagttgcagcttggagagcagcatgaaattaaggaacacaattcagagaacataaggactccaaatatgaactcatgatgtccaagggttttacaggcactcatgctcctatgaaaaccacgaagatgatgggtctatgagacctgagagagtcagataatctggtgttaaaaagtagtgagtgttcataaggcttccagaactcaactctattatagactaagaactttacttcgtcaatcaatccaggtttttgtctttattatagaaattataggactgttagcttattttaactttataataacatagcttattctaactttccaaagatgaacaactattaagatctagcattcaaactcaggtcttatggtattaaggccaatgcttttgtactatcttacagtacactgcttattagaaataaaacaccgtgtgaatgtaccttccacttcgaagaaaatggatttttctgttgctctttgacttagaaaaaaattaaaaattctctgagcaaaggtcaatggaaaggtagcgaaaaagttagtagaggtgggcagacaataaaactgatcagaaagatccattagtttagcagaaccctttatttcccataggttcatgacctgaagattacataggatggaacattacatgatgaatcttaaagcaagaagaggatatatttgggttaatctggatttgaaccttggtcacgtcttggaggaggaagccactgattgtaagggagcatgaagtgaccacacagaggtggtcactgtgctcagcagcatttcaccttgttactccccaccgctgtgttgcctttctcatggatcactgtgactgttgctgttttttttttctattttattattattatactttaagttttagggtacacgtgcacaatgtgcaggttagttacatatgtatatagcacaaagtaagcagagatatagaaaggtggagaactaaagtcttcaagggcatatggcatgcagggtgaatggcatattttacactatttgctttttggtatgtctgagatcctgatagctccttaattaagataatcaaaatccctagtctagagtgggcaactgtacaaaattcttacaataaatggtcagtaggtcttcaagctagctctcatgtaagctatgctatccctgaggcataaggaagggcataaagccccagaatgactaccactgtgtctatgagacaattcaaaagtccagttttttatgccaggatactttcaatttctccatcataggatcagggaccttccagccctagcttcagatccacagtggtgccagaagcactaccaaggaggatggtgtaggaaggtatattccttttctaatgctgctgtaacaaattttcacaattggtgcaaaacaatgcaaatttatcatcttctagtttgtatgtcagaagtctgacacaggtcttactaggctaacattgaggtgccagcagggctgtgttccttttcggacaatctagaggagaatctgtttccttgccttttccaccttctacagatcacctgcattccctggcctttggccctttcctctatcttcacagtcagcaacattgcatctctctgactgtccttccatagttgcatttccctctgactctacccaggaaaagcattctgcttttaaggacccatgtgattagattggaaccactgaaaaatccagaacaatctcctcatctcaaggacttaatcacaccttaaaagtccccttcgccaagtcaggtgacagatacacaggttctgggaattagaacatggacatcttgggtgggagcattacattattccacttaccacaggtggtaagaggtggtgaggagggaggtttccagagactgaaaagatctaagataagaagctggcagcaggagggagtgaggcttcaggctagagctgtctttccaggacccttgagggagttccggctggttttcctaacgccctctttcattttatcaccttcactgccaccatcgtcatcctggcctatgccctctctcctgaggtataccctaatcttcctcactggtccactgtggtctcatgtactaaactgcttctcctcaggctattttccacacagtagccagagttatccttaaaaacacaatcacagtatgccactcccgtattcaaaactctctaatggctttctgtcacttagaacaagacccccaagcccccctcatatggctgacagagcgtgacatgatctggctcactactcctctctcacgtcccctcccactcctctcccacctcccctcccactcctctcccaggtgttatcaggctccagccacatggcccccttgctgtttctcaaactctccaaaccagcttgtgtctcggctcctgtttctccctctgcatggaagggttgaccccggatctttgcatggttaatttcttcccttcttttcaggcccagatgaaataccacctcctcagagaatttctctgaccacgctcactaaaataccaaccctttctttcactctctaccccctcactgaacctatttttcacagtccttaccacgacctgacattacattatacattgatttgtttgcctattttccacgttgattatttgtctctgccactagaatgcagaagaaaaagtttctttagggcaaggaactccctgggagccaagaacagtgacttgcacattggaggtattcaaataactgttgaatgaataaattcaatgtatatttgatgagcccttttaagtgaaagacaccgtgatataaacagtgaaaagacagacatggtctacccttctttccccagtgtcccacggattgactcattttctttccggagtcaacttttactgatgaccaaagtttatttttattattttatttatttatttttttttagagtcagggtctcactctgttgcccgggctggaatgcagtggaaccgtcatagctcactgcagcctcgatgtcttgggctcaagcaatcctcccaccttagcctgctgagtagctgggactacaggcatgtaccaccatgcctggctatttttttggtattatttatagagatggggtctcactgtattgccctggctggcccggaacgcctggtcgcaaatgctcctcccacctcagcctcccaaagtgctgagattacaacatgagccactgcacctggccaaaacttattttttaattcccaattccatctcatgtctctcctttgttcttattcatttattcattaatccattcaacacatgcttattgagaacttaagctaggtccataatagatcgcagtccctaaaacaagaacatgatcagtttgggagggttcttttcctgatggccattatgtgaagggagataaggagggagaaaggttctacccacactcccactactctctccctcctaccctacagacctcctcttttttccatctgaattcatttgcagacaaggatgaaagccccttagagtaataacagaagctccttaggtaaacaaaatatttcagtaatctaggagtccatagggggctaacactgcagagcctgtgctctgaggactgggtcaggtccctgcacctgtgcagagcctgccttatctgttgagaagctcgcatgagctcaccactaaccaagtcacaacaagcacacagttcgagttcccaggcaggctgagctggcagtgcatcaggcaatgcccttttaacatttttcacttcttgttcaccgctgttcttgcaattctatgttttacttaaagaagatatgctaaataaatggttctaaattagcctgagctaatttcagccttgagctcactctgctgccacagactctggcaagtacgatttggagcactgacacatggcctgtgtacatgacaagatgtcttatgcaaagttagtttgggctatatgtagggacatgcacacactccaaatattcttttgttttgtttttgagatggagtctcactctgtcacccaggctggagtgcattggcaggatctaggctcactgcaacctccacctcccaggttcaagtgattctcctgcctcagcctcctgagtagctgggattacaggcgcgcgccaccaagtccggctaatttttggatttttagtagagacggggtttcaccatgttggtcaggctggtctcgaactcctgacctcatgatccgcctgtcttggcctcccaaagtgctgggattacaggcatgaaccaccatgcctggccctccaaatactcttttttttttttgtatttttagtagagacggggtttcttcatgttggtcaggctggtctccaactcctgaccttaggtgatccacccgcctcggcttcccaaagcgctgggattacaggcactagccaccatgcccagccccaaatactcttaataaactttaataaactaagaagtctaagatgaagcttcctacgaatggatgagtcaagaaaaagctacacaaagttcacatatcctagtgctgctcattaatttgggagaaaaaagcttgatgtgaggagcttgatttgaaggacaaccagtatggaaagccccaaggtactttataggatgtccaagattagatgctatttattaggtataatagggcttttttaaaacaaactcatacctctccacgttttaaaagtgtggcccattaatcagcaattaactaaaataaggttgttaaatgacactacagtaattctaggtcagtctgattttatcctctttctggcttaatgcctcagatagagtgaaactcccgataaggcactcactaaggggcacttgcacaataaagaggagaagcaggaacgaggaaaacatagttaatatgccaagtcctttttttttttttttttccattttagttgagatgtgctgtcagcctctctcttgaccagggagaggtgcttctacttcaccagggggctctgtcccccaaggctgcggcatgtcggtgtttatgcaagggactgtgcccctctctccacagccccagctgcagcctgtctgtcgccttataaaaaaggcatcgagcactgcttttagatcatttcatcatatttgctcatttccttggctgaagagtctggagtcagagggccctcagaagatgtggaacagcccttgtggatggaatagactgggcactgttgctttctagctgtttgttctccatgatcacatttgcatactagatttctaccaaggaaacctgggtacagcatcttatcatatttgtagccccacataaatgtattgagtaatccgaacttgcttattttgtaaataaacacataatttctgggattaaaaataatctaataacagcaaaactaggctgtccagccccacactgaagggcaatggaagttgtgctctaaaattttccagcagtatcagatgaaaagccatggaatggggctgtctctggaaaatgagcatgccagagaaaccgtttaacgcttgtgtgtaggatggggatctgcctgtgtacacttatgcaactcttttgatcatttgctctaaatgctcattaacagacattttgcaaaagatcagatgatgatacaagcatatcaacaggcttccgtttttactgtagggaacccagaaatgaggattgttgttattttctttagaaaattcatttaactgctgatagtaaatcaaaattctacattgccacttctgtaaatataagtgacaagaagttatatatctcccctagagaaagaacagtaaacatttctaaaatttccaagtgctcctacatataatctggttgttacaagtggaggcggcttgtcagaaggtctctctctgtaaatggataaggattgaagctgtgtcgtgtatcactcatgttgtttatcctttatattaaatggaagctatatatagatacaaaattataatggcacagactgcccatttcctaccagcagtaggttgactaggaaaatataagtaatttactgcaaaagtgcatcaaagttgaagcatttttagctaaaatgcaaagctaatcaaattagtattaaaacaattgacaaatggttaaattttcctattcaatttgaagtgaatagaattgtatgctcacattttataattgagttgaagctgttgtattgcagtttttattattatggaacaagcaacagaagtatagacagatgactgagtaatctgtatatacctttgcaggtaagtaactaattatgaccatgaggcacctacaggacagagaggccataagactcaaatttttgttattatctgaccaaaggagagaacttatgttcttaacttatccttaacttatgttaaggatccaaagagttagctgttaactacaagtgtcacttgaaccttaaatgagtatattacttttttcaaacaaactgctctacctatgaagaacaactctgaggtttatctccaaaagcaaagagcaacatattgtgtggtccttagggtagagcctgcgctcatcacattagcaggttgtccgggaggaacgctgggttgaaagctgaaagggctgggtctgatgatgtttttttctttacgtgggttttacatgagcttgagtaacccacaggcctctctgtagtctgagtttccctggctttaaaatgaaggtcatttaaaaatgatcctcgtcctgtctacctggcagagctgttgtgaacatcacatgggataattatgtgaaaggtgctttgtaaactgaaaaatactataatgaggcagggcacaaggcagcactgactcttgaggctgaatgctctgctggaggtcaggctggatggatgttgttggtgaagtggggcatggtggtttcctattccaggcttgagggctgactctcctgcaagtgggacccccgtacccacagacttcacttagtctccttgaaggattcatttgccacagctcctgagtactccatcagtagagttgactaaacaccaaagatgtttatattctaactttcaaaaagtggtatgcagctacttgtaaaaatgaaacatgtgaaatctacttgtctatctaaattttgccagtttgattggcatatttggcaagcttttgagaagactgggaaattgggcaatcatttgggaaaactggaatttgagatctaatgatcagctgctttgccttcttctttcccctgttacaaagccagggcaagaagacaagacagaggaccttctgatgtgctgcctgatctccactggcttcttttggtgaccacatgttccttaactgagtgtctttataagggaggtattgttgaagtatgtggtgacggactgagaaaacaagcagtgagattgttagcattcatatctcacaggcttaatgagaacaacaagcaagccccaaagggtgttaaatagatttggtatattttcctcatttcagagaatgtctattcctaatgcattattctctagccaacagaagaaaagtgcccagcttattccttcttcatggaaactacaggtttaaaggacagagactctcatctatcaaagcaactgagtgacttctacttaaatcaaggccagcaaagtagatgatagaaatattaagggaggttgcagtcaagggcagtactcttctttccttgacttatttggtgtgtttatggtttcaggaaactatcacctctttaatctttcaaaatacatttttaaagaggccattctttttattggacatttttattttaggttgcaagaattctttatttctctgcttttaaaaatctatacttgacattatccatggccaaaatgatttacatttgttgtggacgctgacaaggcccaacttacattctatgagaattttgtggaaaaaacttcaccttttgtgatggttcaacttagaaaggcttgagtcgaatgaccaaggttagaaagtctaaacagaaggacaatgagattctatgtatcagcctaaagatattcatctgaaaaatatgccatatgtaaattaaaaacaatgatggaatcctgctgcatgaatatcacagttcaaggtgcaagaatagaggaagagaaagttactataataaaaaccataatatatggtttatacttataataacacatatttacatggtatggttataacacttgctttgtcagtttgtcactctgacaagttacttgccctctctatgcctgttttttttttatttttaaaacagagatagtgctgggcacggtagctcacgcctataatcccagcactttgggaggccaaggcgggcgatcacttgaggccaggagtttgagaccagcctggccaacctggtgaaaaaccgtctccactaaaaacacaaaaattagccaggcgtggtggtgggtgcctgtaatcccagctattcaggaggctgaggcaggagaatcacttgaacctcggaggcagaggttgcagtgagctgagatacgaccactgccctccagcctgggcaacagagtgagactctgtctcaagaaaaaaaaccaaaacagataataataaaataatagcaaaagtagctaccttataaggttttcataaaaattaggtggaataatcactgcaaagaccttagcccagcatctgaaatgtcataaacagtcaacaaataatggctgtaataaaatcaataatacttatcatttgactacataaataaaccaaaaactaggaacaaaagcaatatacgtacatataaacatatgtataaatatatatatatgtgtgtatatatatatatatatatatatatatatatatatatttgtaacatatggttgcttactatgtgcagggcactgtcctaaggatataaaagctttacatctaaaatgtatttaattttaacaccaacatcataacataaatatgttgttatccccattttacatacagagaaaccaaggcaaagtaacttatgtaagtctacatgatagaactaggatttgaccaggttatctgtaggtatctcagtatttcctgaagtgactgaataatttttttgtttttataaccttgtttatcacatcactggtttttacacttttaatatacaatggttatttttgtagacattaactctataatttatttacctgtatctctaaaaaagggcatcacaggctgggtgcaggggctcacacctgtaatcccagcactttgggaggccgaggcgtgtggatcatgaggtcaagagatagagaccatcctggccaacatggtggaaccccatctctactaaaaatacaaaaattagctgggcatggtggtgcgcacctgtaatcccagctacttgggaggctgaggaggaagaattgcttgaacctgggaagcggaggtggcagtgagccaagatcgcgccactgcactccagcctggcgacagagcgagactctgtctcaaacaaaacaaaacaaaacaaaacaaaacaaaacaaaaagaaagaaaagccatcacaaaatgataaggggagagtagagtaactttgcatattattcattcacatgtgcaaataaaaggatctaatgccaaatgtgggcaaagcgacatacctcagtgtgagagagtaagtgctggaggctaagggcattgtggtctctccttcattttctcttatgaggcacactgatggggtacgtggacttaggacaagatggcacttcatctcgcttttctttctgcataccttgctcttagtcttctactaatgccacaatgaaaaaaacagaaacccccacttgacatctaaactctttaaaaacatgtaaaatttaaatcagtattatttattaaaaggttttttttaaattattatttggtaatgatttaccctaaaattttttgacttctcttcaaagcccagatgcttaaatattgcttactttgggtcttaatggttattccagagccatggaattttaaatttgatctcagatttttaagatgtgacagcttgattattttacaaggccaaaaccctgattcaagcctgcaattttaagaatcaaaactgttttcccattgatgaagacattttgaaatgtgtggtccatagctatttatgagtagtttacagctgttgtctctttgtgcccaagaccatggagaatccaggagccgatctgatcctcctgggactgctattaatatcactttcactttagacagctttgccttcaactagcaattttctggctcccttatactacattgtagcctcacagcattcaagcaggcacagggcacttggacaatttagcaataatctataatacagatttttgaaagaagcgatttgttcaaatgctgctaaaacagaaagtggctcttgaataccaaagtgggtgccagaaactgagaaaaaattccttaaactaggatctttagtataaggagaagtgattagaataatatcaatttggggcactgtgacatctgaaacataatggaacaattcctaattgttattgaggaagaaagcaagacctattaaggcaaaccaaccaactttcattgcacagggacataatttcggagatgctatatttgattccatgtttgatagggtctggcatatctcttcccaagtgtgctctggaaatcctatttcagtccttcttttaggggaagaagtcattacatcagccttgtaaagtacactggcatgcaaagtaaaatctgttactagggtgaaaagttggtacattctgtttttttgaggggaggtgagctctcacgtgcccccaacatgcacagttcactaaaaatctgtagctcaccaatctcctattgtatgcatttgttatttagtcttcagctctcctacattttctttgtttctttatctattaaacttttaaaaattgttccctgcctcttttccattctgattttaaaaattctgattaatatacaattgcatctgtattggcagaccatgtagatacagcatttgtaaattgcaagctatggagtacactgaataccatattaaggagttagtgaaaatgaaaagaactttaaaccctagccttttagatagatttctgcttttaaagattatctctggattgcaaaaacagacatgaatattgatagtgtaaacctgactaaaatatgactctaaaatatgaatgtctgccattataaaagaatctaatgataaaacctgaggaaataaacactaaaaaaaaaaaaaaaaaaaaaaggttgttttctcttccttaaaagtcctgaaatttaattttaccattctgtcacaggataaaacatctgtcctaatggaaaagtaacaaaaacccattttctgaaaagccccacagataatttttcacatgagtacatggaaatatctattccatttttggataactattctttcttgatgtaaaacactggtggtcaaaatatacaaatatcacatttgccttcaatcataaaactctgataagcacacaaattgcaataccatcatgctaaattaactaattcatttattaatcattttctttgaaagcagagtgacattcaggcactgggaatgctgaaataaaagattgaatccctgccttctggggtcttacacttcagcaaagaggtcacacatcaataattaatatatgatgtcacagatataaatacagaaatgaagtaaaaagagacaatgaatccagaccaaaagtttcaagaaaggctcctaagaagaggtgacatctgaatggagtctttgaagaccctgtaacaatagccaggcaaaggtgctctaggcaggaagaatgttttgtgcaaaagcagaggtgggtaaaacatgacttcagttctctcaaatagaattaatcaatctctttatacagtaactcagcacgttgtctgtacttctgttagcatgaatagaatgaatttttattgcttatctttcctggtggactgtagcctactagaagcaggctgatacatctttgtacctcccatttgtcttgcacttataacttgcctgcttagttttgatggaatgagccaatgaatgacagtaagatttcacaagagtcacctgtgaaacatacttcaccaaagcacccatggtagcacttattaacaaacggagtttaccagggatggggcagaagaaagtcttagcttttcaaagaatttcattcctgagacatttttgtggtcatgtatttaaaaaaaaagggttgggggggtgctctgagaaatgtgctctcagatggcacagctggaatgagagaaatgggaactgttttccattttacatagtttctggaaagggcaataagaacaaaaaaagcaacactgttggtcagcattctcagtgcctgagttgaaaggtgctataaacagagaaaagtctcataggccaactctatgcaggctatgtgccaagaatagctacaaagtggcaagttaaatcagccagggcttgtgagctgtctcaggacttgagtcccaacttgcactcgtgaaagttatgctgcaaagggagctacctttccccagcactgcctggggccttggcaagtctaatggagaatgagtttgatttcaagccctgctcccttcaggcaacttacaaagaaaagctgttaagtctgtggagctgggaatgtctggaaagagtgaagacccatcatttaaaactgatttctttttaaggaagtagagcagagagcagtgattacttcaacacccattctcaggggaatttctgtaagccggaatcagctaatgatggttaataaaggtaaatgttccctgattctcaggaagtgattcttcatcctggggctttttgaagactctgtcttcacttgaattttgggtggaataaagccctcctggatttatcctaatctaatactcaaagttggtagttcacaggagtctgtttattcttctagaaaagtataacagtggattagctactggcttctatcccttcagcacagctcccccacacaagagcgtacctttaatgactgatgctggtgtatcaaattgtgtcctctccttctaataacaaaataatgaaatacagtaaaatgccactttttctgactttttttttcttctaggacatgtatgtttcttacctcattcagaggcatgctgggaaatttaactaaatctgaaagaaaaacattctgtaaatccttaagactggattagtaataaggagtaatttctgatctggaataaaatccagaattcagcttgctcaccccagacacaaaacacaataaaaagaatggttgttacagttactaaacgaaggatcttttcacactcagcaagggtaaagactgtctcttctgtatctctgtattacccaagacattgagcatccatcttactgatacaaaggatgtctagtttgaaagtttgcctatgtacatttgtttacgcactcaggcatatacagactgccaactttattattacccaagattaaaaataaaaaatagaccttgctctcaagagatttcctttccgttaactgcaatgctaagtgagatgcatcagtttcatttttgcacgctcctttgctccgtttagtaccgaaataaaaacatgacgtagcttttggggccggggaggaatctcattcttgcaggaaataattgccaggaattttaaagagtgtcatcattttctctgtgtccagtcctgcccagtaacagagaacagctattaaaagtatccaaatgctggctgcaaggagaagttgaactctgaaccactataaacccaatcagatgcagacattcttcccatcccataccccggactcccagtgaatcttgaagaccctggggttagccttatcatttattcgtctgtatagtgatggcctgtgctaatgcccaaatgatcctgacttattaaaggttcttcctgaaaagacatgatttttattagttcaccacaacttattctcaaaaaagcatttattctttatcaagccacaaattttacttaattaactattctactagattccaagacgatttagaagctattgaggttgtaacaggataagagaacaactagtccactctgttaaaataaaataaaatccaaaaacattaaatgttttcctttttgttctctaatgagaggtagaggatgtgaaagtgaagatacagtaaggctagtgtttccaatgatttcatgacttctcttccagctatgctggtgtcatagtaagagcctgatgctattattatctctgattatttgataaacctgaaaaacaagttcaacaaatggtaaaacatctggatctttgacagacaatggcttataaaagagaataacgaacagttatttggagagtattaagacccagatggttcatcagggatcactttaaaggtgtttgttagatcctccctctcaaagacacctacacaagagtcatcagctgccaatagcactgagaagattttcacatacccagcactgtttttgtgacaaccctttccaaaattacgaaagaaaacaaaaacaaaggcaaagcacaaagaggaaaaatgaacattgcttaattttttcttgcacccagtgcttgaaacgcatcaaagtcagagctccatgctctttatctcagctcactgcagctgtcctttctgccaaaagcaaaacaactcattctctagaagaatctgaatgcccactatatccttgacagcgttcctaacaatagacgccgaagatagaacacggttagactttcattgacaagaaaggctggagaatagagaattgtgatcaggcagaagaaaaataaaaactggaacagtcagtggtctggcatatctactaccccccaccttttatttttctgaaaagcaaagctgtattttggcagagtccagaaaaactaggcttgtaattgttaatgtagttctagtggtttaggagaagcagtgggcttggccgtattatggaatgactctgcaaatatagctcagaccctaaggaggttaatttaaaaaacctatttcttatctgtataaagtcttgcacacgaattacattgtttccattttctccaaaagtgtgctttctctctctctagatatctgtatctatagatatagctatctataccaatatatctctataagttgtttatatctatatgccaatatctataacatatttctctctatatataaatatatagagacatctctgatctcgctatatatttagagaaatgttatagatattgacatatatatagatctctctatataaatatatatagatatatacatatatttatgtatgatatatgatatatacatacacatatatttatatagagagatctatatatctatatatctatatataaatgtatatctatagatatatatctatagatatgtatgtatacatacatatctagccaacaatatatatagacaacaatatctataacatctctatttatatatatgttgttatatatattgttatatatctatatatagatattttgttattacattatatatataaattaaattgaaagcttttggggaaaaacatatataaatataaatataaatatatatatacacacacacaatttctcattttttgttgcttggtcttattctaaattcctaagtgtagtctgccactctaatctcttttcccatgaagtttgtcttagaaatgtcatccgtgcaaacaacggctcaccaaggacaagtgctggtttatgcaattgagcagtagaggatgctgtatccacttcttcaagaggtaaaaggagctgatttctgcactcccagggatgagcaagcttcatattcatctgatggttatctgagcaggcactctcatgcattttgatactctagttttataaccagagaatgtcagagtcaataacatgattataagccttataagtcatagaatacagcctctcacacaatcatctttgaaaaatggtcagctggactccaggaacagagagatggcagcattgcttccttcaagagacatttattaagcttctggtagcaactctgtgaattgggtattattgtcctcattttacagatgaggaaatagaaacctgagaagatcgcagttagagacagacaaagtgggatttttaacctagggctgattccaaagcctttattttttgatcactacaatatacatctgacagacgttctctttaaccctttcaagactataagataagggttctttgtaaggacagacccatgctttcagtagtaaacactgtgtaaaagacaagagcatcataaactatggggctgatttaggcagccaatttctagtgttttctttttttgttgtttgtctggttctttcacattctctctctctttctcccatagtatagcaacaattggtctaaatattaagctttatctatgtcaccccacaaatgctgagtgtgattcatccaagtctataacaatggtagagtggcccattaccacagacagacaagaagaagatagcagtgtttacacatgagataatttggcttttctgctaagccttgtgtgccaagttaattactctcttggtgaaacaaggtattttgctcatataaggtagggaaacttgcagtgcttttggttttgttcatttctcttcactagtcattcataatgtggtttttaacaacaaaataattagttaactgagatagaaatgaaaatcacactggtccctgtgcataaaaaatatatattatagatagaactttgtgcttgccatttctttctttcatgttgtttaataacagagtattttgcctgaagttccttatatgatcttctgattagagaataactgccaaaatgatgtttgaaatgcaagtagtatggcagaaaactcttaagaggaaaatgttaggaccagggcaagtgctccctaggagccagagttcagaactctgggctggttctctgtgctagttactgctcagtacccagtgcctagaatagtgtctagtacacgacagacagtagtagctaatagatgtctgtccagtcaatgaatataattccctactctggtgcctgctgcagcttccagaggtggactctttcattcaaactatttttactccattttatcttcaagagaagaggcttcactatagggataaccccaggttcacaggaaggcatcttctgttcagctgttccttattcaagcttccatactgtcatctatacaacaaatcagaccaggatatgaaagacagagggcacctcctctaggttgccattgccttaagaccatttattttgagaggtaaccatgcttgagacatgcttatgttaagactactacatgaattttatttaaaatgcaatccctgattgtagaagacagttttgtgaccagtgaactccgtggatcagcctttgatggacaaagagaaaagacttggcttcaccttaacgactggtctgtaagataggaagtttaagttctaaggcaactggactaaaggccagcttaagaaacaaagcaaaccccttacactggtgtttctgttccactgatgactttctccatggtccggagctgatggacagctatattcacacacactcttcacaaccattctgaaagtaattttcagctgcaaccaaacaaccagggacctactgtgtgacacatggagcaattgataataccagtgctctatggatcatgttgtcttatacatcacatgtgcttgattggtctgatcaaagttatgattgaaccagctctgcacctgtattcgtccttgcacgttcaagtgaaagatgatgcaaccacgacaggctggaatcaggcctttgggccatctgagtgcaatttgagacatggagttaggctttaagaatgactttgagggttctcaagtaatatccaccctctttcacaggagtaacaggtcacctacctcccatgaaaggaatttaaaacaatttggaactcagtaagcaatgttacactcagcttgtctgtctggcagagaacactaaaaaaatatgtaagactcatcatgttaccagtctgtcagtaaatatttaccaccttgagacaaaagtataatattcagcatttgatgtctaaattagtagaaaagacaaacacaaatataataattagagaacaatacaagcaagtttaggtgtagaattcagtggctggttgagatgtcagtgaatcaacagcttagaaaacagctgtgtttccaaaatatgttggcagcagtctatacgtgttctcagtgatgtaataggagtcaggcactcacagaagctgacattatccataatgaccctgaatcatagacttcagcatgcaaactcatgatgttctattgttccaataagaataatatctgggatgccagacatacacctgcccaaagctccctgcagaaggcaatccaattcctcattctttcagcggacttggcagaggaatgatgtgtgtgtgtgtgtgtgtgtgtgtgtgtgtgtgtgtgcatgcagggacaagggggcatcttagctcaagcttaccatactgggaggacagggccatgaaggctggagtgaggaacaggggaggatgagggatagggactcagggatgggaaactggcatggggctctgcaagcagtgataatgaagagacatcctggtcctagagggcagagaggaagcgtgggaactgaaggcatttttccctttgctctgctgcttgtcactcacaacaccctgcctcaccaaaccccagctctgatcagggctcctgcagggattctggaaagaggaagaacacgcacgttatgagactttgatgggtattgtcctgaagcaaccaggaaaataaaaagaagtaaattttagtgtgaaagcagctcctggtcctttggcttggaaaccacttctgctttccccttctgctgtcctgatcctcactgcttccctgcagactctgcaaaccttgcatactgcttcaggcaagagggtctgttctggtaatacaagtgccttggggtttgcattcatgatagtgttttcatgaattttcatctaaaaacaaataatagaccccctcaagaattgttcctaggatttcacacatatgacctgaaactttaaaatcaacttttcacctgctgtttttatttagcagaatcacattttaggaaagctaatcatttgctatttaaaaatctgaaatagagataaggttttacaataggcttcagagggaatacttgctcaactaaaggaaaagagaaatggcaggagttccaccagggatgatctggcttcagtgcaacctcatcagtgtgagatattcttgctggtcatggcttggctaatattctccccagcccctactcctctcccctccacttctacctcagctgaaacacccaagttgaggaaaacttcacagggagaataacccctgtgttgtgctgcagccagttcatcctgggagtcagttatgtatacctctccccagttctgtgtttagtgacttcatgttggtggctagaaatcatccgcatagtatttacatcatgggtataggcaagtgctacaaatcaggacttttccttggggatggatgtttggagctagtttaccagcacaccagtgggtaaaagtgaacaaatacttttttgatcccacagaatcttaaaaaatactttacttcgaaaatgtctctactaagtaatcatatatatatatatatatgtatatatatgatttttttttttttttggtagagatgggatctcataatgttgcctgggctggtctcaatctcctagcctcaagtgatcctcccaacttggcctcccaaaatgtcagtatgttgggattaggcgtgagccactgggccaaaatgaccatatcttttgactggacaatattatcctatgttctataaaccatattagtttcagaactaaatgtaatgctaaaatacgatgactgattcttttttttttcagtcaaatgtattataaaacttttacgcaatatcattttccccctttggggaaagtagagggatataagctacaaaagaataaaaaagtaggtagattaaccaaatcctgttttttttaaaaaataagttactttgacagagtctgctgaaaaatattgttaaactatttgtaataatatttctggtctggttagaaaatttattagtttatagtacaatgcaaagggaaaaaatccaacttctctattcaggttacaaatgtgatttcacatttgggagttgtgagagaaacgaaaagaaaccttaacaactttcttgccagattgctttgaatccctaaatgccttattttgtagccagccattggaattgagctactgtctccagacaatcccattaaatatatattggttccctagaaaggtaacaaaaaaaagttattaaaaaaagaggaaacagcccagtgcagtggctcatggctgtaatcccaacactttgggaggctgaggcgggcagatcacttgaggtcaggagttggagaccagcctggccaacatggtgaaaccctgtctctactaaaattataaaaattagaggggcttggtggtgcttggtggtgcatgcctgtaatcccagctactcaggaggggaggaagggagaattgcttgaacttaggaggtggaggttgcagtgagccgagatcgtgccactgcattccagcttaggcgacagagcgagactcagtctcaaaaattaaattaaattaaattaaattaaattaaaaaataaggaggaaaaaatgatgagattagcagacaggaatgggagatgaggaagtagattagaagacaaacatattttttaggtagttggtgctaggagaagtcttgagcaagtgtttcattggataattaaaaggcctgtaatagtgaacttaaaatgacataagtcaatttggcagggaaaggaaggaggaggagtttttgcttattatttagtctcaggttggactgccacctaaactgttggttccattaagtcaaggagaccccatatcctcttcattactgtgccttgcaaggtgcctggatgaaatgaaagtgaaagaatgggaaacgcagtacgaaaggcaaataactgcagctgaaaaaaaaaaaaggtttctttgtttctttgtttttatcttggtttagtagtttcaggcaaattctgtatcttctagttgacccatatatagcactgattctcacaaagttcggagatagcattagattttaaacttcattttctttgcacaacaatttattcatccccttctatagaatatatgcttctagagaagcaggtgcattgtctcaaagaaaaagacggcagcagagtctgggccagatttaccataatgtgcgtcctgggagatcttgctgctgtcacatttgcctggttaactatccataagtccatgttaaatactcaaaaagagaattacagtgaagaaaaatggatattttaaaaacagtggtatctttttttggatccagaaaacaaaaagtattttatttgccagaggtaattttatgtgttagtcaacaggatttgaaggatcctaaaatacccattactacagctataataatgagtaataacaactttcttctctttatttcttagatgtttggaagtcctatatgcatatcccatatggatatttcagtctatataggtatatccctgtcttcccttttgatacataccagttaaaaaactgaacagaaagtttcaagcaaattggttaaactctaatggattcctctggcaactttgatgaaaaggtttatgcctatgacagaaaagtcccatcagtgggcaaactttctagacataaaaattcaatgtaatctacagcaggtaaattttatgtcaattgaacatcaggattggaatttctggtaggtgtctagtgatcatagtacaaactatagttttatttataagggaactggatgtaggcgacttctttcagtcttcttatcacaatctttctaagaagacccttcttttcagtcatgaagaagctttgtgctgttgattattaggagtattttctcaaacaaactttccagtctaaaatgtcaagccacagatgaatattgagaaggcttgtccaaagtgttcaatcagtgattttgagtttatggaagtcactggtatgatgacacagctttatagctgagtttctcactgtgttcataaaataaacaatttaaaaagtaaatcaatgctttgcatcaacaatagaaagataagttcccctgctcatattccgaaagtttcctaggtttcaagctgggagttccttgaaaaagcccagggcgccaacagcatgatgtgatccgctcccatttttagatgagtcactaggacagttttactcaaagaggcaggggtttgtggaaagaggagtggacctctataaatggcataatttgaatgtgcattttgaaaatgccacatgagcaaacttgcccacctgccagtccagagaagtactgctaaaatcacctctgaaagaaccacatgatctcaaatatttaaagaataacttccaatgtctctcaatgcaccttttgttattttatgttagtgcatttatccattggatttttcagttaatataaacatttttatcatattttcattagatgagctaaaatggatgtactcttaaatttcactgcgaggttgaagtcatattcagtcacaacaccctgagtgctggacaagacatctttactttttttttttttttttaacaccacgagctctaaatccttccaagatacaaaccattaaaagcacctttataatcaacgtatgtcagagatctaacatcatattaacttctagcacatgcaggtagctaattattattttatttctagtctttacaagtacatggtcagttaaatagaaaccacataaagagtattacaagtggtacagtggaaagaaattttaaaaagagggaggaaaaactaaaccatgagaccaatatacagggttcttctctttctatgacatatgtgctctcattagggcattgacaaaagaaaatatatttttcagaacttttgtacccctgatgctaatgtacacaagagaagccatcaaaagcctactgctgacaagtcagactattgatccatcctgtctctcatgatttcccctgcctcataatttgatggccttttggaggcgtggacaatgaaactgccaaacaaacagggactctcacatagagctttgggctttgtctccagtgtctaagctagatttttgggttatgctgctgtggaacagctgcttccagagtcacccctctagagacatacttggtcacctgccaggatttacatgattatccatcatggggacaaatctatcccaggaaggctcatttcagaatataatacagtgtggattgaagacctaatggagagaagtgcacccacaggagtgactgtgatctattaaatcagtaagaccttggaagccttctgtcaactgacttcagaaaataatggttcccctctcaacacaccactgtacttttttatttgtcttttgttaagtcatcctgaggaaaaggctgctggactgggagatttaagactttgaatagtgctaacagaatagaaaaggaaagttaaattacgctgcctattctcttaccaaactctgtaataacaacatctattccttcatctagtgaactgtcaggtagggcatagagaatacgcatttggaaattgatctcaactgcctttgagaaaccatagatcatgggaaaagaggacctgtgtgcctttccatcttaactctggatcactctgctcctcatttcagaggccttctttcccttcttagagtagatcttattttgttgttgttgttttctgccagaaaatctttacacatgctgtttcttcttccttggaatgcttttcctccactgttcatttgcctgaacacctaagttaactcaggatcctcctattcaatgtctattgacctcgttaatttttatagcattttctcacaatctgcatttgtacttttggttcatctaaaagtctcacaaaggcatgaaagcctcacaaaggcagggaacatggatgctaacatgaagtaggagttacataaatatttgtcatattaaagaattttaaaaaataaaagtaaataaatgaagactgcaaaaaattgacagccataactctggattgtaaataaagttgtatattgatgctgctgtgtccagttaaataaaccttaatctaaacttggagctttagagtttgtatactagtcactggaagtttcaatcattcatgttttaaatcacatttttctcaataggagcatatcctttaggtaaaatttaaacattgctctcttcccttaatatgagggacttaatatctagctttacagggctttttaagagcaaggaaaatcactctattgatgctaagtgaagggcagagaaagcaactctattaagcttttgacctagtttctctctggttacttcaaggcaattgaaaagtcctcgattaggtgcaatttgctagtgactattctactgctatcagtgcagaggcatatagatggaatagggtatgtagacttatctatggtatattcatttacataattttatgtcataaaaaacaaaaaaaatcaaacttgtaacattactgagtcagtcgtaaaacagagtatccagatgttattttagaaacagcattgattgggcgcaaagatcaaggtgtatatggcagctttagtgagtttggagtatagaaagtgttgggatcaacagaatccatagcaatcagtttaaagttttcaataaagctatgaatggtaagagggaaaccaactagaatttgctgctcattcacctcaaactgcactgagatatctttatgctcaaaatggacaaggagactattatgtgtattctttgatgcagcaatgctacttctaagagtttatcttacagataaagtttcacaagtgcataaagatttttaatgcagcatcatttttttaagttggaaacaacttaatgtccatcatttgaggttccttttttcctatcatattgattatttgctatctgccaggaactgttctaaagcacttttcacataataactcaatttgtcttcaaaacaacaacaatcttcagttactttccctactttaaagataaggtaaagtaagttgtaggggaccacagaggtatttagtggctaagctagggtttgaattcagacagccattaaaaaatgaagtagacccaaacttactgataaaacacctagggcatatttttaggttgaataaaaaagcaagttgcatatatatatatggggagagagagggagagagagagggatacattccttacaaaggtctagaagaatctgttcaaccaagcgtagtcacctcttgcttataagcagatgcttgaagagaactttccccttttactctttaaaaaacatctcaatcattttaattttatatccttaaatgttaaaaagttatgtatgcctggttttataaaataaagttaaatgcaatttcacccccactttaaaaacaataactaaaaaggtatagcgcttactgttcataattttgtttcctaacaattaaaacatgttattaaggaattcaatttaatatggtctatagtcacatgtacgtataatctgtatgtagcacatataaagttctgaatagatggcttccaccggggtgacaaaaggaacagaaaaaagttatactatgttaagttcagaactttacccaaatatctttagacacacagcataatacatgagaaaaatgataactacagataatccataaagttgtttaataaagaatggattgaaaagttatttaagaaacaattattattttttttttttgatgcaaggtctcactctgtcactcaggctagagtgcagtggtgcaatcatggctcactgcagtctcaaactcttgggctcaagtgatcctccagcctcagcctctggagtagctgggactacaggcataagccaccatgcccagctaattttaaaaaattattttgtagagcctgggtcttgctatgtttcccaggctagtttcaaactcctgggctcaacagatccttccgcctcagcctcccacagtgttgagattataggagtgagccaccatgccctgccaaaaaagtaacatattgaatgtaaaaatcataataaaagttataatgatttggtgtatactatgtcattctaaaataatttgtgcatttccttctaaatatctatctataaacattagtaaagaagtgggaaatttttttgtcctgaaattcattttacttaattagcatcatacagaaagtcatttatgtgccagatgctaaaagggaggattacgatccagcagatattgatcataagaatgaaatgaggcacaagaaacacctgtgaatcatgaagtattgacgctggattttattaactcctatatagtgataatgtgattgaaagattatgaatcctataaaggaaatatatttaacaagtccctactaacaccaactcttgactctcagaccatccacaaataatctacaattagaattcattatgtctaaagacagctatcattaaaactgaaggccaaaatcgccctttctgcgtacttctgaaagagcttgcctttgtgagcaggaggagaagggaagagagacagtgtacccaaggaaaggagggtgttggtggtatagagagaaaggcatttctagcgcccaggcaccacaatgagaatttgagaattgtgtttattgtctatagagcttgttattgctcttgggtttttggctacaaaacctaataatttactcagttttgcaaggaaataagaaatgggcctcaattcactctccttaattcatttagttggatctgatttgcaatgtatgttagtactccttctgtagcaactgaaacatattaaaaatgactctagaaaaaatacatgctagaaagtgcttcggttactttttccttaactaggagaccccaagagggaaatgactaggtctcaaaatttctaggaatgacatttccttcttctgagcaacttgaaggtgctacagaccaatggaatataagggattcattatttaatgtacaaaattcaggctgctgctttagggcaaacagaaaaaagtcaaaatttgcctctatatagaaggctaaaaacacttttaagaaataaagtaagtcatagggaactgggcataattgaagttcccaaagccaaaattttcccttttttatttgtaatccaatttgtggtacaattttcctaaatcctacttctgattatttttaaatttttctttataccaaataaaacaaagttaaagacagaactctgctaaaattttcaatgtaaataaaaattaaatcatttaataaattatattagttgtcatgctatattttatgtttactcttgttatgttttatttattttatgtttgactaatcccccatcctgtgggaaacgtttgttgatgctgaaattgccatgagctatctttgctctatttcctttacttatgtcatcatcaagttcaccaattaacctatattttcacccaggtagttgacaaagcattggatgcacctagccaaggactgttctatggctctccactagaaactccctctagaccaggctgatgtcaagccatacacattaatgataatggtaatgagctacataatccagccctccttgacctcatatttctacatctgggtcatgtgactataattaattttttttttcttacatgtcttggtgaactgaaggcacatgatactcatggtattctcctgatcttaccactaggcactgtgtcaaaagacatagaaattgaaactgggttccttgagagcagacattatatcctattcatcccttaattctgtttcaaaaccagtgactgcaagacacagaaatacatgttcaataataaatatgtaatacataaatacatgttcataaactattgggagagtctcaggattttgaaaaagttgttttgtagtcctagctatgccactttcttgctctgtgactctggacacatttcatagtctccaagaacctgagttctaaatctgaaacaaaaatgtactgacacattttaagattctctttcaggcataaaatcctacctagatttatcatttccactgtgtaacaaagtgggacgatgacccattttttgtaactcagtagttttctggaaaaaatttaaaatgcattttttcagtacatcaatacatcttgagataaaacattgtatagtctctactttgtgtaaagcaaacattttcattacttatctaaagacttaaccttctttataccaatcatctgtaagtttggaaaaacaatgcaattgaatttttcatccagctgtttaccatacataacttagaaatcctaaaatgccttattgaaagtgcagtgattttagcattggtagagtaacagtctcaagaaatgaatgaagctttaatgactcatcttcaattcaagaggaggggctactattataaaatgttaagctgaaaaattccaaacacaactgagatgaagttacatgatttaacaatctgttttttgtttttttgaaataaagtctcactgtgtcgcccaggctggagtgcagtggtgcgatctcggctcactgcaacctccatctcctgcgttcaaaccgttcttctgcctcagactcctgagtagctaggattacaggtgtgcaccaccactcctggcaattttttttgtgattttagtagagacagaatttcaccatcttggccaggctggtctcgaactcctgaactcagatgattcacccacctcagcctcccaaagtgttgggattacaggtgtgagccaccatgcctggtctgtacatcctaaaaaaccccagtgttctttctgctgactgaggctaattagtgtgggtgataaaaattgggcacacatatcaaacacaaattggctactttgtccagcaaactgcttccaccaaaactccggctagcaatcacattacaatgactacttggctcttttctttccctaaatggatttggttatagaattggaaaaccgggtatactttgttttcaacagattaaatgtaatgggttttatgaagacagtctttatattttcctataaaaaaggtaattagttaagggattttgggggtaggagaatgaggcacacaggggagtactcatttcaggaaaaataatacgtaacaaaatattcacaaatattctgctgtccctcaagctgatgaattaatcttctcgattagttccagataaatcctaccatttaatctattttgaaagaaattagaaggctatggttttaacactatgttcaagttttcgctaacttgtaaaatggtaacatacgtgctgtaaggatgacataagagatggtaaaggaaagcatgcagaaaactgtaaaagcttataggattttaaatataattgtacagtaactaatgatggtgaaataaaatagatgttccttgatttagaacttatggatgtttctgaagactacatagaataaacaatttagatgttcacactctggccttggccttatcaattcgccttcccctccttgctgaccccacccctttaatctaactccccccaaaagtggccacatactgggagtaaagagagtggcaatgaacctggatctacttggggaggaggcctcggctattcaaagagtaagaaaaacacaatgttccaggctcctgattctcaagcaacacagttacttggggtatttctcaccaagtgacctggatttgaggttggcaagtgtcgcacaccccacctttctgggtggcagagccatgtgaggctgttgggctgcacctaccagctaatggctctgtgactctgtgtcacaaaccatttgtttctacatctcctggcatcaggatccaggaaagatgtccacactcattatccataaagggagttgattgcctaagtgatctgcctgcattctacagagtggagaaaaacttattaaagataggtttagtcacaagattgcactgtcagcagtcagactctcctcctttcttgacttttctttccctcatgctctaatagaattgtggctgaactcatctcctacttggattatttgtcttgagttgaaggagccctggaagatctgttctgaaactggatgtgacgttaggaaggcaaaggagatttaaagtgacaaattgctggctcaattctcaggaagaggtgctgcagaggtgatgtgcaaacatttggacttgtaagggtgatgatccaggaatctggggactgggttctttgcctaaatcctcccccaccttcaatgccattgctctatgctacacctgcaacagcttcccatctgcctctgcccaaatagcctccaaagtggaaatgcagttcggtgaaagagagtttcagcataataatccctgggcctttttctatacttaggacagaaacaaagtgaattgccaaggagcagacctctctccctactaatcggtttagagttgtgttgacaaaatagtggcaaaatctccagaagaatctccctatgagcctccctgagcctcccaaactcctgcatcccatgcatgcatagatatctctatcacattcctggcttttgggaaaggaattgcgcatacagcaccaatacttccaaagtatttagaccttcaggctatcactgtcctcaaagtttcaggttccttatccataaaattctgaaactgggccacaggatcttctaagtctgccaacccagccctgagggcccatgaagatctatgctgcttgctttggtgacaaaaataaaaataaaaaacaacagttggggcttgattccccatattaaatatatgccaagtatatactaagtatatgttaagtacaatgctaagtattatcttgttccattcttactgcaatcctataaagtcattcttgttatcacacccatctgacagatgagaaagcagatctagacaggtcacatacctaatacaaggtcatgtgactagcaaactgtggagccaggatgtgcttcactgctttagaagttcgagtgtttaaaatccagaatgttccattccataaaaaaaaagacattctacatttcttatttgtttcgtaggctggcccacaaaaacaaagtattgtttcgtgcctcagcgtaagtctgaaacaagacatgcatggtaaactagtttcttgagccccactgtgcccttctgaccccaggaattctccacagttcaaacctcagactcatgctctgaggcttcaatttcaccacagactagaacttgagctcagattttggagaccagaaacctagcccttctggccctaagaatgacaagcctctccaggagcaaagtcaggaaaaggctgaagacaccagcagccgttgagaaattaatcgagctgcagcagtcattttgctttatagggtatcttttttggcagaatgatcttaaaaatccaggacaaagtatttaaccaaatatgtagagcaaagaactgtgatgagttaccaacacatttctcacactagtaggttaagatgatttacttgatatttagtaataatctatacgtaattgtcctttttatgaggatagggatatttcaaggtgaaaagaggtaagaaaatgtggttgatccctacaattttttggatatagaggaagaaaaacgttcaaggaagttcagagggctgaagataggtggtcttcagctttgcatcttgatttttgcactaactagctccatgacctgggataaaaacaatgataaaaatagtgataataaccttcattcactgaattctatgtgctgagaatttgctaagtgctctatatgtattatttcctttaagatttaaaacaacactataaactggatgttataagtcccatcttagacataaagaaactgaagttgaagttgtgataacttgtccaaggccacaaagctgttagtggctaagttagtattagaacataaatatgaatccaaaacttatcccaactgaatctgaactgattaccttcaggctataactgtcttcaaagtttcaggtttggaaaagcctggagggaactggagactattattctaagggaagtaactcaggaatagaaaaccaaagatcatatgttctcactcataaatgggagctaagctatgaggatgcaaaggcataaaaatgatacaatggattttggggacttggagggaagggtgggagggaagtgagggataaaagactacaaattggggctgggtgcggtggcttacgcctataatcccagcacattgggaggctaaggcaggtggatcacttgaggtccagatatggaaagttccttatccataaaattcttttttaaatttttcatttccataggttttggggaaaacaggtggtacttggtttcatgagtaagttctttagtggtgatttgtgagattttggtgtgcccatcacccaagcagtatatatactgaaccccaatttttttttgagatggagtcttgctctattgcccacgctggagtgcagtggcacaatcgcagctcactgcaacctctgactcctgggttcaagcaattctcctgcctcagcctgcaaagtagctggtattacaggcacctgccaccacaccgggctaatctgtgtgtgtgtgtgtgtgtgtgtgtgtgtgtgtgtgtgtgtgtttagtagagaaggggtttcgccgtgatggccaggctagtcttgaactcctgatctcaagtgatccacctgccttagcctcccagtgtgctgggattacaggtgtgagccactgcacccagccccaatttgtagtcttttatccctcacttccctcctacccttccctccaagtccctaaaatccattgtatcatttttatgcctttgcatcctcatagcttagctcccatttatgagtgagaacatatgatctttggttttctattcctgagttacttcccttagaataatagtctccagttccctccaggttgctgcaaatgccattaattcattcctttttatggctgggtagtattccattgtgtgtgtgtgtgtgtgtgtgtgtgtgtatacacacatatatatgatacatatatatcatatatgtgtgtgtatacatatataacatatatatttacacacatatcatatatatgtatatatatctgtataacatatatatcatatatatacatatgtatgatatatatatatataaaacaatttctttatgcacttgttgactgagggcatttgggctgattctatgtttttgcagttgcaaattgtgctgctataaacatgcatgtgcaagtatcttttttctgtaatgacttcttttcctctgggaaaatacccaggagtggaattactggatcaaatggtagttccacttttagttatttaaggaatctccacactgttttccacagtggttgtactcatacattccccccagcagtgaagaagtgttcccttccaaaccacaatgtgataccaccttactcctgcaagaatggccttatccataacattctaaaactaggccacaggatcttgtaagtctgtcaagcaagccctgggagcccatggagatctaaacatttagaagagggaaaaccaatgagacattttcaattcttcctttcttgtagactgtaagcactagcaaaatgaattgaatctgtatacagttactacacactgccaaaatctgattcattttggataagtgatgatttccagaagtacaattctcagctgaccatacgctgctatgttcattcaatttaaaaaccttgagccattctaggttttgaagtccctcaccctgccttgccacacccctgtagcaggaaagaagctttcccaaagaggaggagattttacttcaagagttattacccgcttagttgcacacacattcatcacattctgagcctgattggtggctagagttctcagggggccagcactggctggggaaagtggaaggaagagatatattttaggcacccattgatagctttgctacaaaatgcactacccgggcacaacacactgagttctggcaagtacagcccatgttaaagacaaaatactccactaacttgactttgtctttcttggaccatctcaaatttggggaacctctaggtatctgattgcatatgttcctgtgtgctcctaaaggtgccaggggaagagaaaaacacatggcaatcagttgacttgcaaggcctagttataagccgaaataaagttttaggtacaatccagatgtataatttgctataaaaatggactcggaggaatccttggtgatttcccacaagactgagccactgtcctcctttcaatacgagggggattctgggttttccagacctcactttcttcaggtctgagataagcctgagacatacacaattgctgaaggtaacgtgaagcaggaaaaggaaggccagttgctctattaaaggagcttgtgttttcctctaaccaccacagtctgggcagcagacaattctcctttttctttcagagcaagtaaaatgttctaggtcatgtttaggttgtgacaggcacccggatcaacaagacgtcatttaccaagataagctggaggtcaacatctccttatgaaagggctccaggagctgttgcataaatgcaaaataacagatgcacaatatttgagtcctttagtatatctcataaactttaataatgtgataatattcaaacacatggtagtgttttaatggtaactacagaagagcccctggaaaatctgacaaatgctgtcataactggcccttcagagatgtccttccagctagtccatatttgcccttttaattagagttttagtccacttgttccttcttgaaggaaataaggaggctgttggaatagcaattttcaatatccagattccagacacatcaccctgttatagacagaactcaaatccaaggcatttctggaatccctatgttaattaccacattatcaagtcctggaaggactgtcgcataaggattctgagtaacttgattctcctaatgaacctgagccacccagacgatggaatgaacagcctgtagccagtctgggctgctgcctctcacccccgcagtctcagagctttggcctctcctgggtttggcacatggcctgtcctttcccattgtcagcctccttttcagcgcggtttggcatcctcttcaacatgaactgcctagagtctcgtcgtgccccttttcttgacccagccactgcctcatgtgctgccgtgtctgctcactgatcacctccactgtcttctaatctgttggtactgcattgttttacctgggtttgcaactggggctctgagatccccaacgctagctgttttctgggctcagcgatgctcacctagacctcatgcgcccgccagagatgaacccaggtggaatccctttgcctatttttgtcaggtgaacatggacttccgcttttgagaatcttccacctacccaccccatccatttgacactaacatgtttaggtcagtgcttctaaactttagagtgcatctgcatcacttaagaattttgttaaaatgaggattctgactcagtaggtctggtgtggggcttcaaattctgcatttctaacaacttcccaggtgatagccattctgctggtccatggattgcatttgagtagcaaggctctaggaaacagccttgtcctattcatctttgctggcctgcaatttccacagcagtttcactgccaccacttgggaagccccttctagtggtgtgaagcagtgaagacagaaggatgaccatgacacagtccctgctccccagggttcatagcctggagcagttttcgagttcagcactggatgttgagggctgataatatttagttgtgagggaagtcaggtgaaatgtaggttatttagcagcatccctaacctctacccactaggtatcaatagcatcttcccagttttgacaatcaaaagtgtctctagacattgccagatagttaagaatcaccggtatagggagggagacaaatatataaattaataactgagaggatggatcaagttatagaagctatgtatacactattcaggaaaagggattattaatatttcagaggctgtgataagcatttgacacagtgtgtgctcaataagtttgttagatacacaaatgcactgtgatgtccccacacttcctataacagtttacctttctgactgtctaatagaaaagacagttttacattccaaagattagcatctacttcactgacataattcactttcatggacatgtttgccaagtgtattacaagagaaagaagcctccttattttttaggataatgaagatagagtatagacatttgtaagaaaataagacacttaaaataaatatattttgtgaaacagaccgtttgtactgcttttttgacattatatgcacattcctatcagacaacaactaagaggagcattgtacatattacttggtaaatgaattcaagcaggatggtgcattttgttgcttggcacatcttaaatgcatgctcctaagcagctgtttcttttcccttacaggttttgggaggatgaatgtatttccaaggaactgtctattctgggatgctcatgctcttatacagatgcatttgacatctcaccatgcatacatagaaaggcaaaccagtaagcagataagcttggggaacccaaataagaggaaaaccagtgagcatccacatttatgaaatggaaaggagatgaggaatgctcatgtcgagcagcagctctaaatctcagccccaaatggcagagctgagaaaagaaataatgtcagcattggacttacataacaagatggcaagttgaagattttttggttatttatcttaatatagaggcaggaattgagaagggtctgactttgaggcagaacaaaagggctgtgagaatactgaaggtgtaagggcatttaaggataaataaaaaaaggaatggttgtgggggggggcatagcgtggaatatttcagtgcaaactttcagacatgtacttggtaaatgttattatcccttaacattttataaatggaatccaaaataggccaatgggaaacattcttggaaatatataccaactggacaagaatattcacagttgccaaaggaaagtgtgacacttggttctcgtgccaaagtcaacaagcctttgcccaaataatggcaaatcttttcgtttggaacacagtttcttaattaagccccaatgtcaattactgcacgtaagtagaaatcagcagatctgaagtcaaggccaggctccacggctggttggccaggtgaagtaacatttgtgctccaattttcctatccagggaatggggaaggtaatactttccaccaatctatgctgaaggaatattgtgatgagtcagagaataaatctctgattttttttgtttgcttaatgaagagtatcactgcatttactatagtaaaggcttgttctgttttagtccataagttgaaaaaaatcaatatatagcattcatatatccaaaatattcacaagaaaggtcttcaagaaatatttgctcatccatgttcatagcagcactgtccacaatagccaagaggtgaaagcaaacaagtgtcagtaaacagataaacagatgactggctaaagaaaatgtgatatacacacacacacacacacacacacaaacacatacacacacacacaccaatataacagaatgttattcagccttaaaaaaggaagaaatccctgtcacatggtacacggttgaactttggagacattgtgctaagtgaaacatagtagtcacataaaggcaagtatgattgcatgatatgaagtatctgaagtagtaaaattaatagaaagcaaaatggtagttatcaggggctgggagaaggggaaaaggggagttgtttaatgggtacagtgttttaattttgtaagacaaaaaagttctggagatctgttccgcaatgatgtgaatatacttaacactattgaactgtacacttaagatggtcaggatagtaaattttatattttttactacaatgaagtttttaaaaagatataaataattcagcgaaaggaaacaaaagcctcaaaataacatcccattttggttttagcattagaatttggctaaaggggtacagtctctgatgagacttctttacataagtagccaagctcctggttaccagaggtgtgtctggtcagtaacacactttgttcacagacaggaaccaagagtgcaagtgtcccccattctatctagtttgtgcctttcaatggcataggatagcagcaaaggcatcataaccttccagggggaaatggatagttagtacttaattctatgtaggctgccctatacaggaagcactgatttttgatcatgtaacattctaaatagccacaaatgaaaataattgccagttctgcatcatgaagagcaggagaagaagacctgctaaaagagtcagaaaaataaataaataaatgaaatactgagataatatgaaatggaatgaaataaaataatataaataaaagtaaacaaacacttttcaagcaagttttgtttctcaagcctaagaaaccccattttggcccaatatacagactactagagaatttcttgtccttaaagcaccaagtgcttagtgtggcatctgctttttgctaatttctgaggagaaggtgcctcatgattcgtggcagtgacattatctttcctattatgaataaaaaaccttgaatcaaattggagtgatataaacttaataggatagagccttcagatctgcattctcagccaatcactactttactgggttatcctgggcaaaactgtacttcatttgttttttctgcaaaggtagacacttttcagatctgattcgagggacagcaaaggtggagtagaaaggtcactggatatgctgatacaacatgctacagaaagtaaccaaagacttcgtggtttgagggaacctgggccatttctgctaggcagtaaatgacaggaagaagcttggaaggttttctcttaagtgatgtttaaggctctgagctaccaagacttctgggaatcaccaccaatatcatagtgctatactttactcagtaagcagaaggaatttctctgttggaaaaaaaaatcaaacaaaataaaaacaaacctctaaaggtgtattgggctcgcagttatttccaataggggctcagtcctatgggggaaagggagtcaggtagacgccatggagatcagacacctggctgattagctccactgagaacgctgcaaagggcaaaactttgtcatcccatctctttgtagaagcatcttctctggaggcttttaaaaataggacttgctctcagcatttagagaagacagagcataaatcttcctggggaggagtggaagaaataaccttgcaaaatatttgggggactgggtcctgtggacagttggtctccatagttaactggagatgttgaaattgcattcatgcaacctaaaatgcttagacatggtgaaataactagttgaaccaattattttgcagtgaaaaaaaaagcttcaccagtgaaatccaacctgttttgttattgttgatgtttcattatttttactgcatttagcttttgaggggacacataccaaggtgacagtgctttaggtaaattttgtttattccttatttatcttcttattcaagaggtatttctaatattttaggcaggagctgcattttcaacacaggaataaagtttgtagatatttattgcagcttcctgttgctgctatctctacagtaatcatcatagcttcttccctagggaaagagtgcttcaggctttggaaggcgcacagataaaaaggatacgtgtttttggctggagctacctgattctatgatctccctaaaattggttactgaaatattctcaaatgtctaagcaggtcatattgtgtaaatgaatgatctcctgaatattttacttttttttttttttttttttgtgagacggagtctcgctctgttgcccaggctggagtgcaatggtgcaatcttggctgaccataatttctgctcccaggttcaagagattctcctgcctcaccctcccaagtagctgggactacaggtgtgtgccaccatgcccagctaatttttgtattttcagtagagacagggtttcactatgttggccaggctggtctcaaactcctgacctcatgatccgcccgccttggcctcccaaagtgctgggattacaggcgtgagctatcgttcccatcctaaccattttttattgatatataatttacatataataaaatccaacatgtttaaagtgtataattcagtggtttttagtatattcataaggttgtgcaaccatcaccattctctaattccagaacattgtattcagccccaaaagaaaccctgtaccaataaccattcactcctgctttcccttcccctcagcccctggcaatcactagcctactttttatttctgattatttcatataaatggaatcatacaatatgtcaccttttgtgtttggcttctttcacccagcagaatgttttcaagtttattcatgtcatacatgtatctgtactaacatcttccaagtaattactgtgtccaaggtaatgaggtgttgaagcttttcttttcttccagatgtatggagttggtgcagacccagtccagtcttatgacgagccttggatgccatggtcacaggcagcacatttacggtgtagccctaagggttatgggaaacccaagtagttgggttaacccagtgagacatgaaaaactgcccagaacacaagcaagaaacaggtcataattgagaattgaggaaagaaagtgcaagacaaaggtgttcagatacacagttaagatctgagtcctgggtcaggacagaatcaattaagagagaaagaacagtgggtgagaagaggtcagtggccagggatgtacaccaagcagccaaggatctgtagtactcgggtctgtagcagctgccctgactcaggccatgtgacttcagagttctctgtcacagaagcatagaatatttgcactggagaaaaatttagagctatattctttagcaccatggttttgaagatgaacaatctgagctctagaggggctaagagacctcccctcaagctcaccaaccttagtgatcacttccttcatctccctccactcagtagaatacattttccacaatagctcactgccatgggaccacggcatgggatcccaacagatggatctggtcatatgttagtgccaaaatgcagtttagcaaccatttactcacatacccttatactatgtgacaatcagcagaaggtcttagatatttttatattagcttaaaagaaaagtttgatgttctttgacctaatttttattggtttaattgtctaaatacctggagttcctttacattttaaataaatttaatagtatcaatctataggtttagaaactgagagaaataatttttattggttaattgtctaaacacctggggttcctttacattttaagtacattaatagattagtatcaatctataggtttaagaactgaaagaaatgaatgaggtccccaacacgtcagtcaatgggaattagaacagtgatgcccaaaatatgcacataaatatcacgtgatgaccactaaaaaacacttggtgttcaacagaattgtaaaattagtaggtcaaaaggaatgactccaaaacccttcatcatttaacattcaaagctgtaacttttaaatcagtttcttctagcatcattgtatagaaaaaaatcattttttcttcagaaaaaaaattaaaaataaataaattttaaaaatagccttcagattagtcaaaaaattttgatgcattcatatgagaaaatcgaaggcattaatatggcggtatgatgtatgtctactgaactcaaaagtttagtaacatgttgagtgaaataaaaactatagaagaacatttaaaatttgatgtctttatatatcttacaagtgtgtttatttatatttgtgtgtatatacaaagaatatatctggaaggacatccataaagtattgacaattgtatccccaagtagtggaattatataaggatttagtttctataattttttgttgttttgttctctttatcttctatttttttttctggaatgaacatggattacttgcataattaaaatattaaaaatagactttgttttgaatattgtgtttgcaagactggttcattatcagtttctacaacaaatatcattttagaatcgataacaaaaataaaagcaagttgtccttatcatctccacaaactcagaaaatagttctacatcaaatataaaccagtacaaagaggcacttgtgaaaggaaacaaatgtttggggacttgacctactccccttccctcctcccttgcgtctcaaagaggtacagctcattctcactccttttgatttattaaatcaccatcttctccctaggctagacaaaaaattcatggttaggatttaccctcaagcttcaggctgactacattgtatttgaaacaagcaagtcatctctgtcttgttgcaaagtttacaggaacatcacctcaataagcacacttgctgagcttattgttatccacctttacctcataggaaagccctactagtaatggactttgaatcaccttctttgtttattcatgaagttgaaagctacaatagatcatgattattttccaataaaacaaactaccagggtcatcgtgatgcgcaactgtgaggggtactattttcatcataggttatattaatggtgccactttgctcatcacacatctgctaacagtggtccaggaaacttcatcctgtaacattttaatcaaattctgcttttctattcagtatttgactctgaagggcattttctccacaaattataaaagtataaagggttttagataagtacaagtataaatataaataaaatatacaggtataaatatgtatatggaagcaaatttttctatatatcctgtatatttcataagtttctataaggatggacttctgattctaaaccaatgggtcacatacattggaaaatacaagataagattgcataccaagttaatcacataaatagaagcagaagttcctacttttagatttggaaccatggtgtgccagatataatgccaaactttatcaactgtagaaaactatagattagttttaaattgtatattcttttcacagttactcccatgttctagagatcgattgttccagttttttaacagctttatttgatgtatcactgacatataataaactgaacataaagtgttcaatgcgataaatctaatgggttttgaaatacatacacacatatgtatatgtgtgtataaaatatatgtatacatatgctgcatatactacgtatatacacacacacacatatatatgtacctttgccataatcaaggtaataaacgtatccattaccccccaaagttctcttctctagctattccctctccaagtaatcaataattttattgtcactgtggattagtatgaatctccaataattttacacaaatagaataatccattatgtactttggggaggggaaggaggagagtcaggctttcactcagcctaattattttaagagtcatccatgttgtgtgatatataaatagttcattcctttttattgctgagtagtattgctgtgtatggaaatggtataatttgattacttattcacttgctaatagatatctaggttgttttgagttgtacaagtctttgtatagctatatgctttcttttctgttgggtagataccaaggtgtagaatggctggattatatgataagtgtatgtttaacttttaaaaaaacggtctcctaaggtagtcgtaccattttacattccaaccagcagtgtagttgagtttgggttcctccatgtatttataaatatttggtgtggtcaatttttttttaatgagacaggttcttcctatattgcccagactggtcttgaactgctgggttcaagcgaacctcccacctcggcctcccaaaatgttgggattacaggcgtgagtcacagtacctggatatggtcaatttttaattgtagctactctattcagtgtgcattactatttcattggggttaatttacatttccctagtgagtaaatgatgttgagcatatttccatgtgcttatttgttaacatatattttctttagtgaaatatctgctcaaatatttgaccaattttttgctgtgttttcttaattgttaaattttgagcattaattaaatattctgatataaatattttgttagatatactatttgccagtattttctttcagtctagcctgtcttttccttcactgaacaacatatttcagagtaaaaggtttaaatgttatcaatttttaaaaatagataatgttttggataaagaatctaggaaatctttgcctaacctaagttctcaaagactttcttcaccgttttttgaaaaaaatataattgaggttttttattaggtttcagatacatttggaatttgtgcatatagtgtgaagtaatagatcaaaattcattttttatttgctgcatatacaatatttcgggaagcatttgttctgcacagaattgccttgtatttttgttagaataacaacaacaacaaaatccaaaaccagtttattcatatatgtgtggatctatttccatagtttattccattctaatcacttatttctatttttatgccactaccacactagcttggtacctgaaacaataaaataaatcttgaaatcaagtagtgttatccttttgttctttttttccagtggtattttagctattttaggtcctctgtatttatacatgaactttagaaaaagcttgaaaaatttacaccaaaaaaaaaatgcttattgggattttcactggaattacattgaatctctagatcaatttgggaagaacgattatcttaaaaatatgatgttttctgacctgtgaaaggcatatctgtctatttatttaggttttctttaattactctcaggaatgtttttaattttcagtgtacaagtcttgcccatcttttggtcagatttatccccaagtattttatatttttgatgacattgtaaatggtactgtttttctaatatcagtttgcatttgtttctcgtatttagaaatacaattaatttctgcatattaatcttgtaccctgcaaacttgttaaactcccttactagttttagtggttttacagatttttatcagatttttatataaataatcatgttgtctacgaatacagaggttcatttctgtctttccaatctggatgtaattttttttcttgctttattgcactggctagcacctccagtacaacgttgaataaaagtggtgagagccaagacatccttgctttattcccaatattaggagagaagcattcagtctttcattgttaagtatgatgttaattttagttttttcatgtatgtcctttattaggttgaagaagttcccactattcctaatatttctgagggttcttaacatcagggacagatgttgggtttagttgattgccttttcaatatctattgagatgatcatatgttttcccttttctagttcgtcagtatggtggttatcaatacagtaatatggttaacattttattattattaatgctgaattgcaaaacgtaatttctagaaaaatggaaggttagtcacagttgtgcctcaatgatactagattagagtgagtaaggtaaataaccattttctttcctaagaatttttttttttttttttggaatttcagttggctatccctgttacaactgcttttgtatctatatttgctacatccaactgggttagtattgaactagcgtttaaaaagggaaaaagaacagtgaattttaaagttggtatgtaacttaaaatgtgaccccaaatcatgatccctgcttgaagaattggtcaaaataaataaaaatggatcacatgctctttaatgtcactgtcttgtctgaaatcaaaccttcaggaatatttatctgaagtcttttcatgtagctaaagtgcaatcatcttggagacttattttccagtaacatgtcccagagatagaaatttatctaaatgttatctaagttctttatagcctttggcacatggtgataatgtattaagaaacaaaagggggaaaatactcaaaagcttcttgcaatgagaacatttgtcactggtatgtgtcatgaaacggacctgggcatgcaaccaagttaagtaattacactggtctcaggccaatttaaattgtgtgctatagaccttctatgtagaaaatagtccataggttctgcatacaagcatcacatgcaaaaaaacgtgatatgaaagtcttttgttccccaagaaggacctgaatgtctgtctgtcgacaagacaacctctgtgggtacctcactgacatagtatacatggtgaaaaagaaagtgtcaattggttgtgatcatgatcagtaaaaacctatttggtttataagcctggatccaatcacactgatatcattctggactcaactgtcctttgtggttcaaggacataagaaaactgaagagaaggcttgcaacttggatgttgaaaagaaatttattgaaaggaacaccacttgaataacttttactacctccaaaaagcagtatgttctctctactggaaaagacctaaatacactcaaaaagcttactggaggattttttcctattaatttgaacgtcgtataggaacacaaaatttggttaaatatttgatagataagtttggtattaaaaagtccacttggttcattataaatattaaaattaggaacatgtgttctttgtttaagcctgataaagctttagctgagatcatgagttttcataaaacaacttttcacaacacaataatgtattaggtcagggtctactgccctcctgcagattttgcctgatagtattttcatacaaacctcatcactcctgctttttctcagatcttctctgagcttatttcctaatgcaaatcttgatttatatcagggccctaacgtggctgtccaaaatacctccctcccccaatttgtgttttatctcaatacattacccagtggtggcccagcatctcagagtgcccaacatgtaatcttagtctcatagggataaaggaaagcaaccatacctcagggcattcatcatccctgaaagtccctctccctgtcttaccatgctttatgtcatcatctggctcatttatttatttataaatagccctccactcaaataacactcctgaagggtggggaatttttctactttgttcactcatacggagtaagtgctcaaaaattgtgttaaactaatagcattcagttttagtaggattagttgcattaaaaatacatctcctagaattaagattgcataatatgttactgaatagttcggcttctttgaaggtatccttggcagagacaaggttagttctccctgactcaagcagagatactgttttctcaattctcttgttcgactaactcctctctgttatttattactggagacagacagtatccatcacttctcagattgatgcaaggcagtggtaataaaataagctacatacatcatgtaatcatattggttttatgaatcatatttttctgaattagggaaaatagttgttttggtttaagctggagaaaaattctgactcatgtcaacaaatcactgacaaggcaagcactgataaaaataaaaagcttaaagcaagttttattagagaaaacttgcaacaactctacacaaacattgattaattataggctcacttggtcttctttaaaatgaaaatacttttaaagacatgactgtatgtcaacaactaaagaacaggatatataactagaaaaataggaatatttatttaaaatgttatactgcattgtgcttttttttaaagataaaagctatttaaaaatgaagcaagctcaatttgtaattaggacacacaattcctcaaactctgtaagtctattaccttaagttgcccttacttaaaaaatttattcttatctgaaaattatggcaatgtttaaaatgtttaaagaaaacagtaaatttgtgttatgtccccaatttttgaaatttacattttattttcatcatactgaaaacctgatgctgaccttggcttcactcctcgaggtggtatgtagagttctgtgaggtcattgctgtggatattcagcatgcactaacagtgcagatttcctggtgggtcagggctgagaggattggagagcaacactgaagtgtataacaagagaccagtgcaagctttgatttgaaagaaggcactaaatatggattcacggcaacaagtactatcacatggaacacttaattatttttctttctctctttacatcttaagcaggcaaagtcaacttgctggaactgggctaagtttgggagtggtaaaaacaaaaagtcataatcatccagtgatttttaaaattctggtgtgcgtcagaatttcctagaggaatggttcaaaatatgattatctgagcctcatctcaaaactacctaattagagcctctcctgaaagaggctgggcatctgtcttttaaaaacctcattccaggatattgttctacttaacactattcaagagctgttagttttgactcacacttactatgtaccaaggatcatactaaatcacttcaatgtactacattaactaatgatcctacaattctaggattttggtattatttttatatctattttacagaaaagaaaaaaaaactttataacatttccaaagccatgtgaccagtaagtgatgaaaccagaatcacctgacttcaaatcacacacttaactcttatacaaactgcctccaaccatatggagtatagtgccccctataaatgtagaccgttgctgtctaagtagaacctagagatattttacaaaattcagtcccaaaatagtgctactatttttatttactaactgcaattgatgaggaaagtatatgcattgaaattcagtctttaggactccggaagttacacaaggctctatcagacgaaagcctaccagctatatcaagtgcctactgtgtgcaacgcttaggaaagttattctctggaagttgttcttttttttccctcaacttttcaatacaatgtttgagggtaaaattgctatctggggcaaagaatttctgcagatgttactgttactagaatgtgaacaatgattctatggatttgccactgctataaatacaccaactggaaagctttcaactcccaggaaacaggatttggaaagtgagacaggaatacccagctgagaaggtaatttaggtagacacaatgagaaagccttaattcctggcatatttctgttaacaggcagtgtgggaatggctttatttcacctctgagagaaatccaagcgatggattgttttatgagatgcgtgtgatcacaatgagaatttccagtttcctaaatagaacacttaacaagtgttcgtgaagcttccagcaggtcacaccattttaaatgcagcacacatagctcaacactgactctctttaattttgctttctttcactattcttggaggtacaggactaaggaacccactatgcctcacttaatatcatcagggtttttagtcttctcactggttttctgaagcatggatttttgcagttcctagtcaattaattcttggagcttcctttgtcacctggttgatccagctttggtagcactgaatttctctctagaccatgtgttctttatcagagacgttcaaaacacgttttctgaacaaatgattaagtgaatgaaagagtagatgcctcactaagcagcacatctcatactcccatatattatatatgagcagttccgcctgtcacaaagctcctccttatgttaggcatgacagtaacacgaagtcttcatttgactttcctccattagccatcattctgcctttggagagctctgcaaacaattcttccccaggacaaccattttagtagctgaaagaagttattatgaactcccaagtcctaattattcttccactttcttatcaatttcttaaataatatgacctctagatatatcacaattttgctcctccttctgtggagagagcttaccaatgtcgttattaaaaagtggcactaaaaactgaacacaatattgctgatgtgaacaagtggatggttctgcatcttaaatggggattatggcacctcccttttaaagctgttacatggaaatagaatgatggtcaaatgccaagggcacaacaatttaagagatgggactcaataaatattggtatttgtctcatgtcatcattatcatcattaccatcaccatcatcttcatattacctaagtctctcacagcctgtatagttgcaggtgttttttatttaatgtaagtgccacatactacatttgtaaatacacatacattgtttttccctttcagaaaaatttcaatacttattcttttttttcaatgcaaaaataaacatccgatgttttcattaaaatatagattaaatattagccagggaacaggggtcaaccttgtcctccaacatgacattattctccaaaccattatgtccactgcccttagttgctggtacagtttacctggcattagctgatggacttctgaaaatataatttacttttaatgagttgtgtgtgtttcatgttgtggataaccctaaacaaataaatgtaaaactacaatttgatgtccaaaaataaggaagaatgggatttgcctaaaatcagacgtttattaaataacaaggaaatagctttcagctatattaggtatcttaaaactcttaacattgttttgaattcactttgatgcgtgtctcactgttaagaaaagtgttaagacaagtgaagaatggtttgatgttaaatggatcatggaacacaggagatcatatttaaaagggaggttttcctccattttcaatatttcctaaacttaatctcttaagagtcttctcaaaagaacaatttatgaactctttaatggaaatgcattaaaataaaatgtggccgacctcttctttccttgtagcctcagaacactctatcagtcactactcagaacaaattagccaatttggctgtgagttacccacagtttttatcccttcactccaatagcctggatccctggactgcccactctaaccatgcaggcgggggattgtgtgtgagaaggagccatgcaagccacagggaagaggctgtaaactccctgaattgggagctaaaaaccctttgttcgatttggctctgtatatttttcaagatcatacatctacttatgatgccaatgaatcaatttcctcatctacaaattaaaggggatatgagacatctttatttgcaaagtctttctgtcgtacaaatccaacagctgtatattttccttttcacataatgactttagcatctcatggacaaacatctgttaaggaatgtaattgttttttctgaaatctcggtgtatggtttgcacaagtaaattaagacatttataaccagtataaccatgtatatcatttctaactgggattatatttttcagaaaagaaactaaacctcaagatttgcatgctaaggcagacagtgatctataaacagacccgaaggctctcagtaacgcatggggtctgtgggtccttactatctgtattagtctgttctcatgctactaataaagacatacccgagactgggtaatttacaaagaaaagaggtttaattgactcacagttctgcagggctgtggaggccttaggaaacttataatcatggcagaaagggacgcaaatacatccttcttcacatggtggcataaaggagaagtgccgagtaaaagcgggaaaagccccttataaaaccatcagatcttgtgagaactcactatcacaagaacagcatggaggtagccacccccatgattcaattacctcccactgagtccctcccatgacacgtggggactatgggaactacaattcaagataagatttgggtgggaacacaaccaagccgtatcaccatccatgtaacaaatcacctgagatactagtatgtaaagtattttccactcatttaatcaattcacaagcatttattaaacctctactgtctgattcaactaagaaattctgctgtcactcattagtcaacttagggtatgctggtgaatctctaagcaaatggaaaggcctatgatgactctcactagaattgacatagcaattattcacaaagttcacatatttttagcagtaagtcagtttctttgaccttttttacccatattatactgcactggatgagcttaagaaaagattatatcagtaataattttaggaaggctgctgtgtggttttgcatagtaagaaacgagttttccaggtatccctgggttcatcagctaaacttcttgaatcagaaaactaatttattaacctttctttttttcattccatggaaccaccccaatatcttcaactcagtaggtaatccatatataatttttgaaggaaaaggacaccataattttctcacatttaatgccttcacaagctgggcagtgtggttcacacctgtaatcccagtgctttgggaggccatggtaggaggattgcttgaggccaggagttcaaggccagctgggctacatagagagacctcatctctacaaaaggttaaaaaaaaaaaaaaaaaaaaaaaaattagatgggcatggtggtgcacacctttagtaccagcaagtcaggagtccgaggcaggagggtcacttgagctcaggagtctgatgctgcagggagctgtgatgacatcactgcatttcagcctgggtgacagaccaagaccctatctctaaaaataatgataatgataataacaaaaataataatgccttcacaagtatctataaaaccaagtttgaacactaccaatttaataagaaataagatgattataataaatgccacttatatagtgcctaccaccatttattgggtaacacacacacacacacacacacacacacaccacacacaccccacacacagaatctcatttaatccttagagcaactctctctggtaggttttataattcatatttaaagataaatagagacatatttagcgttgttcagaaaagaagaggcatattccatttcatttttgctaaaattttagttcaataatttttataatttaaaattgaaggattatataacacttaaactaatgatggacagagattactgacagaaggtaggagcatttacagaaatattcttatttgtaaagcaacatcacataggcaactataatgcttttgttctcgagcttccagtgtctttatcatagaaaaattacaagattgataataatttttcttaaatggctgtgaagactgacatccattgcagtgtttccttgataaataatcatcctggattctgtcaatatttccctttcataatttgatatacaaatggatgtaacttaagactttaagacactattactgtccataaaaagctcacaggtcttgcaaatagaattgtcatgtctgaatctcaaattatttcttcacctggtttttaaaaaaggtcaatttccttagctaaaaataactgagtgattaatctattcaacataaaacaaatctggattctgacttacttgcccatcctaacttcttttttcaatccccaatttaaatttctattaacactcattccgtaaatatttgtctggcaaaattcaagtaccaggaaacagcataatgcaaaattaacagagtagcactataaagaagcatatgacccaaacagctgcaactcaatgattatctgtcccaatgcccagttcctaaggggggaaatacaacaaaaacaaaccctcctacccaaacggcttccgagagtgtttaactagatcctaaatccattgctgagatttagaaatatttttaaatgtttaagggatatgaagtgatgccagaaaactcagtctcttatcaaggtatctatttcacttatgaatagataggaaactagtatgagaaaggtgtttcaggagtttaattgtaaaaaaattataagaattttttaaagtctgtacaaaattttgcttatttccgtgcatacttaacttataaatagagttactatgccatttatattccaaattgcaatgcttagcaagttaaaggtggggggggggctgttaacaattacagtatgtgtaaaccaagattgtctcatgaaaaatgcggcatatagtcaccctacttataaataaatttatgtaaaaaggtgatggagatattctaaacagaaatccacgagattgaaatatgatgaggtaaaaggaattagtgaagagcttttaacttttagatcgatactgggttaaaagtagaggtagcatgaattgatactctaagtgagaaggtaagaagggcttacatttttaaagaggggaaacgctcacaaaagtcaaggagtgggaattatacctggttttgaacagacaactataaaatggggttcaaataaagatggggctatttcagaggcacttcctaaaccaacatggcaagattatttaaatttcctgttgtacacttaaacaggatcaaacattccatttctttcctaactcagaagtattcttccccttgttatcactacgaagggaaatgtcatagattcctgctctaaatatgattcaaagtgaagtagctcatttgtttattaaaaatgtagggttttagtctccacaaagtggcaattttgttcatccactggggagaattaagttattagtttctctccctctctcccttcctttcccttcccttccttcttccctccctgtctttctctctctcttttattcagaggcatcaatgtctcaaatcttaagtttatcaggaacatactacttttgattccccacaaaggttgcatcttgacaagttcttggttgaactagaaatgtcgcagtagcatgttttgctattaaagcacacctggaggaaaagaacatcctctgatggtgcagctgtttccagatgacctccttgcagtgcaacaaccaaatgactgcaaagatgatgtggctgagatatggccctggatctctcctctccatgtgcccttctgtatcctaacagcacttccacactctcttctccaaggaatccccaccacatcccttctcactctttccttaataatgatccaatttatttatgtgaaggcccacttcctccccacagacagagtctgtagagaaaaaaaaaaactacaattaattccttatagggaaaacaacttgtattttctcttttatgaccagaaaaatagcagacagttttccttgtgaggcttcagattgatgctcaatgatgtagaaagagcataactctgccagccctagtaagtgccatgaaaatacttgaccttttgaggtagggcaggaagagaatgtttcttgagagggctgccaggcccctgaaaccaggaaaaagtcccagcctggcccagggagctgcttttcccttgcaaaccagtggagcagataaataactgggctaatgatatccctgagaaaggctaggcataatgactacattttctagaaactcattattcaatttatgagcaacctaagcatataagaaggctgcaccttttcatattttgtatctcattgttatattacatgttatattataataccattaaaaaattgggtcagtttctttcagatccagtcttaaaacctgaatcaatataataggtgtttgatttcagtcataaaaaataagcatctcttgggccgggcgcacgcctgtaatctcagcactttgggaggccaagacgggtggatcacaaggtcaggagatggagaccatgccggctaacatggtgaaaccctgtctctactaaaaatacaaaaaaaaaaaaaaaaaaaaaaaaaaagtagctgagcgtggtggcaggtgcctgtagtcccagctacttgggactgatattcgatatttctttaagtttcactatcctttataggttacctagaatgggtaaaaaggtaaaatgcacattaatgtacacatgagagttcactgctgggcctccataatgtcaagaagcatgagctgccttcttcacacgcccacagggaaagtcagcaactcacctgtcctgagctgactgacaagcagatctactgcaccttctatcagcagctgtgcaatctgtacagtggtgaaactgaggatatcttgtctggatttttcagacaggcctaggtagcaaaactataggactcactcatttgcaccagcctcttcgaactcagagctagggaccgcagcgtggaaaaggctactggggtgcctgcccatactctctgttttctgtttaccccttattttgtacttgtctttgcctgtgctgctaaacctcctacttttggtacagtgcactatgtaaatcaagagaacagatctcctggccaagaccacctcataatatagattagaggaaagatcaaaaatagtcatagcttttgaaaccacagtgcttctatttgaaaggctccaataagcagcagggaagagataaaaaaaaaaatggtgaagaaagggaacatcagagagttatcttactgttaaaaacctttcttctctgccttggtcttttcttgtcacagcccactcattttgcttccccaccttccttcttaactatcctcttcctctctttctctttctaactttcgaactgccaagagttaaaggaaaaggtggtccccttgtccaaaatgaagagatgaaacaaatttctggtactgatcaatggttatggtcatcactactatgggctactaatggttcttgacagcctagtaatgacttgcatatttaaagaggactcctttcagtcacttccaggagggcctgtgttttaagtattctcttaatctaatctgtttgatccatttaaattgacgatgtaaatttaaagatgattgtgtggaaacaagagaaggatcctaaccagactgcagaggtattgatcccaaggtcagggctcattagtagaaattgctaatggtccaagtaatcttccaagctcactgtacaatattaggtcctccataggaaacaaaacattacttttgtgtaaaacaacttgtaacaacaatagtaatacaatatacctattttaaaaagaaaagaaactacttacaattctactactgtcttaaattatataattttaatttattccctttcaatctttctcatatgcatgttatacatttgaaacctataatgcacaaataattgtatgccctgctccttcttaaatgataattacatttctaatttgatagtcttcatagtttttaaaagttgcatgattccattgaatgacatacaattcacatgaacattccactgttacaatactggacctttgaattgttttgaaagaactctgtgaagtatgtttgtgcatatgacattttaacatttcacattattcccctagaataaagtcccaaaagaggcattatgtgtcaaaggaaataactgtttcatgacacttaatacatgttgccaaatttcgcagcatagctttttaaaaaacgttgtgagcatgttctttctgcaaatcactttgctagactgtgaggcacaaatgaatgagtttaaaatacagtgcttcaccgtggaatactatgcaaccataaaaaaaaacatgttctttgcagcaacatggatgcagctggaggtcattatcttcagtgaattaatgcaggaacagaaaatcaaatactgcatgttatcacatataactaggagctaaacattgggtacacatggacataaagatgagaataatacgacactggggactccaaaaggagggagggagaaaagggctgaacaactacctattggatactatggtccctacctgggtgatgggatcagtcataccccaaaccttagcatcatgcaatatacccatgtaacaaacctgcacatgtaccccatgaatctaaaataaaagctgaaattatttaataaataagtaaataaatacatgcagaaataaaactgaaaaaaaaatacagtatttgccctgaaaatcatataatacagttggggaaataagacatacacatgtgaaaagagaactaacaataccaaccacaggaattcagagaagaaagaaaaagagcatatttagcagaagagggtaaagagttagacttttgggatattctgaggtttggatgagttgaggtagaaactattcaggtcgataaatagagtaaaaagaaaagaaattaaccattccaaggaattttctgtgacttaaaagcactatgtgattaaatttaatgtattatcctggtccacatagactccccaaggatctttccattattagtaatagttattctttcacctttgtccttgaaacatcgacttcccccgttccatttgatgtgatactgtggaggtttatctcctctgcctctaatcagtccttaacttctttcttttaaattcatcttcctccaaccaccaccatgagaacatttctcaaagttctcctgcagttttctccttctttatatatttctgtaggtaatgtcacctgatgacttagctcttgtcattacttcttgctgcgaatcccccaatctctattttcagctctcaattctcatttttgttcgcatacatacattttccactgcctcttacagcagtttaaactagatatcccaaactgaactctttctgtggtctctagataatctgaaagcaccacagttcgcaagcgtgtcatctttcaggtctctttcatcttcatagctcacactgaatcagtttccaaatttggtcccagcttcccagtgacttccaatttcctcctattgtaggtgatcaaaatctcccacctggactattgcaagggctcccccatctgatctgcttgcctccagcttcagccccttcaatctgtggtctacaccattaccagttgccttttaagagcacagagtagattatgtcacttgtctgcccaaggacttccagcaactctagaaaaccagcaaagcccaatccagacacattaatgtatccctcctggtcccttatggtttcaactcacactacttctctattttcatctcctcacactacaacctcacacacacacacacacacacacacacacacacacacacacgcactggactatttaaaattcactgaaaacagacaaactttcactcggccaaacctttattcctgcagtttcccttgaatgaatactctcatattctctggcccattgaaaccttacgcaaccgttaggtccaaccaaatgttatcagttccaacaatccttcccagacctctgtctccacaatctgaagtactattaacttcctgtattttacagcactgaatggttaattttcttgctgcctgtgcaactacaatgttccctttctggaggccaagttaataaattcaatacatccaagtgtgtttaaattttttaatctctttggccaagggctgaacttcctcttgctgtttgttaaatggctattggaagatctcttgctaaacctgaaagtatttaagatgttcaacagaatcctcattcacagatgtgaggaagaataagagatggaaagagaaaaggatttaagttactaatgatttttctttccaatcagccctatgacgtatcttcaaaaccaggccaagaattctcatcacttgtcatgacgagtcccttagcaaggatagggtgctgcacattcaagttcttgttttaggctcttgctcccatcccaggcccttgcttaggtttaaagtgagagctttaagcagggaagactcccaggttgcaagtattcctcaatcccatcccactgcatgtgatgctgactggagtcctggcacgctgtcacagatcctagcataaaaataacctgaggtaggatagaggggaaagagaggaagggaatttatgaccaaccctccagctttatttatcacttaccctgggaaagtactatgtaataaaaagggggggaaaaacaagacagccaagctatttaaagagcaggagctgaaacttcagaagcataaactaatgtttctaactaaaaacgggtgtggagcttaaaacttttcaaaaagtagatgctagatgcatatcttaataaaaatgaattttaaataatatttttgaatggactatcctacgctatttattaggactaatggttattcccaagacccgttctaacttctgatcattagaaggtaccatatttttccatttgcatagtagaggcaggatgatagtatatgtttttgtctgaagtgagactattaaaggaaacacattaaaatgatgaggataaatggtcatgtgtcatcaaggccagtccttcctgccattctttaagctgaattcccataaaatttagttttacctctttgaaaactatgtgtgttgttggactaaacgtaagaaaagaacaaaaccaaccagtgaataataaaggcaatgtctaaggctgactacatttggtatattaaaataaagtagaaaactggaaatacaagagtagtattcctttatgttttctaattagtcatttctgatgttttccctgaatttacacatcagtccattattccaagcagggacacacacacacccatcaataaattactattataaagagaggtaattgtctatatacaaaataaatatactactagttgcttatagttgcaaaggtaaatgtggaaattctcttcattttaccaattaccagctcataaaggaaaaataaagttaaaatatattctctttttgcacagactgctaaataattgactgatcatgattaatcaagtaaattgaggcattctggaaaaatgacaaatggcaagatttactgcctctggaatctacggcatttgctaaatataacttgcttgtaactacagataaatatctaatctaatacaatcgagttacctgcaaaccagagccacatacaaaattgaatgaataaaaacgtctcaaaagacaataaatactttctttcttccaaatgaaataaaatcttatgataggttttgaggagtacacgtagatgctaggagcatcagctttgcaggcctgcagacaagggttcaaatcttggctctaagcctctgattcctacctaggaaaatgagggtgatattatctatggtatgagattgttataagaatttattgagataattcagtaattgccatatagtgtgctaagcttagtgtctggcacataatacattatcaataaatgtgtcttatcattactattgtcattatttattaccactagtgagaggctagaaagtgaaaagtctaaccaatgcttttaacttcattttctacagaatattcatagaatattcatagaatcataaaacacacacacataatgcctactatatttggtacttgtctgtattcacttctatgacccactttaatgtatatgcaaccctacagtaaagaacactcccgggagaataaaaaagtgccctttatattagcaaaattttatgtgagttaactgcataaaataggatgagttttgtactaaaactcatcaattatttttcattagggtggctttttatttatttattttattttatgtttattttttttttgagacggagtctcgctctgtcgcccaggctagggtgcaatggtgcgatctcggctcactgcaacctctgcctcccgggttcaagcgattctcctgccttagcctaccgagtagctgggattacaggcggccaccactgtgcccatctaatttttgtatttttagtagagacagggttttgccagttggccaggctggttttgaactcctgacctcaggtgatccatcagccttggcctcccaaagtgctgggattacaggcgtgagccaccgtgaccggcctaggatggcttttctaaatattttcgtctatgataatttttctctccatgtatttatttattttcagacagtttgaggttacagtgagctatgatcgcactgtctggagtgcagtggtgtgatcacagttcactgtaacctcaaactccttggctcaagtgatcctcccacctcagcctccctaagtgttgggactataggcatcagccatagtgcctggcagtgagttttctaaacagagatttactaaaaggcttgtgtagtgacttggcaacaccgtaagtattttatttctaaactttgaatgcctttctaaatgtcacaggctaggtctacgtaattccctttacagcaccacatgcaattggctgtttagaaaatgctttttgaggatggtgaagagctctgtttttcattaagtggctttgaactttgagactgcaagtcctgactctggatttaccctttacttcactacataattcaattcaaacagtcaaatgatatcctctttctgcaacatgtgtgtggggggaggacgggggcggggggcggtgtttccccttacttatgtatctttatcccgtgagttcattttaatgaaagaactccagtcttccctcaacttccttattctgaccttgtgctctagtactaagtagtgacgccagggagaaaaaaggctggtgagccaaaaatggcttaggaacataattctctaccaagctgcagaaaataaatgacagggttggctgaaatccaaaggtcaaatatatacaggctttcttatgggaaaggaatgtcaaacctgtttaaaaatcctgtgaagtgagtttataatccctgactaccaaaattaaccatccagctgaatcattttaatatttccgtgaataaagtagattgattagcttttccagagttatgtgttatcagataaacaaaccaatatattttaaataaatccttttgacccaaatggcatggtggagcacaaaatgcttaaaagatgccctctggacctcctaaggtttttcataggaaaagtaaattagctagactattttcctttctgcacaatgcaatacaagctgaaataaaaatgtagctttctcttccttagtcttcttttttaatgcttctgaattatgttagaattttagagcttccaactggattaaaaattgattcagcagaatggtaaattacgaaaaaaaatctcttaacgaaaatacttgttgcactcagttaaaactgtcttttaggccgggtgcggtggctcacgcctataatcccagcactttgggaggccaaggcgggcggatcacgacgtcaggagatcgagaccatcctggctaacacggtgaaacttcgtctctactaaaaatacgaaaaatttgccaggtgtggtggcatgtgcctgtagtcccagttactcgggaggttgaggcaggagaatcccttgaacccgggaggtggaggttgcagtgggccgagatcgcaccactgcactccagcctgggcaagagagcgagactccgtctcaaaaaaaaaaaaaaaagaaaagaaaaaaaaaaagaaaaaagtgtcttttattcccaagctagcataagaatgttgaggtaaccaatgttattggggaaaaatctgaattctattcattttattcaagacctaggtatcccattgagcttattctactttgtggtagaaaatatatatatttttctaactctcatatcttcttaatagtataaacaagaataaataaaacaatttcaattttaagagtctccttatcattattgtagcataccatcacttgtcccctattagtttggagtcagtaatcatcacacaaaaaatatcaatatgggctgggcgcagtagctcacgccagtaatcccagcactttgggagctaaggcgggtggatctcttgaggtcaggggtttgagaccagccggaccaacatggtgaaaccctgtttgtactaaaaatacaaaattagccggacatggtggtgcacacctgtaatctcagctacttgggaggctgaggcaggcgaatcacttgaacctgggtgacagaggttgcagtgagccgagatggcaccattgcattcagcctgggcaacaagagagaaactccatctcaaaaacaacaacaacaaaaaaacaatcaatatgcattatcatgtatatccattttgttgcaacatcatcaacatatctatagaaacataagtgttagaattagctaaaaggagccttagagactatccacctgccttgtttctgaagtaaataaaatgaggtttagagaagttagtgattttctctgcattccagtccaatgtgatgttatcaatggaggaaagaaaaagtaccatgtactgaatattgtattaggcttttgatgacttttagcccagtcaaatactcaacgatttaataccaaaggcataaccatttcagttttatatagacatgacttaagtgtagtttaaggccatatatctggacaatgacaatattttttacagccaatgcatatttttgaaatcacactagaaaatgaaatgtattaatacaatttggataatatatatgtgcattaaaattcttaaaagcttattttattggtaccagtaataaaatcattatctgtgattctaccctggagaaggaagaagggtatgtcctgcaatgcactaaaagggcaggaatcatgcccttaaaatgtcctgaaaacatttttttcagccataaatatgaataaccaaagttgagggttacgcactaatggcaaaattatcagatcattgatcaaatgacgtgctattttcaggcaggcaataccataatagcaaagcaaagagaaatctaatttgcatctgggacatttaaaataaatatattaaagaagaactgttgagccagtccctcggccatactgctctcattctcagcctaaaactagtccctcagcctttagggggtgagggggcagcagtaggcttcatgtcacctaccactgtccttgtcttccccctaacctgtaccaaggccttcagtaaattcggtcatccctgctttagccaaaaagccaaaaactctactgatatcaactcatggatctcattctccaaagaggtcattagtgctcccattttgtaaacagtcatattgtgaatcccaaatgaatttcctgctaagataaatagatatagggaaatagttttggatatggatatgatatagatatacaatatccgtatattattttcctacaattatcatactacaactggctttcttttctatcattttagaaatttaaataatgtaaagacaaagcaaatagatgtatgcccataaagtttagcaatgtgctcatatatttttctaatttcctagaatatcaaaatatgaagaagcactgaaagaagaaacatctaccatatattgatgtatttcaaattcagatatggcttcatctggaaagcacactccctgtaattaagcaaaagtggttagtctataaccataattaaatttatattgtgttgtcaagttaaaactgtgaatactgtgtacaaccaggaaaactggatgggaatgactgacttaataaactaacttcttttaagaaatacaatgaacatagcttcctttcccttaattgtatttttaaaaatcatgtgaataatacaaaaatatctatgctacaatatgacagccctaaaagaacagaaatgggtgttttccatggcccacagggccagtctaggaacagccctttgctacaaactacatagatcatgaaactgacaagtgattgaaataaggtaatccttttattaacaggaaatgaatgtgttttgaggctctgcctttgtcatgattatctggctctatgtgaatacaggctctttgggaacctgatccaatttatatcagtggaatgagcctatcagagaaattcaagaaagagataagtgaattaagtttagaaagcactacactgctagttggtatatgaaccaagtactagaaagtcagtggggagaaaggaaaagtccatgaagtgggtaatgctagagctacacctcaaacaagttggtatttacaaggcagacaagatagggtggcatagttccttatgatgtcatgccatgacttaaaaacgaaatccctgccagtggtgaagagcaaatggctgttctctacaatgctccattcccctctaatctcaaggatgaatttggccatcctaattccactttatgtggtaccttaaagacatctgagcatcactggtacagcaactatcatattgcattgtaattgcctgtccttcacttgaaggtgggaaacatatttatatcacactgtaccaatgtccagtatatcttatacactcaaatgagtaaacaaattaatgaatgaataaggatttaaccaagacaacaaaggccttgcaggggcctctcttgtctgcaattcatcataatgtccactaaaaatctcagaatatccattttatacatggtcaggcctcggtactcctgagaggcctaaactagtacagagggctcctcaagagttccagataaatcttatttaaccataaggctcttttctgaaaaaatagtgtcacatcccttagggaagttatctaaactgaccttttcccctgggaatcctccagtcattggtctaggcttcatttctgaagatgctatgataggctatcatagatatagactgttaagttcactttcgttcacaaaaatacaggcatgaacctctgtgtactgccagcatgttccgctttaggatgccttaatatttttattcatgttttcttttttcatgaaaaaaataataaagtccatggtaatattatagactgtggtgtcagagatgtcacatggaatcttgactctgccactttctgtttaactctgggtgaattaactccctgagccacagtttcctaacctggaaaatggggataataatgcttactttatagaggtggtgaatataaaataagatgcacctggcataatgtaccaaattgatattcagtaactagcatccttaaagatgcctaagaagatatgaacctctttgtaatgcacttctagaagccaaccaatttttctcaacatggttggaaacaaggcaaatgttgcttctttttacatataagcatgataattgtgtaagcgttttaactaatgtgctgaccatagtttacagtgctgtgtaagttcaaaaatgtcaaacacattttttaagaatgggggaagtaaatacattcactgttttgaaatggtattttgatatttatacatcaaatgtagtattttcttaggtataaaattttagtatgtttatgcatcatcataaacagtgatattgttttgtaaatatcatactactactcaagacagctcagtcgtacagagtagttttattttctcacccgaggaccctaaattctataaactttaagaaagtacctgattctacagggaacccatgaaggaagtcaggtaaaaaaaggaaaagcaagaaaaacaacaaaccactcacctccatagcgcactcagcaatgcaatggtagttagcagatccaattaccagctactcagtggcactcaatggtattacttggtatggattcatctccttattttctgttttgcttttctctgtatactttaaccacaatctcctaaacctttccccctaggtttccattccatttattttcttgtgagttacactcctatattcctacttatgtccctaggaaaatgcaaaataattccttctattcatggagaaatatactatcctgatgattctatgaagttttcttatttcagttattgtacatcttccgaagtacaggataaacattacattccttgattcttctttttcactgtcagttctacctactatttaataatactaaatcatgtaagttagatgtcttactagtatttagttcaaaaagtcattttgaggtgtgaatatagaggaaagggtgttgaggcagagagagagacagcaatatggacaacatcacccagctcaggaagcaaaggcagcatctgaacttaggaaataatgagggtctgaaagtgctctgtcttaagtttctctctatctctctctctctccctcccatctccctcttctccctctccctctctctctccctttatccaataaggctacaattcagccagtagataatcgtagtggggtagcatcatgcatctttttcagaagacagagatcttcaaggattcatagcaagagaagcctggacatcctgcctgtaagacaagtcttgacatatatcaaaataaatttggcacctggttttactaatctgtaaacaaaaacaaacaacagtgtgtgtgtgtatatatgtctgcatgtatacatacatgtgtatgactgtgtgtgtatgccttaaagcttcttttctataactgggtaatagggaatgaataccagctattctgagaactctgagcctgctgattgaagattactctgagataaaatgcagcacaagtcaaccctcctggcccacaaaccatggtctttgattttatttctgctctgtaaacatcctcatatggcatctgaccctactgaaatcattcaacaaatacaagtcaatgattactgagactaagcaaaatcaacaagactataggtatgtttttcatccataagtgacaacaaaacaagttgtgtcataaagaagtcactagggatgattcttcctttgaaattagatggcaattatcttccataattggattttcttcttttagaaatttcctaatagatcctgaaaggtatcatatgtattacaggaattcagtaaaatgctacgttaattacacatagctgtgacttgaaatatttgaaaacagcgtgctgtatcttatatgagaacaactaaactaaaaatcagaaattaaaatttaagttacaaattagcatataatctaccagagtctctccaagccacagacagtgaacttccctggaaagcgaagtgttggcctcagatgatgggctgctctgtgctattgtgtcaataaaaataagacaacccacaactcagatcacataaacctaggatctgtctgattttcaagaaccaagatgattgatattactaaacaaatacccactacgcgcctctggcttcttctctcatgtttcttttagttcttagtaagcattgaaatgataggttattcattcctaagatgtcattatctgtagcaaccactgtcttgcagcctgcatatgcttcatgtcagatcagagtattctgtttaaagatgaccagtgattagataaaggtaatgtgcattctctcattacctctcatctagatagcggcaggaggaaaggatatcagaaggcagcagcactgtgagcctctctgatgagcagtggcaatccagttacagagaagttgagggctctctaaagtgaggcagtgccagaattcactttaccatttttatgtacacttggttttagaacttgttctagaaacatatattctaccattttcactgtaccagattgtgaaaagatagtaactgaagtacaaagtaaataagtatatacatgtatgaaaaactgctcagtaaatattaactaatataggttatgaaatagaatgcaatttatgattccattgtcaatatcaccaatgaatgtctcacacatgcataggaaaatttgattaagttcccagctcttactgatgaattgaggtaagggagtatgagttgggcattgtgaaatactttcaatttctaagacgtatctaaatagatggatggatagaaagacagacagaagttactttgtaactataaaaatcatgaacatatatcattatgcagaaaacaaatattcaaaatgcaatgtatcctattgcatacctattgtgtatactttcacaaattcaggtgacaaagctaggtcaatcaaacacaatatatttcatcactgcatgacttttcagagcttttaatgtgtactgtggatgtccactgactataagtagtcatatgaggcagaatacaaatgttcatatgcaaaaaaaccaaaaacttccaacggtcattgtagctcatatcctcattaaaatttgactctttcttttaagtcaagatatattgcatgctctttggagatcaaaaatggtggtttgtgattctgatcaccatggaacctctgaaaactataagaaacatgtctatttcaaacttctggtcctatttctgtgagttgatttggtaagctcgtcaagaagggagtcaaggccaggtgcggtggctcatgcctgtaattccagcactttgggaggccgaggcaggtggatcacttgaggtcaggagtttgagaccagcctggccgacatggtgaactctcatccctactaaaaatacaaaaattagctgggcatggtggcaggcacctgtaatcccagctactcaggaggctgaggcaggagaatcacttgaacctgggaggtggagcttgcagtgagctgagatcgtgcgactgcactccagcctggccaacagagtgagactccttcttaaaaagaagaagaagggagaaagggagttgggggactaggcacatcaaacacagttacccatgcccttcccaggtttagggttaggatttttgatacagaactctcttatcagaaggagagctccacaaggctcaggattttcagagtttaattcttgagactggcctgggcgaatctgtttcttgctaaattgaaagctgggtgtgagagtaaggaaaacggaaattcatcatgcaggtaagccttagaggcctgagggtaagaaaaagtttgaaggagttatttcagagacaatgagatagcacgcacccctctctctacccaaatacactggagacttgtactaaaggctttgattcctacacaaatatacattcccatgagagagttaaactttgagcttttattgatcatttcatatcctactatgaactgctttatgagatccatagtggagaaagcatttgaaggaacggatgcttaagagtagaaaggaatggagtagtagagagaagaggggttttgtttcccaaccagaaagtaactcaccctattgccttgtttggtgtgtactagctttgctttgtgtactccctggctctctttgccttatttttttacatacgggagtgtgagactgaaaattagttggcttcgtgaaacaagtcaattcatcttcagaaaaaaatctcaaagagcactaatgagtattttcaaatatatgtctcaaatttggataagtaagtaaataagtaaataaataaagcaaatggtagtggctaaaaacagctgtcttctaacttggccctgactaacttctagttagaatcataacaccatgactcattgaaactattgtggagtctaaatcaagtaaatgagatagtagttctgggcatctttgcaggttactctataaaatgaaagagttccttctgtggctttgttgattttgcaaggtctttccttggcctatcttctatgcattaaggatctttttgttagcaaaaaagttttattgttttcaaaatatgaaacaaatgatgctttttggaaagtttcttaattaccctaagcctcacttcttccaacgtaaaaattgcagttaatgtacctgcttctcaaggctgttttcaagattatataaatgtgtatgaatgcatgcttttaaactctggggttctacaaaagctattattagttacactggttttttgctggacttctaacattcacaggatgatagtgataatgggtcaaattccattgcatggaccatcaaggaaggacattaattcttgtacttgaagtagatttacctttaagcaaatccttccaaaattatgtattctatctgcctggagtgtggatcctgcttaggatattaagagaaagtatttaaaatcttattaaaaagtaggtagcatgacctttcagcatcatatgggagctatagacctaatcaaaggttatttagttacttagagaaggtgtattttgtttgattcactttattactgatacaggtccaagagttagtaaagtttcttgttaacctagtgaaatttgcctggtagagatacaaataatttttgtctagttgaaaagataaccccaagggttttagtttatggccctatagatattaactactcgtatctaacactgcaatcttattctaagatttattaaatggcctatatatacttagctctgcaaatgctctttaaactggccttaccatcttactggatctctaattaataaatgaataagctatttgacatgtgctcatttgatgtaggcaaatcatatttttaatgttttaaaaactatattaacagtgatacagaaattttgttgttgtagagataattagagtgggatttgttagatggtagaatatattctgatattgaaaagaatagtagtaaaaagtaaatgggaagaaagatggacgagtaagtagttagaaacaaagagtttctggaaattttaaattaacagtgttaaaatttgctttctttctatttcccccagggggccaacatgctgttagatagtttatgatgacaaggaatttagggaacttatttaaaaagtggatccttctaataattggaatatacactattgcaattgtattcaacgatactaaagtctcacacaataaacttcaaggtgcagtgccatttacttacactttatatctcagatgacggagacccagagaatcttggttgttactaaacagatcactcactgcaaatatgaacaaacgtgaactaaaatagagtattcggggttcttgatactgtgttaaacgtactgatcactttaagatttataactgggtaaaatgtgtctgcacagaggtccctcacagtgtacaataagagatggtaaccacgattccagtcataatctgaaattgttgcataagcttaaacttaaactttcagaatctcattttaattatgagtaaaatgaggatattggaataaattatttttttctttctcgggtgatattctattaaaaaaaggaagacaaaagatatatgattcaatgtaaaacttgggcaaaaattacttaaaaagggaagcagagtaacatatagtacagcctctaagagtttttgctgtgaatacctcttttaaactctgtttaattatgcattttctcaatcttatttggccataggataactcacttccacctcgtcttttcttgcccatcacctataaacatgtctatgaacatcaccatgaacttaaaactcaagttgtcagtaactctttgggaacttctggattaatcatctctgaagtcacttggaattctaagaagtcacttggaattctaacatcctattatcacttggctaacatcacaaattaccctaaatttacttagcacttactatttgtaaggcactgttctattcacttaaaagtgccaacctattgagatcaggtgacagtgctggagctcataaatgtcagccttgtatgtattaggatctgtaagattaaatatctgtgccatacaaaattgttcctggtaattatgcaaatgtggctacaatttttttaaagcacagattattataaattaaatatagacatatcataagttctgtagtgtaaaggaaaaagatgttcatgacagactgagaaaaatatgaatgggaaatatagtttgaaaattacattgggaaatgtatttattttcaaactactgtacttgtaattttgaatcaaaggctaactcccaacttctgctaatgattggatgagtcttacaaatacccttttccattttttataatagaatttttaagtgactataatgtacaaatccattcaataatcaattgaaggtcaaactacatgccagtacccgcatcaggtacagggatagaggtctcagaaagttcacagctttatgagcaagagagtgtgtacgatggcaatataatgaatcagcagtatggcagccagatgacaggagagatggtcaaggaaagcttccagggaaaataagtgaggccatagagaagtcattttttagagtaataaggaggtcagctgagggcatggcatgaaaaacatattccactagaactatttaaaatatcaagatgtcaacagcaaagtatctaagttaactcctttctcctgagacaatgcaaaggaggaggctctgctgatttcatgcactatttgcctgggatttttttgcatgattcttttaaggtgtcaagcactgggtctatgacaatgtagatgaaggaacatgctttggagggagagatttagcctaaacttttaaaggacttctatccaacccactcactgtccgtatagacacaaaaagaaagggacaagaaaccagattaccccaggtgtgtactacaaacatacaatagtggctttggttctgggaaagttcatctttgagtaagacacccagactcactgtttattttaatgtaaactattagagagaaaaatgtctgggagaaatgtactcaaaaagcatctgttgagaataaccagtcctatgaagtaatatttaaatgctgtgaaaaaaaattcacagagcttcaggtctcccattgcccttagtcttcatcagtctattcctatgtacacaagtttaaaatgttgaggacagccctcctaggaaagtctcactcagaattgacattaggtcctgtacctagcagcatctgaattcccagactaatcttaagaattcatggacctgatactcaaaactgaacattcagcatggtaatcacatgagatctcagggtacatatacttccccacccaatctctcttcctctcacacccacattaggaacatattgcacaggtcaggatggacaaattctagaggactctgggaatcatcttccgtattttgtttgtctgtttgttttcaaaaagtgacaagaggctataagccatggattttctaattttataactggttaagtccaagcttggaatgccaagagtcttcattctcatttttccagtcctgtttactactccagagtcaagaaactctgcacacggtggttgcttatgataggagtgaagggtagatgttttgacactccgtctcctgtggccacaatcaaagcatagcaagaaatttcactaggggccctgctgctcctctcactacactcctacctcatcaataacaacatctgtatttagtaataaacatgctaggaaaatgttaacgtgcttcataaattatatttccatttatttgcaaagaaaattgaagtgtgatagggtagaaaacatgttttataccacatgtagggaagcagtcagaagattcatgtgagcaacaaagctcaagaagattgtcagaacaaaaaaaatcataccattaagaacatgaaagactctacctttcagctctgagatggacagggccactgatttattcccagagttgttaataaatgaataaaaaaaagaaacagcaaatttgtggtaaagtatccctgactatgagccaatatactttgtaatgaccagaaaatctgcattttgaaaaccctctatgcagccatagaaaagaataagttcatgccatttgcagggacatggatgaagctggaaaccatcattctcagccaactaacacaggaacagaaaaccaaacactgcatgttctcagtcataagtgggagttgaacaatgagaacacatggacacagggaggggaacatcacacactgggccctgtcgggcggtggagggcaaggggagggagagcattaggacaaatacctaatgcacgcggagcttaaaacctaaattacaggttgacaggtgcagcaaaccaccatggcacatgtatacctatgaaacaaacctgcacatactgcacgtgtatccccagaacttaaagtaaaattaaaataaataaacacactcatcaacattaacagtaaaaaaaaaaaaaaaaaaaaaaaaaagaaagaaagaaaaagaaaaccctcaagtttcctgtggtcccctcaccacactgctcagaaccagaaagagtttaagactttgaatggattcatttcttagaaagcctggctgtacatctctatatttagggttgatttcttttattgcacacagtgagaagttgatgggaggagtgacgagatggctgagactcccctttcctaagcttttcttgcctttgtagagttgtaatgggcaatttcttaccacataatgagaaaacggacttgaatccatgctactcaaagcggactggcatccctgggacttgttagaaatatatatgctagggcgtttacctcatacttagtgaaattagcatctctgggcagaggactcaacattcagtgttgtgaccagcactgctttatggctacagcagtattcctcctaggaccatgccgccgtcagagttattttgaccctctctgggaagacagcaagcctaagtcaaggttttactctattccacaagagcttgttctctaatggaatttacaagtctggcctttcaagtacagtcccaaaaatggaatgcaagacacaggaaggcagagaggggaaaaagtctgagtgccaaacagagaagaatgacctctatggctaaattgttttgtctgcatcctgtctaaaggcaccaaaatttacagagaataaactaaaggaaagggaaaaaagtcttgtagctcaatgatctttctagtttggaataattttaaattgagcaataatctgagcatattttcagccagcatctgtctgtgttccacttagtttcagtctgacttttactcccctgggtaatcagcccacacacaagcaggttaggaatgaaaaaaataaaataaaataaaccctgcttatttcattttctgtttcccacatctccttttgtacatacatcaaagcacagcatgtgacagaaatgcttccatagcaccaaggcaatagatagcactttgtatagaaggttggtgtgtcttctgtgcctaggttcaaattttggctttgctacatactggctatttgaaatgtggtaacttactctctgtagcctatcgcccaggctagactgcagtggtgcaatcatagctcactgcagccccaaaccactggcctcaaacgatcgttccaaccttggcctcccaaagtgctaggattacaagggtgaaacaccaacctgggccccttgcttcttctaaactatcaacctaaccatgtaaaaggcagaatccctttgagaacctcatatgccatgcttcttcccatcacagggcctttgaatgtactatcgtagaagtcagcagagaaagaagagaatccaggcttcagagccagacagcttgagctcaatgcctggcttcagccttgctgtgtatatgacatacaagttactgagttatcctctctgactctcagttcccatatatgcaaaataagcataatacccattttacagaggtgttgggaatattccatgagaaaatccatgatttacctttagtggtactaagacttctaattgtctataacatctattggctttaatcgaatgttatactaacaattttaaaataaaactaatgaaatactttcgaaatattgtgtattaatttagtttatgactcttgaaacaaactccaagttttaatgaccaacaaaagagatctttagtgattaatcctgaatttaaagcaagatttctctaatttcaaagtccatacattttcatcttgaaatcaaccatataattaataacaaagataaggagataaaataaaacaatggcttacggtctacacattcttttctgtctaagatggcccacttgaaattataagcaatttaaattagaattttaaaagcatattctcaggttttaaaaaatcagctgtatttgctccagtgcttctttatttactgaaggaaggaggtcagtaatttgggagtcatagagaagctgaagtgtgtttccttcttaatttttacatgggctgaaatgttttcaagggctggaagacggcgtggtgacaggaagacaacgtggtgtgcagagagaagattgaactgtacatgaagaaatctgagttcaaactgcagttcccaccagctggaatccacagggcaagtcatttaattgctctgaagacataaccgcctcctctcaaaatgaggggttggcttagctaactgcataggctccttccagctttatattttgctggtcttgagaattgttagggaagatcacagtgactccaaaaagagaagatcagatctcctatcccatcaaagaacctatctaccgtttcagacattttaaatgccaaacccatacatctaataaaaaagctttttttctgaactctggtttttaaaatgtataacttcaagaaaaagataaatctgcgcaagaaacatatgacacaaatataatgcattttatcagcatatgttccatccctagtggtcacgtttattagagatttaggctgagccagggttggctgtgttctcagaagtacggggatgggtcttgcagaacctctgcactccggggtctcagggcagctagtgctgaaacgtgaccagaaagagtgaggacatgaagagtgccatgtcttgcccttaatgactcttggtggtttcaccagaaagacagagggaagcggtattcagtctggaggaaagaagtgggtcagtctccccacagtcgtaacacatgcatcacagtcctcttatgctttcatctgtcaggaatgggccttcatgttgttgttacactttgacctaatgaagagaaaaatgactcagaataaatgaatcttcccactaataaatgatttcttaatttcgtggtgccatgggcttttttgagaatctgaggaatgtggctcttcttctcccacaaaatacacataagcacaaaattgtgcacacagcttcaagggcttcctagactccttcatgcccattctcattcttcaggggctaacagggaaagaatccttcatctaaatgaaggaaaattaagagtttatgaaaacagacacaatttgagcacatcacaaatgtggtataagcctgtttttccatcaaatatgtcaagtctgaaaaaaaccgaagacatgtcttaatcaaatttgtagtctcatcagcatggtgccctgctcattggttacagtcgacactttgaatcatggtcattgagaaaagacagagtgggcaggaagagaaagaggcaaggaaaaggaatgatttaaggatttctgtggaaaatgttatttcaaaaaaatacttctgaggttaaagggaagcagaataaaagactttctagttaccagtgaagtcagagagacacaaatatgaatcctgctccttcctcatagcagctaaatgaccttgggtaagttcctctctgcacctcagctgttttctctgtgaaatggggttaataagagtatctacctcacagggttattgtgaggctggaaggagctaatagctgaaaagcatttagcacagtgcctggcatgtaagaagtgttcagtaagtgaggtatttatcaagaatcaaagctgtggcctacttaagatggtactatctgcaaaagtgccagccttaaaaaggatgtgaaaactaaaccaatttagaaaaaatatcatccttttaatattagaattatacataattctgaaaaacttaagattaattcacaaatcaaaaaagcttgaagaaagacaaaaaaagaaatatggtatttatccataaatataacattgtttctatttccctaagaggggaatataagcagtaatattaatattaaaatggagctccaaattaatggaaagtattcatttccagagatgactaaaaatcagagattagaatttctgagctttgctgtagactatgcattttcctaaactcacagcttagccacccttttattaattttttgttgttttccttacttggatgtttgtgtttatgtgttgcatgtcatatttatatgatgttttaaaatccatttgatctaaacaactcagaattctcttaaaactatcaacgacgccatttatcagctgggtatggtggctcatgcctacaatcccagcactttgggaggttgagtgggaaggatagcttgagcccaggagttcaagaccaacctgggcagcaaatggagactctgtctctacaaaaatttaaatattagctgactgtgttggtgtaggcctgtagtcccagctactcaggaggctgaggtgggaggatcacttgagcacagaaggttgacgctgcaatgaactgtgatcgtgccactgcggtccagcctgggtgacagagttaaactctgtccccctaaaaaaatgtcatttatcaaatggcatttatcaaattacaaataattttttgtgcatttaaaatagccccaagcaagcattacttctcacgcacccagacaagcaaaaaaaaaaaaaaaaaaaaaaaaaaaaaaaaaggcatttccatgtatggctgaattattactctatgtgtaaatttgtcttaacattagccttatataagtatatcttttattgtaaaagctaaaagatgttataaattataaaagcacaaaaactgcctggcacgtcactaatctatggagtataagctgccattttttgagtgcctagaatgagccagaatgtgtagtaggcactctatataaattatctataattctcaaaataatcatgtaaagaaaatattattaatattgccatttcataggtaagaaaattggggctttaagaggttatgtgacttgtcaaagggcatgaggctagtatatggcagagctgagaaatgacggcagctctgtctaaacttcacattctcatccttatcccattgcctataatgcaatattaaattattattctaagtaatatctaataaactttagacaatctcaggtaaagcattataagtggattttatctgggaatgggatcacccatcatactttgtatcatattttataacatttgtatgtcagttatttatattaagaaccatatcttacctaaggcagcgactgagtgtgaattttatttctgtgcagagtagacatctaaactctcactgaataaatgaacaaatactacagatttgaaacatgccatggatgatacatgattcctgacacctcacctcttccactcctcacctactttcccatctccctggttaagagtgagttcaagggatggagaatgtggagacagtgtttgcagtgagaaatcctgaaaaagggagaccataccaatcactagggcttcatcatactactactttttccacagagacttccttgtctgcccctcctgtgatgccgccagtattctaatctccaaatctaacatctgtccttatcaatgtactagagtcaagtagattggcatactgaatgttgcatccaaaaaaaaaaaaaagttggaaaactcatattctagttcagtttccaaccaagacagaccaagaactcacaaacaacttttggcatgcactaaaatctgcccctttctaaataaattgaagaaaggcagtgataggggaaagagctttgacaaagacagtaaagagctctatgtattacagacaatagcttgcctaagtatttgaggttgtagagatggtaggaatgaaagattcaaaccaacaaattgaagggactccccatgacctagactaataagcagtactgatcctaaggtgatgtacgacaatttcaaattaaatggttttctgagcagaccactcctatgttatttaaaacagggtatatgtgcattcataaagaatccaaatcttatccaaaagaagcaaaaagctaaaataaggaaacatgaaaaggtttttaaaaccaatggacgttgcttaagtcaatctagagaataattatgcctagaaattgtaacaagctatttcctatggaaataaatagattaatgcttcgtatttatccagttttcttcttttaaaattcattcataggcgttcatagagaaggaacttgcagttgtattgcaattttgagccagtgtgtcatgtgaacaattcaatttaggaatatactcatttagggaattaaaaaagcagaagttaaatttaacccagaaaattaagaacattatctctgaaataacattttccaaagctaaaaatatgccattatgtttattgagaagtgtttgatttcaaccaatgtctcaaatggttaccttatgcttcccgtgttattcattttattgggaaatggatgttctattcattgtccaaaggcttgttgagttctctttctataatcctcaggaattcaaagaagcctgtgagtcatcaaaactcatttccaaaactgagtgtgaaatttaatttcctagagattaggaaaaatatagcacatatctttggtctgtaaaactctggatgtaattttggctataggcaaagagtggcttaagtgacctttgaagaggatttctatgtgtacttaggatttagcctccaagagtcggcctactcagcctcttttgaaaagtattactgaggcagtcacattttagtcagtaaaatgatttttttccgaacaagttgactgctttcagaagtaggacgtggctttaagttaacaccaggattccacgttactaaggagaggcctcgatatgtctgttgcatccaggtgggctactccctgttctccagtcacgtctgtatccagtaagagctttccaactctttgtggcttatctaatacatctacgagaaaccagggagggttttaaaagctggcagggcataactctcacttacggaaggtccacaccccagccttatttttaaggccttatctttgatttcctgaaggggtggagctctcacagccttgcttttgtgttcaacttctgacttactccttgtgcacctataactttctattgtcaactgaaattacttgggaatcaaaggggtaaattgttttcagcactggataaagaaatttttgagaatgagaactttttctggaagcattctcctgcctgctcaaattttgttcctcaaatatgtgcttgctgtcataaccatgtctctgagcctccttaggagccaactcttgacagctaaagaaaaaaatggagcaaagagagcaatcttcctacagccctcgctgctgggggccccacccttctccatcgttcaacctcaaaaacttggcctcatctgtgaccctctcctgttctccgcaggctctccaaggcctgtagatttttcattatggaaaatggctctgacccattattaagcaatttccaccttaacctccctcctctcatgcctcattacaacatcgctaacatcaagtccaacattctaatattacaagtggaaaaaaaaaatgatctgagactgtgaactgtgagaactgtcgactgtggtaaattttaagcatgttataattctaggcctgaaaactaagagataacaaaagaaatgtaatccacagatgcccccttctttatgctgcctacctgcctttgtactctttctcccaaagtcatcttctgcatatccttttagaaacttgtgtcccattttcattttcccaatccatccacaatggcagcgaagcgctctaccatccttctacctgcacacccttcagtagaggtaaacctcttaaggagagggaggcaccagattagaatctacttcctcactgcccggtctgtcttccttggaaaaggaaaagggaagtagatattgaataagcgtaccattttacctacaaggcacacagtaagtggttgatccaatcaacacaatgccaggttgaacattatacacaagtcattttattcttgtgcagatgtttttataggaaagagccccagaaatggggttgcaagtcaaataataaatccacatgtaattaggttaaatattttcagatctccctccatatgcgctataccactttgcattctccctagaaatatatgagtgcctttgttttctcccaactttgcaatgaagtatgattttaagctgctggattgttttaatctcatgaaagagaaattgtttcttagtgtgatttgaatttgcattattataactgaggtgatcatatgtttaagggccatctgtattctcccttaaatttctgcatttggcagaaggcattttgtaatccaaagagctatttctttaccttcaagtcacactccgtgcacagcccacccatctgctgacctatgtaagaggtcaatgctgcttacacgtgttttgggactaaatgggggtggttgtggcatttgtgtcaatggagcaaaggacctagaaggcatcataattcacacagtcagtctttagttgatggcttggcagaagctgaatgaagtgtgtgaaggtgactctacagagcacagtagtaaggaggggttgcttcttctgtaagtttacatctcatgctattttgggatattgcctggatgacttgtcttctcctctaacatataatattcagagtgttttaagttgtataaatcttaagaaaagaaaaagggagaaaagaaagggaaatgctaggaaaaagttctcacatttgacaatgtgatttatagaactatttctaggcacatcttattacatcaaagtggcagtgtttatttttttacaaatgtgtaataataaggatcttgacaatgcacccctccctttcagattacctctagaaatatccctggaaaactttaagatgaggcaattgtggcataaagaacaggcatagagaaatgctttttgaagagtgtttgacataaaatttctattaactgttaataagcactttaaaaattgttctgttctcaaatacgtatgggaaatgccggatgaaataaagataagcaagctcttgtattgcaagaactgaaaaagcctttactatggggaggagttaaagtaatcagtgtcccccactataatttggctgcagaaaccccttctcccccaaaagcaatcaagagtctgatactgtgataatgctggaaaatgctgatgcagagggaaaaacatctaacaaggtgattccgatgattttttgattctgacaacaacatgcatgatattctcagtcacaaagcctctcagtgctcaggtcactcatctgtaaagtggggtactctaaaaggtcactttccatttttactttgacctataaggagggatgccctgcagaagacaggtcttcctgttagctcagccagtggctttcttggtccatttcaagggcactgttggaggggtgggagagacagcacttctatcatgccaagctaaatatcctgagaaagatcaggggttttctattataaaatataatagagaccttgacatgaatcctcattctgtgtacagatgttgagcccacactcttactgattaccacacactgacccatctagggagtggtttaccctgaggccaggtcactaagccagtcaaaatccagctcgctttaatttgtagtccatgcacgtaacaaacactggtccactgctccaggtcatcattcgaatgtcagtataaactcaccagtggtcccaagagttctgtttctttggcatttgctttctctggtattatgtgccattttacaacaacagaaatcctgatctgtcaatgtcactcaattattaacatttcctggggtgttctacaaaccccattaagtgggatttgctggaaaggttgatgctctgctttgccccttggccccttcaggcacaaacatggattgaacctacgacatgccaagcacctaccgagagctagaggtagagtcactgatggttacgcacatgctgttctttctgaatgctctgccacactctccacaaaatggagctgagatgcctcttcctccaggaagccttactgagcttcacctcctctcagtctggattatgtgtcctacccacccccagttaaacagttccttccacagatatcaaacattacccttatattcctacatgcctgcctccctccttgagggtatctctgctccttaagtgtgaagactaattccttaatcttcatttcctcagcatcaattgtagtgactgccacataggaagtactcagatttatgactgactgactgactgaatcaaggtatgaaaaaccaattcctgctctcaaagaccacagagaatctagttcaacttttctacatgactttaaaacaatttataatgcatttatgatgctttaaataaaaatcgcgtgaatacttccaaatatttttgaattataaacacattttcaaatttgcctttcattagaagataccaagaaaaaaaaaactgcctttcaaagatattggataatgttaaaatgttggtttcaaaatcacgtatggtccaagataccaagaaaaaaaaaaactgcctgtcaaatgtattggataatgttaagatgttggtttcaaaatcacgtatggccccatgcagagaagggtccagatgtaagaaagactaaaacacagctaagggagacaagcacttatgtctacttaaatcggcctgctttttcaggctgtcaactctcccaactctgcagcttccacatgccttgttaatgtgaggagaaaccaatgtgagacaatagcagtcatatttccagtttaattacagaaatgcaaaccttacatctccttaagcctcaattataaaaaaaaatgacaaggcacatgccatgttttctctgcttcttgtcaccaaccatcttgccctattataaacaagaacactccatgagtattcagagtataattctaataaactgctctcagtctgccagttacatctgcagaacacagcaagaagaacttttacgaatgtagatatagtagggtaggaggcacatgaaagagagttccagcttcatcagagcaaataacctgcagagtgtattttgataatagtcacataccatggaaaaaacattcaaaaatatatttatttttccttaaagaatgtaaacaggtcagctggctcgtacctctaatctcagcactttgggaggccgaagcaggaggatcccttgagcccaggagtttgagaccagactgggcaacatagtgagaccctgtctctacaaaacatttttttttttaattagccaaatgtggtggtgggtgcctgcagtcccgactacttaggaggcagaggtgggaggattgcttgagcccaggaggtcaaggctgcagtgtgctatgatcatgccactgcatgccggcctgggcaacagagccagaccctgtctttaaaaaaaaaaaaaaaaaaaacacaagatgtaaacagtaatatttctgtgctcagtgtagaagtaatcttctcacagaaatacctaatgtagacgacaggttgaagggagcagtaaaccactatggcgtgtgtaacaaacctatgtaacaaacctgcacgttctgcacatgtatccgagaacttaaagtataattttaaaaaaaggaacctcctctcattaataaccagcatatagaatgctgagctacatcactggatgctaatcaaatggattaaaagccctagcttatacgacattcctttagtgcacatcatcctctttaaggagagtacagttgatggcttctctctcccccttttcatctttcctgtttcctaactttagggagacgtaagctgctaggaagacagatcattgtttttgagttgcatggttcctctgtgctgccagatattttatcctgatgtgtttgtataaaaagggataaagggaaatccatcacaaaattattgttgctcagtgaatgccaaacaatacatgcaactgaaggaaaaaaaaaaaaaaaaaaaaaaaggtggcggtgctggtggtgacctagccctcattcctgttatgaatgggaaactgaagaaaggttaagaaaagcatttatccatccactcatccacccattcattcattattcattcaagaaaaaaattcagtagctatttaaggtttttagataatttctcaaatgcagataatttttaaaattaaaatctgggcagattaagacaaaaaaaaaaaagacccaccacattgtgccctatgtttaaatatgttctaaaaaatgtccttgtagaaacatctgcagcccacatagacattttcatagacatcttgacagcaaaagaacagtactatcgtttcaggtacttaggaacataaaaggcagtgaatatatcagaaatctctcaaattttgttttttagttcattgaagcatcaaggaaagaataagggatttggagtaagaacatcttaattttaaaacctaatccagtctaatcctatttattctctttattttgtggagctgaactgaggatcaattaaattaatgcatgcataaccatttggttcttgcatgtagtcattcacccattcaattgattgattcattaattcactcattcaacaatctgtacaatggcctaggtacagtccaaggtgctgctaggattctaagtttgagaagaaacaggcaagactcctactctcataaggttttttgtctattaaacagccaggggctgataaacaacaacactaatgaatttacaatgacacactgaagcgtgcactctgaaggagggatatgcttctacaagactgaaggcaaagaaccacacaaaaacagggatgtaggaaggactttactgagcaggagacgctttgtacctgagaggaaaacgagagcttactgggagaaggtgcgggggtggatgggggtggaacggcttgtgcaaaaacctcagaacaggagacaacacggtgattggaggaatggaaagaaggtcaacatacaaagctgggcagaaaagaagtgaaagtgaagctgaaggtggggaaggggtatctagcacgtacgcagctattgagcacttgaaatggggctagttcaaaatatatgggctgtaaatgtaaaatacacactttattttgaagactgtgaaaaaatgaaactctctcaatttcatacatcgattacatactgaaatgacattttggacattttgggtttgataaaatacattattaaaattaatttcacctatttatttttacttttttaagacgactcctagaaaatgtaaaggtacatacatgactcatatttttcttggacagtgctggtagtaagtacatgcatagccttttaagtgtgaaaaagggtttttgtcctgagcgcaatgagaagcattgggaggctttacgaagagagacaatgggatcttcgcagcttctgggtagaaaagagatcaaaaggcacctggaggcaatggagaaaaatgatctgtgtactgcattataacagtttggtttagggtcaagaagtagagataagaggagtggaaggatttgagagatatttaggaagaaacacatcaacaggctctagtaatgaattgagtatgttactgagaaaccccaaagggcagaaatcatgttgggaaaacaaagatacagagtatatggaaatatacaatttaagtcctataatagaggcatggattcattgcagtaggggtacaaagtaagaagcaagtgtgtgctttacataggataaaatattgctgctgcagcttttcaggtaggcttcattaaaaatcaacatctcatcaaaaatatgcattctggttttaaatatcttttacccagagtttaacttaaaaaaaaaaaaaaaacagatacataatgagtaacggctgtgcaagagtctgtggtagggctgctcttgaaatggaaaagaaagagaatgtttctttagtgcccactggcatgtgccagaagttttaagtgtttaatttatttaatcatcccaaaaaccttacaaggtcatgttactatccccattttagaggtaagtaaaatgaggctcaaaattgattgaagttccacgaagacagaaaccatttttattttgcccctccactctattcctaatgcccagcacactgtccagcatatgctaggcactccgtaaataaaggttaaaacagctcccaagaggtagagccaagtgccaaccttgcttatctaaatttgggatcatcatgctaccatttgtttttttaatatattggatagcaagtacatttaagttaaagctttttaaaaatagaattaggcatagtttatatatttatatgtggttaggctaacaggtatttatataagagccctttatctgtgacaggtggttatcctctaccttattgaataacaagaacagttaacacttcctgagaatgtactgtgtgccagcctgttctaagcactttgcttgtattatttatgcctcattctcagcaaccctacaggatagatactatgatttctctcactttagacactgggaaactgaggtacacagagctgaggcatacagaggttgagtcacttgcccaaggtcacatagctgtaaaggcaacaaacccaaggaacctaattttagaatctgcatcacactctcaacccctatgagacagagcccactactccatgagactctagttcttacaaagatctctctagcattagggcaaggtctgccctcttgccattggtccagcaccctctgctggggccacacagtgttgtggtttatcagggcacctccttgtaaatctagaaaatcattcaaggataaattgtgagtcagacatttggagagtcagaataaaatgagcacaaaaagagcctgtagatctcgtgtggatctcattccatgaaaagagcaaacttaccctgagtctttaaatgtccactagcaggaagctatcatttgtctatggtgacatcagatagagtagagaaaagaggtgaagaaagggacttagtaagttgaagatttcccaacagcagaaaccatggcattcgggtgttaacagtgaattcaagagacccttgttcatgaatggagtttaatggctaagatactctctaagcacactaggcaatcagtgcttgctaggagttcacataatgaacaggatggttacaaccagacatccaggcatttgatgtgtgccggttacttcaagtgtcaaattacttacaagttttcaattgtgatatgtaagagggcttattgctatgatttggaagatcagttgggcacatgtgggtctatatatgaacacttcacttcttccaatactttaaaattgttatgcacattagtagagctcctgaaggagcctttttttttttttgttttggaatagtcttaatattactgtaaacacttgagaacatgttcagtatctggccatttcatacaaagggacctcatctggtgccccatcaagacaatctgaagtgcaatcaagaactcattatgaggtggtctaatctgtagggtacctcactgcctataaactaagagcagcacgatgcttctctactgaatgatgtcatctgcagtcactgggaacacacggaggtagaccaaatgccctatatggtaagtggccacacgtatcgggtaggaaggattgcctctgcccaaattctaatataaatgagaaataaattcatttacaagagaatattatgcactgaaatgcataatttttcaataataattatgctagatagtcagatgtttatatcttttctttccttttttttttttttttttttttttttttttggagacagagtcttgctctgtttcccaggcaggagtgcagtggcacaatctgcctgcaacctctgcctccgggttcaagtgattctcctgactcaacctcctgagtagctgggattacaggcatgcaccaccatgccctgctaatctctgtatttttagtagagatggggtttcaccatgttggccaggctggtctcgaactcctggactcaagtaatccacttgcctcagcctcccatagtgctgggattacagtaatgagccactgcgcctggcctacatcttcttataatgactaagtttggaagtaagagaaaaaattgaaagccattctgtctaataggtactggaaaatggaaaaagaaaaaaagaaaaaaaaacttagatagatagattccagggacacaaaaccagtgttagcataaataatgacagcccagatttatttgtacttaaaaaggtatacaggtaaataatctcaatttaaagtaggaataacacttgcaagacaaattaccaactaccaaaataaagaaaggaagaaagaatgcatcattgtgctactattttttaatatatagggtagcaaattcaaaatattttaaaatgctacaccacttaccatttaatcattaataatacactatgttaataaaaatgatatatcttcatgtgacaattacagttgcaaatcaatacagaggtgttgtcttggtgactcaaatatcacaaaatgttgttgccttgggtgggtataatattccaaaattgggaataaattttggtaagtttataaaccaaataaagtataatctttcctcaatttacatcatagttgcatccctcaaacatttagtacaaattaaaacattgtaaaaactacatctttttgtacaagttaaattctgtgttctcataattataaactgaacttgtacttctgtggatttcttgggaatgctcagagtgacctagaactcaaagaaattttttgttatttgagactaccccatgcaatacagtttatctagccccttagttctgactaaatgtcctttctgttcctcctcagtccctagtatgaccataacatgtccccataaatatccataatcatttccccaccacccctagaaggtactgctttcattcaggactacagcttacaactcttttgtatcaaatttgtacatctgatctagaggaatgaaaaaggttttactactgaaggttggtattagatgagtcttataatcatttttcaccatataagttaagctcagagataagattcattcaacatgctttatttttttaatttaaagttaaagctcattgacaaaagactaagaaacaactgataataaaaagtgcctcctctccctttttctgaagtggtttctaaaagaaccactgcagggatgatgatgatgatgatgatgatagcactaacatttacttaaacagttattttgtgtcactactaaactatgtgctgtaaatgcaagaaagctacaaaacagacctccaaactcacttgtggagcacttgtgaagattagagatgatcaatgagaaataaactggcacatggtaaatgattaaaaacaaaagctatcattattattaaatcccaagctaccctgaagcagtaactcaaaaaaccgtgccttaccattatgtcagttgttcagtagttatttatttataccacagacaatatgtttcttaaaatatgcatgcaaataagcccatcagagcaaaagacttcctttaaatttgcccctttgtggcaggtaataatgacatcgcctcgcttggatgattaataaccagttgttatgaggactgtgcctactgacgcaaatacagcattgtatttgggccctgagttataacattcatttctttaaggctgattgactctgaacagtcacattatttgcttgttgagtttacgcaagacgtttttccaagggaggtttatttatttatttatttagtggcatttacatgtgtgcctctgacttcggggagaaaaaaatgaaagcacaatgtaagtagtctaaaaaaagggctaatcagaataaccctggatgttttttcaccatgttacctctgtactcatatcactatagccaatttttaattaaaaagcttttattttctttcaataggatagtaaaaatgtgcaactgcctgataagtatttgctcttagtatagcacacttttcagatatttttaaagaagtatcagataattaaaacaaaacatataaaaacatatcagctgatattattttctcaatgctcagtatatgaattaactgatgggaatatagagaaacaaaacaatttagaagaaaaatagctcttaagccatcaagtttcaaacatttcaaactcactggaattgtgcaatcactacgagtttgtgtgtgtgtttgtgtgtgtgtgtatgtttagggtaatacactttattgattcattaaaaatgtaagtacagtaagctggaaagtatggcaagtaaaacaaaaaaaaaacaattagaagatttctatgaaaactttacaatctaataaaattgaatcctttttttttgttgttgttctctccccaggcaattattttgctctgttcacatgtcttcacaaaatactttcaattttatttttccaccctcagataaacagattccttttgttcggcagatgagaaacgtaccagctgttagtactactatatccatccatttactaatatttaatgagaaaaaatttaactccattttcagcctttctttccctctgctcattaaagagaagcctgccctcctggaaagcccttacttgtcagcccagttcttgaattatttttaaacagaaagttaggagaaaataatacagtgatgaggataagaaagtgaaagtgctgcaatttttttttcttttaattttttttcttgagaaatgacagggaacagctttggagtgtgtgcaggtaacagatggaagacaaaaagagggattttaagatttgttgctggggcacatgtctctctaatcaagaaatcaagtaaagaactgagttattttatggtattattgtattgcatggcatgtattctttcaaccctgatgcctctctgggactggcccacactggccatgttctccatgagttatttatggtactttaccatttttagagtgtatataaatgctttaccttatttgaacctctgaaaaccacagggtaggcaggaaagatattatacccacattttacatatgactaaaccaaaaaaaaaaatgaaagcgggacaagaattcagactttctaccatagaatttggtggtccttctatcagctatacattgacatatcatatttttatacttaatttattgtgcatttgcttcagggctatatctttacacatccaaacatctaaataacctgtagaaaataaaatcagtgatttatgtgtttacaattatccgaatatttggtattcatatataacagagaaataattaactgcccatttcacttttcacctaacaatctataccttctgtactcttagaagtaacagcactgctcaagaatcactacggttgggggcaaggtgaggggctctgaatcccatttggaagctttcttcagaaatattgcttcttgtgcagaagtcatgggtcaggttttctgtttggttgatgacctgtctatacctacatttacacacacaaacatgtcattcatttgcatttaacttgtcagtctaaaacttgcttatttggccaggtgcagtagcgagcacctataatctaagcactttgggaaactgaagtaggaggattgcttgaggccaggagttcaagaccaaactgggcaatacggtaagatctcacctctacaaaaaattaaatatatatatgcatgatggtgcatgcctgtagtcccagccactagggaggctgaggcaggactgattaagcccaggagttcaaagcttcaatgagctataatggcaccactgcactctaacctgtgtgacaaaataagaccctgtctgaaaaaaaaaaatcatttttaagattaagaataaaaaaatttggatccagagaactaggacttcattcttcttctgtacattatgagctacctgaaaactggtgatgaatatgcttcctttatctctacattctctatttgtaaaatggggataataagagcacccacctcataagggcactgtcaaatgggctaatacacatgagtacttagaacaacatatagtatgcactcaacaatgttaactttttaacattattaagttttattatgttacagttgctagtgcttgctaaaatagtgctgacacatggtagtcacaaaataagtgttattgtggtatatgttaaatgaatctcagttttgccaatgtgtgatcttggaagaagttacttcaccagaaaaataagaatataaaacccacaataatgacagctgcctgacaaggctatcgtgaggaacaaatggaataatatgtcagaaatgctttataaattataaggtgtgaaataaatgctaattaccatgtttgttctctaactttatcctcacaaataggctgttctgtagatgcaattatcctcattttatagaggaggcaacaggcttaaagaggattatataactcgctcaaggtcatttagatggtttggaggaaaacacagatcaaaaatttggtctttttctggccctttaactccagtaccttctttactatctctgttccatacagagatatgatctccctacaatgttatttctgagtattcttatgcttttttttttcacaaatgccatttgaaaatgttgatgaaaatatactttacattttatggatattttgccatcgccaagaaatttaaaaaagagaatgtggcagcaatcccatggcagcaactaacaagttgaatcaatccaacatcctctgaacaggatttcatctttagttttaggttcggtatattaaaagcaagcatcttaaaattccacctgagattaaccttcagcatctgatttttaaagttttgagggtgtggttgtcaaaaaaatgaattactgaggttctgggtgatttcatagggatttttcataaaaaccaaagagtcataagatcttcctagagaggccagcccccaacctgccagtgtgctgatccccaaagacaagctgtcactttgcaaaggattcatactaactcttgcttaatcaggcagatggcatccttgttctgcctcctagtctctgcttccatttgtctcctagacatcaaatactgagtctatagttcagaatcttcttctgcctgtgttccctagtcaacctggaattccctgacactgactgactgacacctttacatccattgtgctataatattctaacacttcgctgatctttgctgcaccctctgcatccatggtatcgctacacacatcccttttttccccgactgagttacctatatttgttcctcctctgctcttttataataagtattggtaaactgtttcttccaatagaaacacaatgtaccaaactatacagtaagtattttccttgccctattgaaaaccgacaacccactctcaagtgagacaaacgtacatgtgtcatcagtgtgtgctgctccgccataattgttcgccatctcatctagatgcctccagactgtcaatgaaatctgaacatgtgggtccaaaatggaatctaatactcaagctgtggcctatccagtacaacatgtagcgagacaataatatctcaggatctgaatacaccccttctgttaaaatgcagcctaggattacactagctttgttcacagccacgtaacaccactgactcacatgaagactgaagacaacacaaccccccacatcttgttcacaaaaactggtagcatgccaggtcttccatatctttacaggacacttggtatttttcaaaaacttaaattcagtccttcatatttctccccactgaatcttaaacctttggtttaggtcaagtgtttcagcctgttaacaacatgttgaatttttaatctatcatgcacatttacatattcctcccaactttttgtgatctgtagctctgattaagcagttatcttgttgcttcttttaatcattgataaaaacgttaaagatactaaggataaatccctaacactttttctaaggaccactcatggtttgatggtgaaccagttatcaaaactttttgtggatgtctaactacagaaaattcatttcaacatctaggccataggctccctttttatttacaataatatcataaaagattttcccaacgcttttgcaaaaattaaatttttaaacaaagttatttctttagtaaccctaccaaaaataaaaataaattcatttcaacatggagttttaatgaacctattttagtttcttctgaacccctaagtctttcagttatctgtttaatgttttgtatgtaaattttattgggaggaactgggatttaccactttttatttacaagaattgggatttactgattttatttaaaaaaacagaattatcttcctcttattaaaattgataaatattttcaattactgtgttttttaaaaacttttaagttcaagtggtacaagtgtaggtttgttacacaggtaaacttgtgtcatgggggtttgttgtacagattatttgaaaacccaggttaagcctagtacccgttagtcatttttttctgatcctctctttcctcccgcccaatatgtgttgttcccctctatgtgcctgacttcaaaccatactacagggtgacagtaaccaaaacaacatggtactggtacaaaaatagacataaagaccaataaaacagaatagagaacccagaaataagaccacacacccacaaccatctgccctttgacaaacctgacaaaaacagcagtgagaaaataattccttactcaatcaattgtgctgggataactggctagctgtatgcaggagattgaaactggacccctttctttcaccatacaaagaaactaactcaagatggattaaagacttaaatgtaaaaccccaaactataaaaactttaggagacgacctaggcaataacattaaggacacaggctggggcaaagatataatgacaaagatgccaaaagaattgcaacaaaagcaaaaattgacaaatgggatctaattaaactaaagagcttctgcaaggcaaaagaaactgtcaacagagtaaagagacaacctacagaataggagaaaatttttgcaaactattattgcatttcttaccactttcacctcgtcatcatctgagctggttgtttctagtgtgtctgcaacctcagtgttcagggatatgaaaaccattagcggaatacataaagcattaagttggaaacaagtatcagcacagaatctctcttgttaacatgcatgaacttcaagaattccactctaagagaaaatgaatagatttagcattgctaatgttaagagttctgtctgtttttcatccaccagttgtctgtggatgttttactgtactccagtcaaatcttagttgtttaaataatgcttattgggttgtggattagccagctctaatgtcctgtccatctatgtctatcagccatttcaatacttgttagtaccaataccatggagtacgcagggagcaacattctggcaagtaaactggattttctttagcagatcttgtaaatgtctttccagttaaattgttgagccattggccagagccaattgaggaatcatctgtggttgggcctgacagccaattctgagagcagaacaccatgaaaaagaatttcctatgaccactgctggtgtagaaaagaaaaaaaaccaaaaaaataaaaaaactgcttaaatacactgaagacataattcaaaatttattctttgtttttaatatctttgtaatatttctgtaaagataaagatctataaaataaagaccacagaagatggagagaagttgagataactgtaaaatcttatctgttgctgttagtcttagcaaacacaatacagggagacatggcattttaatagcttcacatgtgtaaattctagatgatctaggcaacagattcaacacacaataccagttaaaattaaggaaaaaggtctcatttctgtacgcttgttggtgagtcattcattgcgtgggcaggagtgatcacccttacagaatttcttctagaaccataacctcagttggtgagttctgagagctcagacatttttctagaaactaaacagggtacaggacaccagaaccctagggaatcaatttacatttccaacttttcttccagcacccacaccaccttctccccaacttcttatatagcaaaggctctctggtgcctcttttctcttttccccttcatcttgcctcagacttgtgtgttggcctcactttcctagtgttgttttaaagtgactttgctttttctcatgtaattgacaggctaaactatccttgcgtctaacaaaacatcctggaaaaaactgcatttcttagatatcttattcttatcagaatgacttgagctttctgccaaaactacatttaacttgaataatgaattataaaatatgttaaattgacaaatgacactaattcaataaatatattacaaaaaagcaaagaaagcctctactgtattcttgagtcagtatctcatgaaactaataccaactccagtattttacaatttacaaagcactttcatacctgtattcttacttatcagcattactaatactgtattactattatcatttccattttacaaataaggaaattgaaggtttattgaagtaactggagacactgagaaagtaaaccccaaagctcatgaagccaaggtcagtgcattttatttagcatgacttagtacactagttgctatttgaaggtacccctagacattcatttctataaagaccacctacatttcattttctgactcggggtacctaagaggctgtctctcttactttcagaaaggttttgctacatggggacaaaaactagaagggatcttttctagcaaaataatgcctaaggttcaaggatttcttagtatgatattggtggtccctggcccagcccctggaatgatccctgtgtgcattcatttcaggtgttcacaggaaagtctagatttagtacaggctcacattttcctttcagtgtaggggttaagattttgataaagtagaagcaaattgctcaagttaaatcccttcattgttgcctttcaaatatacattacagcttcagaaatagggtggactttaggtaagaagggggagaaaatggtgttaggcagaggccaggggcagtcctgttgactctcatggatctgacagggaaaatcagtagtttctcattgtgaacataggctttgatgtctagcaaagcttgactacaatgttaccaaggctcagggacctcactcttaaaacacagaagatgttagtgtcttctacctcttagggtttttgtgaggaccgaataggctaatgaaggtaaagcacaatacatagtcaacttgcacatagtgaatgctcaataaatcctagctcttgctattatgagattttatctgattttggagatagaacagagacacatatgtttaaagaggaaacaagagagaacaaaggtttaaactgtctttgagatgggatgtgcaaaattgtctcccagcagaaagagttgatcatatcctctggaaacccgatctctggcaggcagattctgaggctgtgacatcactgattcttgttgctgtggcagcagccctgcagccagacaatacggttttacaacagaaccaggtccccagttggtctcctgggccaggcactgagacaaaaaaccaggactatattcgtacatggaactgggatgtaacatcctacccatgacttaatttataagcattgtttattctctttggagcaaatgaaatgcttttccaagggacagctgcaaaggccaaggatttgaaaagaagaaaattatgataaacccctcttaatgcaggaaagattagatagcttgctaccagaaatcaagaaatatttataataatcacattcaaccctagactttcctctaagaatctaaacagaaaactttaatcctccagaatgtaaactgatgccatggctatatatggtcacagaaatcctaaggggaagaaaaagaaaagaagagggggagaaaaaataaacacccagttgctgtgtctcttaaattggtgtatgtgtgttctaccacagagatctgttaaccttggcaaaatttacaagtaagaagcattaatcaactttacacaagtacacgtgacactttcctttttaagtggaagccacaaactcctctccctttgggaaatctcactgtcatgctgaggatttttcttcatagataatactaccatggcaaacatcaaaaacaactggattccatattctgtgggcttgaccgccccatgaaggcaagcaatattaacttttcttgtggttgacttcttttctttttttctcctttctctacttcttttggcctttaggctagaaagactgtttcttgaaagtattcaactattcttggaaattgcaacattttcctgcattctttctatgttgaagacacttccagactaagtttgggttctagggaatcttgcagaagatacttcctcccctgtagttaataagccatcgcttataccacggtattttgttgtttgactcacgtctccagtgtaacagtggaaagtcattatctctggctttggtgttaacatagggagggatagcaaattgcctcactctactagtgaatgaatagaagagaaatccttgatggtttatcaagagaggtattatgggaacacaaaggaaaaaaataaattcttacaaaataccaacagcagccttgcaatccccgtcaaaatgtacccaaccaacttaagggggaaaaaaaaattcaaactatgtcctagccataaattgaagaaagaagtccagaaatgttaaaaatgtttataatcatcaaaattagtattttttgccttgaaggatgtctctttaaaaggctattcttaccaggttttgtgttgtaatattaaaagtggcttacaaaagagtgaatgtcaattgcaaaattaaatttatctctgggtatgtgattctatctctttactaatatacaaagctgtcttgaatgatttacacctactttccacccacaggtcctctgccagggtcaatctcagcagaaacatgactcttcaaaaatagatcatcacagttgtgattaaatctcccatgttcaaaatttacagcctataattcaatgccgatatgaataatgacttaaataaaaagttacagtcaccctctttccccttccccctaaaatgaccccaagactaatttacagttgtgggaggtggggactaagagctcttgagtatctattttaagctaggcatttttcaagtttttttacttacataaccctatttagcctgccgaacaatccagtggaatagtactaatttatctaatttacacataaggaaatgaaggctgagagaacttgagtaacttagccaaatagtacagttggatccgaggctcagaattcccactttttccttcctacaaacaaacagtagataaacaaaatattcatgtaaggcttaatggcaggtggcatgagagtactgaatttcattgtatgtatctgcaccctccattcccccatcttttgccatttgtgctccatattccctgacagtgcaccaaaaacaataggtttaggtattctctttcagatatcttccaaacaagtgtgcataaaatggactagaaggcaacttgatagagcaaataaattcacgtgctcttctcaagaaatctgagaagaggtatcagatacactccttgcctgacccagtgtgaaacacaggacgcagtgaggtaaagtttggacttttccatcctcagagcacacacaaatccactgaggattaaaaccacacaaccaggaaaaaatgttaagttacagaaagagctctttaaagccaaaagtcatacagctcatgagaagagagaagtcactttgtgctcaggtgaacaggaaaactttaaagaaaagatggaataaggccaggcacagcggctcatctctgtaatcacagcactttggaaggccaaggcaggtgggttccttgagcccaggagttccagaccagcccgggaaatatggggagaccctgtctctgtatttatatatatatttatattaaaaacaaaaacaaaaacaaaatttaaaaaagaaaagatgaaatgaataaaaataatttatatatggaaaggacttaaggctattcaggtgtgtgtgtatatatatatgtatgtatttggaattataaactgtacattttgcataggggtgacttgattacagcaagggaaattaacctgcccctgaataggcctgtaaaggaaagaactaggtaaagaaaccatttagtaagttattacccaaatccagctttgttggtgataaagtgaaccaaggtgatggtggcagacagaataagaacaataactttcccagcctggcctgacacacattcaggcctgatacacacacaggctgtatcagcctggcctgatacagcctctaaaagattattctagaggctgatcccacatggtgataataaaccatttcaactgctttgtgaatgaccaaagatgacatatgtttaaggactttttttaagaattgagacactgaaaatacagactagccatttttaaaagtactcgtcaatatccactaaaaaggagccccttatattttcatcttccttatttaccaaagctagcttcatcagtataaactagaaaggtaattccagagtaataaatcttccatggagagctctctacctctggctgcttgataatgaatttaatcagtcgggagaacagccctgtcattatggattaatcaccaaagactgttttggtaagttgatgctgtgtttgcagctgatggtggtcacaagacacacttgatatttttaagaaatttagagattgaaggaatgctcagttaattaacaaccacaaaacacaacaaacaaaaaatagaaaccctaagaacagcataaacacagatattagtacctttggctttgatgaattcaagacagaattgactcaaaatattggtaatatttatcttcctgttggtttgtttggtttattttccaatccaattagggaattttaagccagtggattctggagcagggtgaattttcctaacaaacttacttacaatatatccaattagtaaagtgcagctcattttaaaaaataagcattttaattggatagttttattagaagaattttatgtttccttttcaacatggtatcaaataccataaagtcctcattaaactttcatgtatatgactccaggatcattaccacagatagaattaagtaaagttggctaagagtggtctagtcaattattctcctaaaagatattaaggatttcagatgagttaagacccactcccaaagaaactgaaacaagttaatcacttgacaactatatcaagttatatgcttaggctgggagtggtggctcacacctgtaatcccagcactttggaaggtcaaggcaggcagattgcttgagctcgaaagttgaagaccagcccaggcaacacagggaaaccctgcctctataaaaatacaaaaattagctgggcgcagtggtgcacacctgtagtttcagctactcagaggctgacatgggagagtcgcttgagcttaggaggcagaggctacagtgagctgagacagcaccactacactccagcttgggtgacagagcaagaccctgtctcaaaataaataaataaataaataaaaagttgtaatttgtaggttgactttttcaacagtatatttagaatgctgaatgaagaggtagactctcaaacctaaaattttcttctagaatatatttttttccaacatctttgtcattcctcttaagtttcactgattgcaatataagtttgtgacttaactgttaacctatcagtctagtatttgtggccaaccttaagcatctaacaatgtacaatttacattgtacctcaacggtttctgtctcagataagctaacctaagccaattttgcttgtcaatattttggtaaataatcatggtcacctgggattagagatagacagtagctatggtttgttcgcctacaatttcactatcaaacgttctgttctataaaagcaagtctcagactaaattctgctgaaccttccacatttgtttacaaacaggcacaaaatagacattgtaaatctgaggaggtctcactctctgttgtcagtcactctgacatttacctcataagcaatgttcatgcatttcagtcaagttcaaaagtggcgaaaggaaaagaaaggaaaagggaaagggaaaaggaaaaggaaaggaaagttcacgctgtggcagatgcaaccaacaaacaacaggaccaggcaaccatggagtcacttagccagtggaggccccagtgaaatgggagacaaggaccgatgatgctttgactctgtgtactaactgcctcaaaagtattgagcagctgggctagcagattctatatgtccttaatgcaggaggagtagggcttataaaatctctcctgtcaactaaataatctgaatacttgtaatttccaaaatggaaacttattccatatgtctattataattaccatgccctctattatgcaataggtagaattctaagatgacccccatgaaccatgaccaggtatataattctcttctcttgagtgggaacaatacatacaacttgcttcttatgaatagaatatggcaaaggtgaggggatgtcactcctaagactgggctattttgtatggcaaaagtgaagaaagtgtgcatatgtaattaaggtccttaattatttgactttaagttactcaaggaagagtttatcccgagtgagcctagcctaatcaggtaacccattaagaagagggtccagggcttcactgaaagaagaaactcaaagacattctccagttggctttgaataagcaagccaccatgaagtctatggattcgagaaagtgaattttgccaaaaaccacatgagttttgaagaggaccccaagcatcacataagaccccagccttggccaataccttgagtgcaggcttgtgagaccctgagcagggagcccagttaaacactgcatggtcttctaatccatggaaactgagataacaaacgtatgttgttttaagccactatatttctggtaatttgccatgcaccaacaaaaagctaatataaaaatatttgaagtgcttgaagtctcacttctgaattgtgtgcttcagatgccaactcacagccctagagcagagctcaaagtgaatctacacacacatgcaccacctgtttttttctcaagtaatttaaaatagatttccaccatagataataaaaaactctggtccacatacctggtcttagtctctagatacgacatcaccgagtatgagtgggagctggaagcactgcagatattgtttagtcttctcctgcctctccaatcaggtctacttctactaccttctccctgttatagatgacaaagtagagccctacaaagtttctgtggcttcctcaaggccattcagttgcagaataagactgaaatcttgtgtcctatggtcatcaattcaaaatgtttttatttcaccctgttgtaatgaagtcttcttattgtcttataatttctaccacaaactccaacttcatttcacaggttttaaagaaaattatcctgtactctttgtcatccattcattcattcatcaaatatgtattaataacctgctgtatgcaatgcgttgttctaggagctggtgataaatcagtgaacagaacagataaaaatctatgcctttatagagtttaaattctggtgaaagggaaataagaaataagaaaaaccactgaaatgcctagtatatttcatattgataagtgctcagggggaaacagtatatggaaggacatgggagctgcaatttcctggatttcaggaagatctcttgcagaaaagtgccatctgagtaacagcctgaagacaagaagggagtgagttaagcaggtatgtggaagaaaattgttccaggcagaaggatgaagaaatgcaaaggttatgtgtgagtagaaaccttggagtacaagacctagaaaaactgaaggaagcccagatggctgaagtagagtatgtgatggggagaatgggtctgacaggtaacaggaggccaggctttgtggagtttttactctcagtgaagtgcgaagctagtggagagttttgagcagaggagtgtctgggaaaatcagcattatttcttgggagtttcaaactagaaccaagtcagagtgttcatatagctgataacagtttgtacctttcctgtggaagagaaagctgcccgtcatctgcagagaaagaggaatgagtcagacacatggagagaagtagaggtcagaagccagaaagaattcagccaggtatcacacacatgctcctgttcctgttaaattcctattttggcccagcgaactcacttctctctttaaaatggccttgcccctcattttgctgaggttgagctcaatgccacctcctagagaggtcttctttgaccatattctaaagtagcagtatcaaacactctatctccttctcctgcctaagttgtattcatgctaggcatttatcaccactttacaatgcactatttatttgttcactgttttgttcccagactggaatgttcaccccatgagggcaggctctttgtccatctttgtcactgttttaccgccagtttccagaatagcatctggctcataatagatgccattttaataattttttagtgaataaatgcaaatacctaaaatccccatggttatttactccacttggaaagcttgttaaaacatgaattactggaccctctcttgagaatttctgattccgttttgaggtggtgcttaatcatttgaatctctaagcttccaggtcatgtccttgctactgatccatggaccacactttgaaaactactgttctatacctcgctagtttctgttacaattaagaagttttagctaatgtagatgacttgaattcttttttcttcaatttttcatatgatttttgttttcttccttcaaccataataagatgatacttaaattttgtcttaaccaggagatctataaatacaggcttatccatcccacttataagcatggcaaatggtgcttctcaaaagtgtcccccatgaaccctctggtcacctaaccgaagtcgcccccttgcctgtccttagcttgactatgttgtgcagccatttcactgaatctcattccagactaatgtttccatagccttcatgattttgcctttttttttttccctgcagagaatgtgtctgtttaccgcatcaccatcacctttgggaccctgtgcctttatgtcagcactggtgctctaagaggcttcttctttgctcattttcccagagccacattttccttggggcagcatcttcaaaacttgccactgaagtctcctgaagtctttctaaatatctattaaagttctcaggctaaacttaatgtaaaacatatactcacagtaaaaacttaatggctcactcaaatattttgccaatatggagccattaggaaagagctctagtaggtctcatactgttagagatgtgaaaattaataaaatactttaagtcttatttatgtcacttgataccacatgtcagcacattttctgacattatatcataatgtctacaatgaaaatcatggaaaattttggcttactacatttagcttgatcagtgctttgtagtttacaaagcactgtttgttgttctatctcaatagcaatgccaagaggtaaaccgaacaagtatccttgtactcattttccatatgataaagctgatgcttgaagaggtcaagggcttgaccccaggccatgctgatagacagcaagagtcacactcatatatatgccaagcatgcaaggcccttgccttcacagtctatttacaaaacagcctggaagaataataaatcaatcctaagaattgctatgaaatgcctttagcataggcattaatgtgcaatggatgtacagcctattcaatttcttcatgaatctctatagtcttcacaaggaactttcactagaaaaaaagacaaacttatctgttttatctcatttttttttaacaccaaggactatgagacagatgcaaaatcatttttgatttgttggttgaggattgactgaaatcattactaattattcggcacaagtgggttccaccagctgcacttgaagaacacttcaacatcctaaagcaaaataaagtagcttacggcaagtgatgagtgccttaattatgttattgctacacttactgcgatttcaaagattaaacttaatagaatttcctgagcaatgatggtccacactggatctgagggggcttttcacaaaggaaaaggagaaaatacttactaacctggctacagctagatctggcctccctactaaaatgagggttaccaggtgtcctacttcttcagggaatgtgctacttttcaacaaatcaccctgcgtatgggatccaaagtagggcagtaaaaatgtctggctttctgtgacatgccagattcttctcctctctctgactcactgattttccacacctttcagtgtccgagtttgaagtttttcttagactgaagaaacttaggattggtcaattccccaaacctcttcatttcctatagcagaatgtgattaaagaaaaatttccaccaaccaggcaagccaaattttctagattgtatatccacaacaacaacctcagctggttgctccaaacatcaaaatcgggggttggctgcactcggcaataccaccagccctgcttgaaatggtttactgcatgatgaatgctgaactgtcacctcttccagggagcctttcccaatccactacatgctccacccacccacccacatgcttggctgaaattaacttttccatttccctgtccttccacaacactccttatatacttctcttaaagtaagtataacaagattcctagtatcttagagattcctgtgggacaaacttcacaactcctttctcttctcacatctctccatgagtttatgaaccttcaattcatatctccagaacaggtttctttctcttcacttcgtcaaaattttattcatctcacagaattcaggtcaaatgtcttttacctggccccattcttcccatctccataaagttagtcaaaacttccttcatgatctctgataactatgaaatggacccagctgtcctatagaacagatgtttatggtttcttttaaataaacatagaagttgactctcccagtcttaaaacttgagaaagttacatttgtcttatctgagttcctttttcaggaaaccaaccattgggcctcctagatagtatcaaggaactgaaactttccagatcaccatctggacaaagagaagccacacccctcacctatcatgactgcctaactgaccacctgcttcctgttcaccaactcctcttccatacctctccctaattcctgttctcctcatgtacttacatttcttccctgctctacaaacccgattttagtcagtcaggaggatggatttgagactgatctcctatctcctcggctgcagcacccaataaagccttcttccctgacaataatcattgtttcagtgattgattttctgtgcagcaagcagtaggacctaaccagaacccctggcatttcagtaacacacatttctctactgtagcactaatattgtaattagtttaattattactttacatatcttcttcactagactgtgaattcatccaaagaggccaagcttaatgacctgccacagagtctagcatattatagctcagaaaggcataacagtagaagttctcctaaccaatctctacttaatgatgacttattggtgaactgaacattctctgtagcacagtgagtacatacacctagtaggcggtcttcaggtacatccagatggtagaactgcacatttgccaagggttagtatttttattccgtaacctgtttacatcacttttgttaccgtaatttccataatttgattaaatattattcaaatcaataaaatatgagtgttttaaaacagttatccctataagaaacaagcagaatgccttgtaagtactaataaacactccgtaaagactagtattattttcttttgactgcctgatttgatgtaaagaagacaattataaaagactgggcaaaatatgtatgaactctgcaattagattgccttgcaaccatctaaactgaaaatcgtatattataggtatggtttgagcaaataagaaaacacaaatttacaactggtggacctttgcttaaagaaaagctttaattgttctactaaaatagaagtgagtaaatgtacatttatatgttttagttaaaatagaatgtctattttaaaattatttaaaattcctactttgacattttgattaactaccaggaatataagagggattctattataattatgtctttcttggttgattcattcattaattcatctgaataaacacttgatgaatactatatttgcttttatactatttaatacacaacctgtcttatggcatttattgttgacatataaatgtggcacatagtgcttggcaaattaggtacccaatgataaaacactaaatgaatctggacctattatccctgctttgattttgttttttaatgatacgttctgttttgacacatccttgtattcaaaattggcaaattaaagattacagacacgttgtagataataaacataaatcatggagcaaagtttcatgaatttttcacatttttttgaaatttggagaggctattgtttgtatatctcacttgtcacttagtaacttttacataccggaacaaatttgatatatgttttttgtccttagttggacaacaaaataacaaacattatattttagaattgctcttatccttcgccatgtttataagaaacatttgacacaggaaccatcccaaagacatttggtgactgtcattcgcttcatattttggtagagagcatcactcaagtttagtaataaaaataataacaatgagcatatttgccatgtgacagacctgtgttaaataattatataaattatctctttctagatttacaactatgatagtactcactagagaagtaggtactaacagagaaaaaaattaaatcttagataaaaaaatttgctcaaggtcacaccaactaattaagtaatacttaatacataaacaagtattaaatattaagtagttgtcacttaaatccatttgatggattttgtcaatttatttggcaagacactatttaacaaaggtacagatccacagaagtcacagactgtggtatatgagatgcatacgtgtgatagggaaattgtcataattaatagcatctgtaaacattatccttaacagaaattttagagatacaatgtagtcctatatccaagagtgaaccttcagtcattcacagatctggtaacagggcatctgcgaactttacaattcactataaagtaataaatggtaagcactggccaggtgcagtgactcacacctgcaatctcaacattttgggaggttgaaatgggaagattgcttgaggccaggagttttacaccagccaagacaacacagcaagagcccatctctacagtttttttttttaacagttagacatggtgggcctgtagtcccagctactcaggaggctgacacatgaagatcacatgaatcccaggagttggagactgcagtgagctaagaatgtgccactgcactttagtctgggagaccgagcaagaccctgtctctaaaataaataaataacattttaaaaaatgttaagaattattaaactgttatttattgtattaactagaaactttcttgattcactctgtatgttattgagcacagtcttttgtagattgttgaaatttgatgaaaacacaatgagacagtctcaagcagaacagaaccttgcatcatgaatcatgggtatagaaggcaacattctctaattatctttgaaagaaggtacactatacatcaacatcatcatcattcaaaaagaacatagaagacagaactaaattcttctataaataagaaatggactcacttggccatcattgcaccacctattggtttctactatgctcatttcttcaagatattatagttgtattttgtcatgatctttggtggaatattttatattttttatttatgtatcagggaggttttgttaaaaaatttcaaggactggatgaaagcctttcgaaaccaaaaaatatttaaaaacctaatttctcattactttcacatttgggcatttaaaaatgtattagcttttacaattttttcccggcattttatcttctattgcaattattgtcttttctgtggtcagatgagtcaaggctttacttgtgtagattaacaactgttacttataatagcacttgtaatttcacaaggattgcataatcaaggtcaaatctctttcctaatgcctgccaccacttctccttaagtatatagagttcttctaaatctaagtgatatagtactttcttataaaatacatttctaaaataatcataaatgacatgccactattcaattcctatagtactcaaaaattcaactcttatagtacttttgatcctgtagtgatgaaaagttaattgcaaatagtacggtcattaattgctatcacctttttaagagcgagtatgttcttaactgtttctgcaaatagaagatgcaataggaataatcctagtctcgaggaggaaactccttttttctaatcaagttttataaggaacagtttttgagacatactactgtaactctgggcttttctccttctccttcagtgatcagccacacttaaagaaagttgtcttgaatactggatttaaaacattcatttattttttcctacctttctcttttaatctctctcaaatcaccatttttcaaagtatctgttttttggaaactgtatcaattgctacgaaaagacagaagtataaatataggtgaggagatttataataaacacgggataatgataataataacatcaatataatgtaaaagttatcatatcaacaaggaaaaaaatgtaccatgaggagcaacataaaacaaagtttaaactttggcaggctgaagccaaggaaacttttgaacacttaatataccatctttcaaatgtctttctggagagcagtttgctaaagtgtactaaaaaaagttttaaacttcatgctttttgattcagtaaatccccttaaaggaatctattttaaaacagaagcttggcaaatataagtgtaaaatatgtaatgacaatggtttttaaaattaaaatagtcctggaaattataaaatgtccaaataaaaaaaagtacacaaaatgataatccacttgatgatagaatattattccaccactacaaagatttgagaggtagaaagaacattcacaaaaatgtaaaccttctgaattataataggtgattttcatttttatctttataaatttttaaattctccgagttttctttattgaactggtattgcttttgagctccaaataaatgctactatgtgttttaaaagaatatctgatagcatggagtatgcttacaatacaatcaagatataaagtataattttaattttgaaatataagtttacatatgcccacggacaaaaacaaaaaggactgttaggaaatacgtggaaatcttaaatgactacctgttattaatacagctggagataatttatattattttattttagtttagatattttccagaattttataatgagtctattttactttcaaatggtaaatgtgtgtgtgtatataacagagcaatagaagtcaatgtagcggaattcctttccttggctcaaacctgaggcttcctctcagaccttgggacaaaggtctgagaaataatatgaggcttttacattatttaatctcaccaaagaatgaatgcatgaaaaataaagcctaaagctattttagatcaggatttttatttaacatcaagtaaatgaaaaaagagataatgaataatgggactacccttttatgatatacaaagcaaggtattgggtctaattacttgatgaaatttaaaaatcaaaaaaaaaaataaagggaaaacaatgcagttaagtttccaagtatattattaataaataattgtaggaaaagtcagtaagtccatatattcatgtacggaaacagaacccatgatggatgagcattggttactcctcattgctggaggttttataagcaaacaggccagttttcttcttttgtggctttgtgagttttgccccttgacataaataatgtatccctaaaataccatgaatgacaacaaactaccattttgtcttccttgtctatcttcagtatgtggtggttctactatagcagatcacttcaacccaaatattatctttaaactctccaatggtgtacacttgaataaagagaaactagaatatcttaagtaacttggatcctaaaattcacagagatcaaattgtacatgagcataacaacctttatgaagatccaaagaatgaatgattcattggaaacaagtatgttccaaaggctgacctcacagagcattggacctcagaattcaacctccatctctgtctttctttccttgtattttatttaggtttattctgtagtaatggtatttccagggtctacatctttacttggatattttgttcctctttgtgtgccttctctctagagaaatgctgcaagtatagatcaccaccttattttagcttcccattactgtggcatgtagaagagaagcaaaggagataacaaagaaattgatatattctattcacacaggggtaggatgggaagatacaagcttttaatgaactggctaaagtttccaaaactcaaactttttttttccataatttttgcaaagctaattgaaaccagatacaaaacatcgcagacaaactacctaagagtaccttgattattccttctgcattgttctcactgttatttatctgaagaaaggggcatcctagacgttatagctatattttcataataaactatctatgctaattatgttgaactagacttatcaggaggatattaacttggggtacttaagaattagttgtggtggctcatgcctgtaatcccaaaacattgagaagcctagcggggtggatcacttgaggtcaggagtttgagaccagcctggccaacatggtgaaaccctgtctctactaaaaacacaaaaattagcgggtgtggtggcatgtgcctgtaatcccagctactttggagcctgagacatgagaattgtttgaacctgggaggtggaggctgcagtgagccgaaatcatgccactgcactccagtctgggctacagaaagagagactgcctcaaaaaaaaaaaaaaaaaaaaaaagaattagttgagactgatgggctactaaggaaatctctcataccagttaatcaatttagctactttgtatctcaaattggcatctctaaattgtgactgaaaagtatataatcccttttcaaagcaagtcatggtgaaaaatgttcccacttaagccaaataaacaaatgtttatgccactgatgagtagtgccccttagaaatcatcaaaacccgctttagggattagggcagaacatttgagagtataattaaatgcataaaagtgcttaaacttgaattgctacaaaatatagaaaccatttggaaatgttttatggatcacattaatgtgtgtgtgtccccgtgaaacataagatatatagttgttgttgcataatgagttctgacagcacgcttcctagaagatgacgttcatctgagcagtatcttacttttcattctacagcattgcaaaaagtgactaatgatagagaaaatactgaagagcatctcctttgatactaacttcaagcttctaaaccatgagaaggacccatttaaaacgttaggctcatttactgatgagagtggaccaaagaaaatcactctatgcatctaagcaacagtatgtagtgtcatcactaatttatgtcctttgggtaaacgttcttgttaaacacactggtttttgacaattttgttggaaattttctgtttataaatttcctcttttattcagaagcttggaccaaatcaaataacgcaaagtgaacaatgctcttttggtgatgtgcaaaacaaagagaactctaaaacattctgttaattttaataaacaacatgacttagaaaaaagtaaataaatcaaaaagcaagtagaatccaaatacccaaataacgggtgtgttagataaaactattaaataggaataaaatcagataagaaaattgcttaagaccttgagcctgctgtgaaatatttagtgaatctagggaacaaaggataacataatgaagctaaagtttaggaaacgtaagtgttcacctatcacactgtcttagaaatgtgtatataaatacatacgtatatatgtgtgtatacatatttacacaaatgtggctatatattttttgcaggtttttatacatatatttgagtgtgtgtgtgtaaataaagttcacagggatggcctgaagcttaacctaaaatatttctatttcaaagttgatcctatttataggcgtatttaacagagaggctatacggacaatttgtagagatcaatagttggctgtatagaaaggattttttttttaccctttataatgttgtgaatccctaatccccagtctcacggtaagtgtcctacatatttagtagagggtgatatgaacattcaattcttaaaccctttggtgccagccttaagctatcagtttgcaatatttcatatttacaatctaatctaagcttccaggattttcctcactctgaaagataaaacagacattttaaaatatgtatcattaattctaagttttagcaaataaaattgctacactgagacaaaatgtggttacaaaaatcattgtgtcagttaccaaaaatcccaagtctaccacttagactacttttatgtcccaccaataaaaactataaccccagaccatccaactgaatgagccacgaaaattacccccattcccatgttactgcctttccaattcccatgtcactccctttccaattcccatgtcagttgtgggtctcatacctaggtgtggggaagcaaaagaaagtttaaattatgagaaattgttttcagatacttttttttatgatggacacttaaaaatttggggaaatatatatatgatatatgatatatatgatatatatatcatatatatcaaagaaaatcaatgttataatcagccagtctccccaaatcaccaaagctaataaaatattttcttccaatttatagacacacacacacacacatacacacacagtgaatctggtattctaccaactaacatgttataaacattttccctcctcattgaaagttcctcaatcttcctttttctaatggctgtataatattccataatatagatatgttgtaatgtattattaggcaattgtaatggaagaaacattttactagaaaatctggattacacaacctagtcactgtagtaaagtaagagcattagtagaaactgtaattgttttagaagcttttagaagtgacagattcacctatcgtttcccgtactcttcaccgacattccttaaggagcagattctgttcagcttgcaattgtcacttggcttggaatcatataattatttaccactttttttttaactttcaattgtggataaaatgtttattaaatgaggctgattcacctcagctccaaagtctgtggcaatttctcacctgcttcctgctaattattctaaatagttacagaaacataattgtgattcaagtggttctccaagtagagtccctggaccaccaatttcagaaatacctgagaatttactagaatgtcaattcttgcataccatctaggtctactaagtcataaactctgaggatgaagttcagcaatctgtattttaacaaacctccaggttattctgatgccccctcaacttgaggaaccaccatcttatcctatagacagatcatgctgttgaaatgtgccattttcacatacacatagtccacagaggcttctgccatgttttttttaacaacccgatatgtaacttttgtcccagcaacattttaacatcaggggactgcatccatttcaatctgaacacttttgtccaatcactccaagtgagcttaagaaaatgtagagtaaatttttttaaaagatctgtgtacccaatttgatagacattttatcttattttggcatttctattctcaggtagcaaattgcctgaaagggcaaacaataaatatgggagctaccgcatggctctttgtggatatatttggaggcagtttaacatgctgtggagatgtttctagaaagattactgacaagatcaaccattttatgaaagttgcttttattacctttggattttttctaacttgaaaaatattgctcttaaagtatgcttctctactaatccttcctgttgagcattctattctccttaaaatatatatatatataaatatatatgtagatgcgtgtgtgtatatatattacacacacacatatgtctgtgtgtatgtgtgtgtgtacatatgcacactcacaaataattaagtaattccattctgggagaaagactttgaagaaaagcagtttatttgctactcagaaagggaaagtgatgttcgtgggacataaagggatttgaataaataggaataagtgtccttttaaaagaaagcagcatatggaactagaaatactttctggaagctctaatctcctatttgaagaaaatccaattgttctggctggtggcaaactaggagattacagctgaatttctctccctccattcaatgtgaagtaatcatagagccataaggaatttgacaggaaccataaatacttctcctgtaaatccctaaaaatttataagagcattatgactttcatgctctttctttcctagagtctttacttcaaagtcttctgagactagaagagcccctggagcaatcattctgcttccatatccacaacttggaactcttagtcccagaccctcaaattatagaacctgagggaaaatttagggggcactgaaaccaaataccttcacgtgtcagatgacaaaataaatcaggtagacaaaaagtgttaaccacatcacgcaaagaccaaaacccaaagttccacattttcaggcagagccctcagcctcatgtcactaggcttcatttctaccaatatcgccccactgactaaatgtcctttgtcactagaattgtttagttctgcataaatacaaagtatcgatgatcaaatttgacttatttcttctcattcagtccttaagtggaaacagcaaaatgctggttgccttctcttaaaaaaacaaacaaacaaacaaaataagaaggaaggagaaggaaggaaggagaaaaataaaaaagaaagcgagaatgaacaaagagtgaacaaatgaaccaacggaagaatgaaaaataaaagaaagaaaaaagaaaggaagagaggaagaaagaaaagaaaaaagaaagaaaagaaaaagaaaaagaaaagagaaagaaaaagaaagagaaaggaagcaagcaagcaagcaagcaagcaagcaagaaaacctaaagatctttatcatcacatttaaataagagtaaatctcaagaggccatcttatctacccgttcccactaggcattactcaacagagaaccaatagctaggaacttcctctattcctaaagattttcaagaaaggaagagaaatatcttgggaagtttaggaaacataaatatttaggctcatttattgatgaaagtgggcaaaatgaaatcatcctatgcatcttagtaatactatgtggtatcacaagcagcttgacataacaggctggtatcaattgtcatgggtaagtgctaattgctgaagatctaccaatttgctgtgtgcttttactaaaaatatctttgaaagttccacagccttccaagattttgtattccttgatataacctttaaattgccttcttcacattccctcttgtttgttagtaatgaaatgccaatgatcacagtaccggaaaaaagaaaacggagaagaggacaataaaaaatcatggttatgatttgtggagcaaaggagggctttcagcattaatatttacattaatgtttacgttaaagtgggacagattacactactttttactcacttcacttcttcttaccctgcatagagttaaatacttactgtttgtgccttgtaagaactctaaagattatagtgtactagtaaatctactttattttgctggcaggagtcagcagacaaaagaggagcaggagaaatgttgtcaaatcaatagtgatactgactgaattttatcagtgtttcatctttagctgaactatatgaactcattcagattttaaaaaatatgtaaactgtctaatctattttatagctccgttttacagagttataacatgtcaagaacaaagttacaaaatccaaaacatacaagttagcatcacctctatttttttctgaaaattccgaaagtacaatgattagaacacacttcaaacctcacagctctgtattacttaggaaaaaaatcccaacagctatccagttgtgctttgaggtcatttctcaaagcatgtgcattaagaaacttagcaatctatgtttatggttgctttatctggtagtataatacaatgaaaatctcacatataaaatttataatgtgatatttacaggttcaagggtggaattgctatgttccaaatgattttctgtcatcccttagttcactgtttctttaatcctttaaaacaatctgtacagcctttgctgtaaaagattattacattcttatttccactgtgtagtcataattttgaatgtactctctaatttaccaacattgtttccaattccatataaacccatatgagggtgctcccagcaaaactaattagggggataactgtgtaatgtgaaaaaataaagaattggaatattatccttgtgtcatttgatttgccaaaattcagcttgtaacaattagatactacagttggaaaattagtgattttatttatataacaggatctgtcataaaagagccaaactggcaaaatcactaatagtcataacctaaatcacccaatcaaccaaaatattataaagttcagcttttatttttatgcctattacccttttcatggcaatgggttatttcaaataccccaccacaagccctgagaacacagctgggttacttgaaaccagtagctctaaaccagtggtgacttgccccttaggtgacatgtgtcaatgactgaagacagttttgcttgtggcagtctgggggatgctactgacattttgtgtagggctcaggaatgctgctaaacatcctacagtagtgcacaggacagccccccacaaagaagaatgacctgggctaaaatgtcaacggagcttaaaaaaaggttactagtctaagtgagcttaagttgagaaaccctgcactaacattaagaactatgtgtccaacacggttgcaacatgttacgcaaacacctgcattttgtggggtggggggtgaatacagccattctagggagagtaatttgttctaacttgggtatttctgcccaataagctagtaagatatttgctttttctaacgtggattcatcagggcactgaaatttaactattttatttaaaatatggtatatactatttctttgtggtttttctgttagtgtgtgtgtgtgcgtgtgtgtgtggtgtgtgagtgaatttctgaaacagagcggtagcaagcaaatggcagatttggttttatcatcaagtttctgttagacatttcgataagattatacagagcatatagtggatgcctactacatatttattgatttttgaaaataaagtttgtgaacctatttctgctatcttcctctttagagaactgtgattgcatttttcttctttttttctaacatgtatagagtgcctgttgccatagtaatcactgatttagcacaacgtgttttttcctccttctttaaaaaaaaattagttcccattcctgccaaaaaggaacatattaatctacccatcatgctagcttggggaagttgaaggccacagaagttgtcatttgtgcaaagactcccagaaagtcagttgttagcatcttctgtgccaagaactctaccccaatcccagagaggaaatgagacactgaagtaaaagattctggagctgaggaggtaacatctctcttcttttctgcaaagtcccacaaaagatgtgcacaaatgctcatgtctgtgtaaacaaattcacctactgattatagatttaacagaccactgatgtccagaaaacagggactaactagacagtgctctttaagacaaaagtttaccttaatctacttacttctgagggtaggggaacaacaacaaaagcaacaactaaagaaacaaaaaccttttgagaagtctaaaagaagtagagaaatcctactgaagaaaccaacatcaacagtttcatttctttatcaaataaaaagtccggcctgagtctcctgactgactacattctttctagtattaggtaaatcagatctcaaatctgatctagccctgctattcagaccacgaattcctgtaaacatacctatctagaactgtgtgcaggcccctcttatgacaatggtctgtgctcacctggatttttatcactggcactcttagtcaggaccaccagattcttcctaatttctcaagtcaaatccgaaggctaccctgcttgtggtgttccataactctgtctggcccctcatgagaaatgccacctacttggatgagagcatttaagtcagagcaagacagcacagaggttgactttaggttcccatctgacatatttactgttctaagagaggaaaggtagtggaagagaaagaaaaactaaagtggaactgcaggatttctgattttcagaaatgtctgcttattatcagagtgataagaactcaaaattaagacatgggaaaggaaaagatagggatatagagtcagagctgttccttaaccaaaggctttacagaattagaacacagctgacacaggaaattcaatgcaagaaggtcctgctctaaataaaaacagatgaggagaaagtccattcatttttactaatagtatgcatggagaatgaacacacgctgccttttacatagacccttataactgttcatactgttctgtaaaatcagcatatttcttattattttcttctgggaaaaaacacttggctatgcatttccttttaatttcatggaaatgggaaaggggtaaaaggaaagaaagataatacttcctgaaaacttgaatgttttgctgaaaacacccttaaaggaatgtatctctgtcagggtaacaaaaacatttaataaaatatttttaaagcagttggtctctaagagaaaatgtgaggtatatgtaattagtagcaaatatgcattcaattgtactaagcatgaccattcttcccctttaaatcctcaatccatgaagtgtgtttgttaattaggcagtaacttgaagagcgctgcttttcccatagaagtcaggtgctcaactactcaaccatgaatctctacggttacatgaatctatgaatggtctgcaaaccacttatactccaggtttcaattctgctgccagtaataatagtaataataccatcattctattctagtagcacagtgcaaatttaagataattagaagatgatgatagaaatttgaaagcaatggattacaaaacaagactgcatcaaagcataacacgcaacacaacactttttcaattatgtacataacctggaaaaactagttggcaatgaaaaaaatgtgttgagaagtaccttattaattcattaaatatttctgtaatcctatgtttctttaaaaagaaaaaaagattactagtctaagtgagcttttatctttgttaagcagcatccttttaacctccatcatctctaataactaaaaaaaaaaaaaaaaaaaaaaaaaaaaacaagagaagttaaagaagcaaaccagcaagagaaactgtagttgctgtatcaatgacaattattccagtgataatgacctgactttttgggttggtcttctagctagtccacagggatccactgttcaggacggtgttaggggaggtgggctttgtcattttgcacaaggtttgacaggtttcagggtttaaatctgcaatttccatggccctggaaaagtaatgtctaaatattgcttaactgaaagttgctgatgagaatatttcagtgctctgtgcaaagagtggatccgtggatcagttaattttattgaacagaaaaaaggtgaagtattgttgtagggattgaatgagaacagatacacagtgtttaaagtaattcctggcacatagtagatatccaagaaggtgtctgactccaccccttccttttctctctttctgaattgtattccactgtcagctgctagtgtatacatgtcatgagctaatgtgcccattgatggtttagcttatgactttcaggtcagttttctaagttgataaaaacaagcattatagataataaaattcagaggcagttccaacatggaataattggcttgtctcattccatagtcaaagctcatctcaactaagttttccattgctcacagtgaggactagggaagaggaattgctgcaaatccattttcacaggtgggtaatcaacacaagaagcactgtcaactgattgtgggtgtgaaaccatctacgcacttgaaagttttcatgttatcattactatgtatccacatacatttgccgagcctgaccgttccagatcagtcttctgaatgctagctgcatatcagaaccacatatgtatagtttcataaatgtgacaatactcaggccctaccctgagacaagtggcacaaagcattcagaagtggaaaggattctcaccaggagaaccactctgagaatcaatagaaacagagatccaggtcaaagaaaaatattatctttcttccctgggaatcaccagcatttgcacagacttctacaactagctacatgacccagggcaatttcttaaagtgggacacagtgtgctctgaatgcagacctgacactaaatttatcatggttgggtagctgctgccttatggagaatggcctgtgggacactgaacttacacattaaacagctgagccaacggatgtttcaactgccaggaaaataacagaatggggagaccctctgttcatttgacaccagtgccagcttggagaaacagcatttcttctgcagttattgaaagaaagtaacccagaagtacccacagtcttttagctcttaaaatatggagccactttttcttttccagcttatttccaatgcaaacctgattccaggctcaagagaagtacaacgtgccttggtcccttctccctagtcttggtcagcttcttcaattcctcttgctgatctggcctccagtttggctggctttttagaggagtctctcagcactaccagcagagtcttttgacctatgttactaacgcgtgtatcatatctagatccactcctcaccatatgtcatggtactgtcttgttcctggttattggtggtatatttgtttttctactgtatgtagttaaattttaagtaacttaaagaattacaatagcaatacaatttcattataaaaagcagaatatgtggataaacagaaagaagaaaataatatccactatcataccattaaggtgacccactaacacaattttcaaataaatttcctacgtacatattttatttttataaaaatgcaatcatagaatagtcaatatgatttttaaaagtcccttttatgaaataaaatatgtgaacatctttttgtaaataattattcatttgaaacattcttttaaaatggctgtatagtatttccttgtgattttcataaccatccccatattgatatttagcttgttttgaatcttctgctgttataaactatgctaggatgacagttacagctcttcttcaactgctactacccagtttgattgataaatgacacacttcccttggcctaggaagaagcaacagattctgatgtttgcaaaatttgtcagtgtggcttatcaagaaacagactctatctctctatttatctatcatctatatatttgacaaaacattttgaaaaatgacttttaaaaatgaaataaggaatgtaaagtcacaaacagcccagggacccaaatgagaaagcatctgtcagagattcatcagtcaggagtacctattattttaacattttcatggtcatataagaggaaagaacaggtaaaacagccaaagtatcacctgattcccactgatttagaacagaactgcagaaatgttgaaagattttttattagattaagcttcccagcaagaaatctagacagcaatctgcagctagcaacatgccttcggaaaaccaaatacgagattcactgacactgttttgtgagggcctcctctacccctcgtctcccctacccctcgtctcccctttttcacataccccacactaggatcagagaagtttggggaaaaatcaacagaaacaacacgccaggtagattatggccactgcaaccttgctgcagcttaggctaggctcttaggatgaccttctcaaaatccttgaaggagaagttggctgaaggaattttatgcaggtctggaatggtctcgtctctagaggtctagatccaaaaaataaaaagactgcaatttttaatctaactcttaccagaatgaaaaaccatctaaatgctccctaggggccttaaattgttatgttaccaaaaatgctatgctgtgggaaatactaatattaagtaaatagcccctgtcatttttaccaaggacatttgggggaaaaaaagtcactgatgaataagtgaaaccatcttaagttgctgaaactgacataatgaaaaccaccatctttctaaattccttagccaattaactaagggaggggaccacccctcatattgccttatgcccaattcctgcctccaaagaaagaaaaagtaaaaactaaaaggcagaaatgaaatccacaagcagaccgcccggcgccacaccctgggcctggtcgttaaagatcgacccctgacctaatcggttattttacctatagattacagacattgtatagaaaagcactgtgaaaatccctatcctgttttgttctgatctaattaacagtgcatgcagcccccagtcacgtacccgctgcttgctcaatcgatcacgaccctctcgcgtgcacccccttagagttgtgagcccttaaaagggacaggaattgctcactcggtgagctcggctcttgagacaggagtcttgccgatgcccccggccgaataaaccccttccttctttaacttggtgtctgaggagttttgtctgcggcttgtcctgctacgtaacaacttgtatcattcatcactacatttatttccattaacctatcctagaaccaaaagatcctagaaccgaaagatgagggtacataattgaagggaagactcacccaggaaagaaaaagaaaaggagtcagactgggctatctgagaattcacaaaggaactagaagctgtgtagtcaaaatgttcctggcaacgtggcaaatgtatttcaaatcaaaccatgcattcactagactcttcttttctaatcttttgttttctcttggcctgagtcaaagtcctttgtaaaactttcatggatcacatgaggaggaaaggggagaaggagaagcaggcagacagggaggaaatgagagggtgttcctgctggcaaactcagtggggaatgaactacctccttcagagggaaaatgaggtgggagggacagagagccacggaaagaaaggtaccagttcccttgcaagatgggggtaggagagggctcttctcagaaaactagaagagattttggtgatgatgtcagaattggagcatctgccttctaaggactttgtctgccaactggcatagggagcactgcccagagagccagttctccgtgtaataagcaaaggcaggaaatgggcagggagcagtaaactcagtgggaaaagccacatttgaaaaacttgggagagaggaggagaaaaaggaagccacacagaattttggtgccacgaggaggaggacatctgtatcttgtatttgcatggtgttttacagtttagaaaacacagacaccatcataggtcactgtgaggtgggcacatttattactattttccagttgcagaaatcatcacccagaaataagggaaaaacctgattgcaagtcttcttatatgggtctgttctttctactacatctaagacatttctctgtggcatgcctgcactttgcagtgttatcttccaaacaccatctactttcagaaccctacacttcggagaaactgtacttgtaccattcttcaaacacgctacaagttttcctgcctctatgtatttgttcatactatttcttccccttaaacttctttacccaacttggactgttagaatgttgcccaaacctttcaaggtctaaatctccatgttacctgtttttcttctatgctattttttttaacatgattctttgtattacagatatttacaaacatttcttctcccatactaaatttaactttgtattcattttactgcctagtaaagctccttgcatagtaaggaaactagttttgaattaataggccagtcaaaaaaaaaaaaaaaaaaaaaaagaaagaaaagaaagctttgtgagttcttaatatgtattttttgtcacattaagtgaaaaaaaaaaaaaagttccccaaagtcatgaaaccaaagcagattctatttacatttagtgtaagattttgctaactgaatactatatcccaagtttatggggaactatctatacttacttttatatattgatcttacattttgggtgtgtggttatgaggttaattcattaaaatgagtaaaggctcttaatgattctttcttgactttatgggtcatgtgtctaagtacagaagttagtacacataaaaaactgtaattgggtactaaaaaatacatatacagattgccccatatctaattttctaactttaagtgtataattgtcagaggcatttgaagcagagcaactccatccatgaataagggctgggtaaagtaaggctgagacctacagagctgcattctcaagtggtgaggcattcttagtcacaggacgcgatacaggtcaaaggccttgctggtgaaaggatgtggtaaagaagctggtcaaaacccaccaaaaccaagatggtggcgaaagtgacttctggtcttcctcactgctgattatatgctaattataatgtattggcatgctaaaagacactcccaccagcaccatgacagtttacaaatgccatggcaacatcaggaagttaacatgtatggtctaaacagggagaaccctcagttccaagaattgcccacccctttgccaaaaactcaggaataattcaccccttggcatatgattaagaagtaactgtaagtataatcagttgagcagcccatgctgctgctctgagtagagagtagccattcttttattcctttactttcttaataaacttgctttcactttatgtatttgccccgaattctttcttgcacaaggtccaagaaccctctcttggggtctggattaggacccctttccagtaacacaactgtaggcttttattgattgaaacataggtgataaacagaacttcaaatttcctttgattttctgtcatggcctggattaatcgccacattttccctaattatggccatcatcttttccagtgcaaaagaaaaactcttcaccacgtctttctgcagagtttccacccaatcttgttttccatcacaggaaagtaaaaggaaagcttgcaagtgtctgtagtcatcattcaactactcaacttgactagaccatcatcacctactcctttaactttgtgctcagtaaactgtctctctcagatgaaagtcattgctattagctaccaacacaattgtgccatttgattttttatttgtgacttactgttccagagctgatccacagttaacgaaaattaaagccacaaatttttcccctaattagacatttgtgccttccataatgacacttacatacaaatgacactcaaatgtataagatgtaggctatatgcacaatacacataacgaacaccacatgaaacaattttggaatttaaatttagattaaattggtatttaaagttaatcctcattgaatatgaaacattaaaaaggcaagcttaaaaataccaagcaatttggcattattcagtacagcatgtcaattcaccttattcaaaagcaaaccttttgcaaagcaaaaattctcccattaaacccaggcattaagaagaaataaactcttaattacttaaggaggaaatgctctcgtttcatggttagcaggttatcaatgtaaacaatccagggagctttctcaatggctcctgtttcaagagtcccagcctctattccccattccccatccgccaccctctttctacacaacaggagctaatgtctttatgcgtaccaaaaaagacactactgaccacaatgggagagcttaggtatttgcccacactttccctgcaggagtaaattcagtagaaccctataattctgaaacagtcaagtcatggaccatctgactcattaaatattccaggcagccttgtcagtagtctggaagaccttgcagttataatttcttccctctgtcattcctctattaatactcagctaacttgaatttcaacatgagctttagactagctgaagaacatttattgtgcaagattcataaggtacagaacctattcatagaaagcattttggcatccaaaatatgtgtaactaataatgaataataatagcattgtctccgaaggcaagagcacaaaaatacagctatgaagcaaaaataaactcctgacagtgccatatgtaccctaaaggaaataagtaaaaagctttttttctgaatattagttgtcactatttcatttgattatttcaaaatgtaacttttcattaacttaggtttatcatggatttgcagatacactggtatctaatagagaatattaaccttagactatcaagataaagcaaatccatgaatttcagcatttttttttaagacatatggtctcactatgttgaccaggttggttttgagattctgggctcaagtgatcctctacctcagcctccaaagtactgaggattacaggcttcagccactgcacccagcctagcataattctctatagcttttacacttgtccaactttaatggaagaaaggcttctttgtacacaaatctgacaacatatctttttttctttagttgtgtatgcctatgatggtcaaactttggactattaacatttttattctcagttgcaaacactaagaaccattctacatttcctctgtaatgcaacaattttgctgatgccttcagtaattatgacaatacattttttgcaatagatatggtaatttgaaaagaacacatttaaatatatggttttatgcaacagctatcaaatatgtaaaattcaatatcccaagagtttgtgcatgttgaggaaagaaatccaagaaatatttaattaaactaatgaatcatcattttctcactggtcttccatgtgctgtatttattaagagagagaatatgggctctaaagaccattggtctgacttagggtgccatttctcgcattttcatgatctgaaagtaaaactagagcatttcggcagtttcaagttggcacgagtgcgttgcttcctagcttgaaatgcataattaaccagaaagctagttgttgagcagttaaacaggctgtccaaaaaggcccccattgctgttcaaatgaatgctgaaaagtagggtgccacagtgatttttttgttttatagacaagctacatacaagcaattgacaaagactaattttcctttcttttcaaagcccatgaaagcttgtgggtaatagcaattatttctatttgtcaaatacttgtatccagaagtggatttataatcccacgaaaattctgtaatttactgaaccactgagcaggtccatgctactccccctccccagccccataggatgtaattcatttcaacagaggattggagacaatgatgtaaatgaagcagtcctcacaaggcagaaggggaaaagtgtcaggggaacatacttcttaattcccataagaaataccccaattactggacagagtgccaaatttcagaacataaatgaatcccattcttattaccgagtggagaagatgctagggcaagaatagtggcttagagttagaaggagacatacacctacaattgctaaagcaatttctgcaagaaaaatttaaataaatatgggaaacattatggatcaaatccaaggaaggtcttaaatatatagtgctcaagaaaagtgcatgaatgtttccatacctcaaatatggtattttaaaagagcttgcctttaaaatacaatggatgtgtcatgatctaacagttgtccgcttttccagcacatccgactaactagaattcttgggagatcccatgccacaattcattttccaatttctaacaaagacaatgcacttcacatttttacttttgcattccagcacttacttgcatggtggtttatggttggtttgtgtgtgtttcttttttagaaatgttagaatgggaaaaatgaggtaattcttcaactgactcagtctttaatgattttaatgagttccagtgtttatgcttgagctaacaggtgccttatttttttccttggctattctttcttcccttgtcctcctattccgggcaatccatgcaacactccagctgtaaattattctgatggtatgaataagctttgacctgaaatcaggttagtaactaactgaaatctaacttacatttccataaatttgctgttttgaaaatgattagcatgactttgaaaaatctgttagctgaatcttcaaagactactataatcttcacaaaatcattttatgtaatatgtcttccatcactgtattctatacatacaacatcctctttctatagcactgaactcccaaattgtttccactagtggaaaaatgcagttaatattggattcatttgttgtcagtcacctttataaaatatacacacattcaaatgcacatggacacaggctccgcgttttaaattccgcattttctcaaaaatttaaacatatatgccaaagattatgcaaaatatgatctccctatagaacattttctttttgttaggcagtgtaaaaataatagaatgtatcactgttcttggagctttgtggattcctagactttgtaattcttcatgaatgcagagttatttttccaagatgctagaagattccccaggccattttaatagttctattattaaatatataataaacatgattacttatttattgtataatggatgtataataaataaacgtcagaaaatttcaaaacttctaaatgggttattgagctatcaaagtctgcagcttttcactatcagacaagtgagggtaggaaaatgggccatcacacgatctaaggtgaaggctaagggcagacggtatattagtaagctagaagaggggaatatcttcccaggtggactgataagatcagtgtggcagagctgtgggaacccaaggccctctgttactcaaggctgtgtgtgcagtgctgagaggtcagccatggaggaagcaacatggtcctgcatttcgatctaagcctacaatctaaccattgtcagctcaccccatttgtttcacgtaaaagcaatgctcagagacatctgcagagggacctaacttctcaaacttgccactttggattgaaaccgtatatgatatgcattccccctatctacgtcacatgcatatacatagcacagtaacaaggcaatcctctgtgttgtgttctcaattccttctccacagttttttttacttcatgatgacaatgcaaagagtggactgaggactaggcttaccaggttctaggcccagatctgcccctttctaactgtgtgatcttagtatgtcactcagcagatttgtgtgtgggtgtgtgtgagagggagtctcactctgtcatccaggctggagtacagtggtgcgatcccagctcactgcaacctctgcctcctaggttcaacagattctcctgctcagcctcctgagtatctgggattacaggtgcccaccaccgggcatggctaatttttctatttttagtagagacagggtttcaccatgttggccaggctggtctggaactcctgacctccagtgatctgcccgcctcggcctcccacagtgctgggactacaggcataagccaccacacctgacccaccagattcctcatggactggttccttgtctgtaaaaatgagatgatttattagatgctatctatacttccttcacttcttcaaacgtcagtggtttcttttttattggtagttttctgtcttcctgccttttgcctgtgtccatttttccattttcattttatgaatttttaatcctccacctcagtgaacagcctttccttccacaccaacaggtcctctgtcctgaaagaatatcacagctctatattggagctcccacagctcttggtgcactgcattttgattgctgtgctgcataaactgtcaatttctttccaaaaagacatcctctatcttgtttacccttatgtccccaacttcctggcactttgtgaatattcagtgaatatattttaaatacttgaccttcctaaccttttcttggaaggacccttcaggtaaaggagatggtcaagaggagttgcatttgcttttctggccaactctctttacaaggagccagcctcctgttcagtctcttctgaggtgacttttctatcctgtggatcttcactggtgactgtaactactaaccagtttgcatttattcactcacaaatgcagggacacacatataaccgtgttaggcatcacagagcatatcccataagtgataaagtcacaaatatgttacccccataacaagttaataatcttccagcatgccagaatgtcagtttagccacagaaacagccctatatattcttctacaatctctagtttcttttctaccctttcttccctatcacacaactcctaatgtagtttggggcatcaaatatagttcaatacatttttatgccaaaagtttcttcggaattgaaccagatacgcctgatctaaacttataccttcaaaagtctttatgttgttctctgtgagatacacagttactcaaataatcctcccaggcttaacttatcaacagtttgataaattagcttagactgtggatatcctcactgcagcacacctctgcagattcacacaaacaaaggccaatttggaagcactaagtgaagagattctctcctgtttcattttctccattctcctcctaaaaccacaggaaattttggcactttggacattccttttacacaagggacacagtaaaacataattcaactgcttgaatctgggtgaagggagacagcaattaggacagctttggaaaaataagagagtaacaagtaggtggcccaactgtgggaattgaaactacaataacagcttctaatgaacaagtttctacacagagaagcatgccttcacacacacaacagtggtaaaacagcacgaaagacctgtatttcgaaggggcaccagttagatatttaaaactcacgagtatggtcaagatttagtcatacaaatttattatcccttgcacttgactaattctgttatgctgaaagatagagcatttgagcacatttcaacttaagtattgaatccaaagacactgaaatagaaaaaaaatatagccataagaaccatagaaaaatggaacaaaagaaagataagagaaaaaaacaaaattttctcggtaactgtaactacataggaatgaaaaaagttgtaactatacagcgttttaaacagtagtcaatgattatatgtaaatattgtttttgacattacaaatataccaattcaagacagacctgtaaagtgctgctttttctgtagtcatttacattttgagacaatgagacaagaatacaaggtccttttctcagaacaaatttccctgcaatagtcacatcggtacagcttctggtattcatgtaaaagaacctattagttgactaaaatacccctgtaagttcccaatcatattttgttactagggtatattctaatttttttcctacgggaaaaaacaaatctgtacattcaggcttcaggaatatagttggagtaaagagaaaaatcaggatttctgccctgcattatggccaaaagataatggattcttaggctctttgtcaaaaacttcctactttacaattgtccagagcaagcttctggacagaaataaatttgaacccccaaagattcttaaattcacaaataatcagaaacattcacacataacaccacatcagagcttccatttatcaagagcaggtatgcagtcattccttgagaatactctaattcttacagcccaaactgcatctactgtatagcttgctgaatagaaaaagtgttggaggtggtggcatataatgaggctggagagtggaaaggaataagagcaatagcatgctcaaggttttggagttgattacagtagaaatcatcttgctcaaaatatagtgggatttatgcattccagtgccacatcatccaccattatccatctaaaacacagaaaaggcagtgagaatgtagtcattcatgtgtggtccccttgatcctgctttgccttcaatttcattactgtctgccaaccaaccaattaatctgaaaacttatcagtggtgctactgcatatctggcatccctgccccaacaaaactggagttctgtgagcgagtttaaaataacctagtgaataggagcaaccacggactaagagtgagaagggaaaaaaagggggaggggagaaggaatacagggaaaaaagggggcaacttctggaagcaaatactaaagaaaacatgaaataaaaactttatgttttaactttttaataaatcatggggcaagggatagaacacatgactctttgaagttttagacaataaatcttggaaatgggttgttcgattattatagtacccctccgagggcaatgaaaggatgtaatgaaaaaaatcaggccatcagaacaataaattatcctgacttaccagaaataccagcaaaatctttcaatatgacctgttactggccaaattaggaggaaaataacatccagcgctagggatcacattgaaaataatttcatttgattttcattaaaagctttccagatagtgactggtaaaagaagcccatatattctatctatagtttaatgtatatgagtactacaggaaagaagaaaactttagagataatctatttgcaaatatttccggggaaaaacaaaattgtgagattttcctatgatgaaaatatagtaattataattatttttaaaatgtattcttttattttttaaaaattagaaaaaatgttttacatgtataacatgatattttgaagtatatgtacactatagttaaatccagctaattaacgtatgcattacttcacagttatcattttttgtggtgacatgctatttaaacatatcttcccactctgtgagctcacctataagttatcttcaaaatctgataatacattgcatgtcattttcttattaaaaaagcattttcacataccttatcttgtgatacttaccatagcactttgagaattatttttgccatttatcagaaaagaaaactaagttcaggagtatataactaaattagccatgcacataataccagcaaatgggattcaaaatgggattttttgaccccaagaatgtgccctttctatagtactgcaatacagctgcaggcttgataaatgattttgaaaaataattaagtttttttagattggatttgattttggggccagcctaaagttgtatggcactaagactttcatacgaaataaatgattaggtaagataatgccattaggaactttgaaaaacaggtattatctatggctctgaagataatttcaaagggcattttaagaagagttttgaacactaatagttactattcaaatctacgcacatttcaaaggtaactgatttaaagttaataatagctagcataacactttgcacacagcatacactcagcaaatattagcaaaaacccttaaagtacttccatatataagcactggtaaggttttctaacaaccagtctcatcagaaaattacacatgcccattaggaatgtaaattcaggcagattctcttaaaatagctttgtgaaagttattataagccttaccatgtctataaattttggtctatttattccaatttgagaatttagcctaaagaactaatctaaaatgtgagccatgatttttttgctttctcaaaaatgtttactatgatattatttatgtataaacgttgtctttaaaaaaacctgaaaaaacaaaaacaatgtcaaaacaaaaacaaacaataggggcctcattaaataaattgtattcatttaatgaaataatacttagatattaagactttaaagaattttattcatataatgaaaacttctaacgcaaaccttcacaaaaaagcaagagtaaaacaaagattatacctgtacacactaaaatgtaaaaagtagccatctctggtttgtgaaattacaattttctccttgtcttttaaaaatttcttatattgggtatcctgtttttatacagacatctaagttattttataatcaataactcaacagtcaaaattgaatttttagcatgtgtcaggcatagttctaacctttttgtacatactatataatttacttttcataaataccattgatatagaaaaatttactttgtttttatacgtggaaacaggcagagagatattaaataactagcccaatattactttccaaataaatatttgacctgggtcttgaaccaaatggtctgattccagaactcatgttcttcatggcgttgctatactcttcatgttacacaggctgcttagcgatatgtcagaatatattaatgtcaaggagaaagtgatctcatgcaactgcgaccatgtctataaaatgttataacctttttggtgagatggactgatggtgtattaagtgtacttagcttacctcacatataactagttttcatgaatgtgttacttctccttcccgagaatacaaaagctgttttacatagagggatattacatctattttgtaatcatatatttacaaccatttatggtatattaggcactggattaaaagctggaaataactagcaagttatagcattcattgccataaatttaacactaccttggagtgggcatacggttttaactgaaacagattcttgaccatgggaatggaggcactaccttaagagcaaagagattcagattgtttccttgctagaacatgcttctgaggcactactgactgtatagatcaaagacagcacaggtaatgttattgacttcagaaattcctgctatattcactggctaatattatgtccacaaaaccacagctgctaaaattgcaaaggcatgagtcagtcatgacaataatttagagtattatcatgataagctcaactaggaagacaccaacctcattttactatggatgaaaactattgatggatatttttggtattattgattccatctaaatatcctctgaaatgctagagtgtaatctaggtattttttctggttatcattgctgatttttttttattatactttaagttttagggtacatgtgcacaacgtgcaggtttgttacatatgtatacatgtgccatgttggtgtgctgcacccattaacttgtcatttagcatcaggtatatcacctaatgctacccctcctccctctcacctcacaccagttagaatggcgatcattaaaaagtcaggaaacaacaggtgctggagaggatgtggagaaataggaacatttttacactgttggtgggactgtaaactagttcaaccattgtggaagtcggtgtggcgattcctcagggatctagaactagaaataccatttggcccagccatcccattactgggtatatacccaaaggtttataaatcatgctgctataaagacacatgcacacatatgtttattgcggcactattcacaatagcaaagacttggaactaacccaaatgtccaacaatgatagactggattaaaaaaatgtggcacatatacaccatggaatactatgcagccataaaaaaatgatgagttcatgtcctttgtagggacatggatgaagctggaaaccattgctgatttttaaaatgatctatttaagaatctttataagcagagcccttttttcttaataaaggaggaattcagaagttaataacattggtctgctttacatcctatacttgttttccctccaaattatatgaaagtcttatttcaaatgcaagtgaaaacattcatgtcctgtagcttgagaccttactacatataatatcactgcacagcatgatacaaattaacgtctttaagagggagctcaaaggcatacagaagtataagacatgccaagaagtttcatttaaatttcctttgttcataaggcaaatttttatatttactaatccttggataaatataacataaatacatagaaaaagaagcattatgttttcttaaactataggttgacccattgcaagcacatgatgatgcgtctcactaggtgtgcatgtagtaaaacagattgatttgccaaccaacagttaagaaaattaatttgttgagcatcatattttatactaattaaaaaagaaaatttgtaagaattatgtaagagaataacctaacattaaatggcaccataatggcatgaacaatttagaaacagaaagtcaataccttggtttctctaatataaatgtgttgctcatgctcttcaagcattttatgaaatgaaacatgaatcaaagtcattacagagctaatgagtgaaattgtattatttgctgtctctcattttcagtgttgattttgttggaaaacagtatcttaagaccaaaactctgggaactgttgagattctggccacaaagacagctagaccgtggggaagcaaacatctgtacacatctgcagccatatatgaggtccctcatgagacttagcaacaaggtgtgttttaatgtgacagtgtgtctgatgtgtccccagcacattgggaccagtacacagtgttatttgtacatctgctgagtaacattgagtgtgtgggtaactaaagccctcagtaattattttacttaatgttttcaagcttaattctgatcttgtacttgcatgatttattattccttgtgctaaattcttcaatgttcttgccttgattgatctttcattatctatcacttaactaaaatattaaattctttaattaagtcatgtttaaatgaggacttgttttagtctcttggaggtttattcattgcttaggtactttttcaataactcttctcttgtttaaaatcaataaatatgattaatttgccatacatttatgataggtcaatatatttattatggaaacatatagctaacttgatttgaattaaattggtttatgcctacagatcaatattgttctactcctacaaaatcaccttgaaaaaaatactattggttaaataaagaagacaatgatgtatatttataagacaataggtatcaaccagagaaaactctttgcagttggcaatattgggaaagaaggccacagacagatttatgtcatctagatatcaaagagaatgaaatacatggctcagaaatttgttgtaaaagggaatggactcgtatttaaggacaggactctgaggactattcatggaatgcatgaagaagactgataaggatagcctataaggcacagtatagtagtatagtagaagtgcaccaactatttctccagacttgaacaaccaagtctaagagtaagataaggtaagacaaggtcaggaagtctcagggctggagaggtggtgatgttgctgaataattgctttttaaagctggaggggacttccaagagtctctcatttaagaagaaaaattaaagacataattggtaacggttttgactgctgcagaggcaacactttgctcacaatcctacagatctacttcacctgtaactacaattttcctgaagacatagaagaaaaatcaattgttctaatccatatggaaaaaaaaaaaaaagaaaactgccaatgtggtttgactagcaaaccactggagttgtggcttaagcataaaggattacttcttccattgccactaatctaattactttcccctatctgtctccattccagcaggcatgtttagtagccaagctgtattacaaaaaaggataggatgtgggtaggtaaagcaaacaaacggcaacatcaaatgcaaagtctttcatttcaaaggactaatgctctcttattccacttgtctccaaagaaaagcaatctcaaccaggtgtggcctgttatcccagcactttgggaggccgaggtgggtgggtcacctgaggtcagagttagagaccaggggtgggtcacacctgaggtccggagttcaagaccagggtggccaacatggtgaaaccccatctctactaaaagtatacacacacacacacacacacacacacacacacacacacacacacacacacacattagctgggcgtggtggcaggtgtctataatcccagctacttaggaggctgaggcaggagaattgcttgaacccgggaggcggagctgagatcacgccactgcacttaagcctgggtgacagattgagcgaggctctgttttaaaaaaaaaaaaaaaaaaaaagcaacctctccacttttctgagacagcaagcacagagatgttcaaattaggttgactatgccatacttcttaattatgtatctgcataattattaatagtgccctcttttactcacaaaagtgctctgatttggacaataagttatattgttatcctaaatacattgtgacaggaaggtcaacttatataagacactaaaacaaatttgacaaaattcattttagtagatcatccatttaacatatataattctacaagttcataacttatcaagactcactaagaaacaaagatttaagctatttttatatatttgttgtctttcaaaatgtttctttttggcaaataactttactttaaaaagtaaggcatagactaatttagaaaacaaaaaaatatcatttcctcacactttactctaaatcttattcagtgttatgtcattttttaaaaaaatttttgctttctcttaggacagcaaacatttttgagatggaagaaaacccatagattatttacttcaatgccttaatgttactatcaagaacactgaagttcagagaaatgaaatgactcacccaaagctgctggtctggtctaggtagcgaccaactaaccagaccagtagcctaatgagccaagttggttctggaactcctgactcctaaatacttgtttccttctgcattccattctgtctcctggattatattctctattttattaggttggtgcaaaagtaactgctggttttaatttaaaagtagtaacaaaaccagcaactacttttgcaccaacctaatagaagcctcctatcaggaagaacttcatcaaaacctagctttgccctaagcatcacattttcccactggaaaagggtagataaaaaagcaaaggaccaaaaataaaaatgataatttaccaacctctctctcaggaggcaaagtacagaggtctctgcaaaggagcattttaaaatgtcttaggttattgatatttgattgctttttgaagattatgcagagttctcctatctctcagtcttgtgattgtcttcagtatgaccaattgttatttttacttatttttttatgtaacttttcttttaggtttggggtacatatgcaggtttgttatataggtaaactgcatgtcatgggggtttggtgtacagattattttgtcacccaggtaatatgcatagtaccaaatagatattttttttctgatcctctccctaatatcaaagaagagcaacaactttgggaaggttggcccaggagacatcattgggaattgtaaaccaaacaagaaaaacataatcaagacatgtttcttaatattcaatttattacaacattttattggctctcaaagcaagtgttaggattagttttgctgaagaatttgacaattttgtttgtttcttttgttttgtttttgtttttctgagacaaggtctcgctctgtcacccaggctggagtgcagtggtgtgatcacagctcactgcaacctagacctctccggctcaagtgatcttcccacctcagcctccttagtagctgagaccacaggcttaagccacagggataaaatgaggatttaaacccaggctagtatggccccaaagcgtgggcctttagtctttatgttaccagcagaaatggcctttggatggcacagtgtccacaatgaacatctaccattcacttttattccatgttcatgtttaggaagcaatatgtttaaaatgaagatagctggagtcaggcacactgatagcttggatggatacacacacacacacacacacacacaaggtaaacgcacagagtcataaaacagtaagctggaaaactttagggtcaaagacccagatctacttcaaaatgtttcaagtgcttcatatataagaattgatcatagaattaataaccaaataatcaaaaccaggtcgatttaaaagaatatagtttacaatagctatagaagtcatgaaatattgagaaagatgttccttccctaaaataattcaaacctatagaggacacttaaattatccaaacaaataacaaccgcaagatagtttagctctagatattgtcagataaatatctggacttaatattctttacattattttatttgttttatgtttacttctacacttatatattcatatttactgtttattacattacattatattaatattattccattttactagaccatgtgtaggtcagataaattacttcctagaatatatcagcttatagcatcccagaaacaacccacaaagggttcttctttgcataatacaacagctcagaaagactcccatatctgatcttttgtcttttctcagtaatccgtctggcctacttcaacaacatgtcaggatattctgaggtactaggccacctgagcctaagacctcaaaagcactgagcctcagctcatcagattcctggctaagtactttcaatgtctgtagtagcctcatttgctcatgcttaataagctcataccatttagagaaaggactcaagtgtgagtaacacatgcttcccctagtaatgcacagcattaagaagcgaagtagaagacaaaactctctccctatttcacattcttctgagttcattattgccatgaaaaacgaatcagatttgagttgttcctaatctctgctcttctggtctccatcagagagggcagccaaactgtgacaggagccatctgggatggggacaggagaggagagagagccctgtagttttcttctggggaaaagcaggcacagggggtaggttgctcctagagtggacagcaacactgacagctcatcatcatttattctcagcctaaacaccagtggcaagagccccatcaggtggcactgagagaaggaggccaaagaaggcacagagaggctttaggggtgactaaacatacacactgttgtaggactgaacattcgtacatccatctcctctagtaaagcttgaggttttctatggcagaggctatgtcttaggtaccagtgttgtcacagcatcttgcaaggggcttggcatgggattgatgctcatagaatatttgctggaagcaggaatcaatgaatagggcccagcccttctggattccaccggctacttctggcttctcaaacacactcaggcacgtacacttgatttcaaggacaaagttgctgtctatttttaataaagaagcagcttgagtgaatcccatttctatttccttactctcatactgtcttctgtttgcgtgagcaagagtatggactaattccaggcttcagttcattttagtcacagcagaaatctaatcagggctgtatattctgtctctgtccctctgtctgtctcctttctctccccctccttctttctctgcctacctctccttcttactcaccctgcctccacctccttctctgcctccctccatctttgcccctgtctctttttctctctctgtcaggtgatatacaaatcccaggaacacagatatacacactgaactgaatagctcatttttcaaaactgtgtcaagattgtaatggttagtgtgcaagaaggaaacttatccttgtaacattaggatttttctttttctttaattgcgccctaagaattaaaccctatgcaaataggacttaattttgcgttcccactttttcctttaataattgtgtgtatatgtgtgtgtgtaagacaaatgttctttgttgaaagctaacagttgcaggcttcttttaaaggttataattatatttataaacacattgctatcaggtttacaccaaatagaccaataatttgccggcaaaaggtaaaaaatttaataaaaccaccttgttcgaaaacaaatttgttatagaaacacctgaacattggttttgtataaagtatatgcaagatgtaactggacattcatgtgattttaggtagaattttttgtttgttcttgtcctccagagaggattcagaaataagaatgacttggaattgggcatttaaaaaatatatctaaaaattctatgtgctgcggaggttggaattctaagttttttataagatgaactgccatgcaggtcacttattctaggaaagtctcctaataaataattcttactattaaccacctccagggtcacagaatatgttttaacctctttttagtgctgacacaaggtaatagcatcccctgatactaattctttgctgtcattaatttggattgtctggtaacacattaaaaaaaaaaaacagaccaagaaactgctatttcaagtacgaagaaaagctgcattcattattcagccatataaggaagttaaatgctacagcgccaaagcaggcaatgacagaaaactaggaataaagaagtttctttttaaaaactaggaacatagggaaataaatattgtgtgagagaaaaaagccaaaaccaacaataactaggtaggtcagctacacggagggactaaaacattaagcattcccttgcctctcaaactcagctattcatggccttctaggttaatggagagtggggcacggggtgcaatgtggttaatacacgttctagaatcccagaaaagataaatgactgctctagtttctcatcttctgagcagcttgagcatgtgttgaggttactgtcactgcaccacagcctgatacatattcctccttgtgtatgaaagccattcaaaggaagaaacagccctgaataagactctatgggaattacagtcaagcagtgctgctgaattctggatccaccctttattagctgtgtgacccagagaaagttaaatctctaagcttcaacttcttcatctgtaaaatgagtctaataagagtagctacttgatatagttgcaaagattaagtcatacggatactttaagaatagcatgaaacttgttgtttaataaatcttagtgccatcaccatcatcaccaccaccaccaccaacaccaaaaataatcaccactaccgccatcatctccaacactatcaccaccaacaccatcagcatcaccatcactaccacctccaacatatctagaaccaccaccattccaaccacaaccatcactaccaccattaccaatatatccaaaatcaccatcaccaacagcaccatgaccatcttcctcattttacaggtgagaaagttgactcagaacctcagtaactggctgaaaggcacaaagctggtaggggacagagagctcaaatttccaagtttagcgatcctcctaagcccatctttatctcaggaaatttgtcatggaaaaatggtgtggccttggtttcaagggtcaccacaaggcttcagaatacctaggaccccagatatctcatatgtaagcatagaaaagcaaaaataaaatcaaaaaactatatctggaaaatatcttagggtattttattaatatgtgaattgctaagtatactgcaacacctggttgccctgttatcatgagcaccagcctgaaaggtgagggactcaggttctgcttttcgttcttaccttcatatcttcaactgtcaccaaagaacacaatgcctattcccatatttagccctgtgaagacactataggaaagaaagaaactgtcatctacagcaccaagtcctcaggagaaaggcaggaaatgaaaaagaattgtttatttagcctggctctatagtgaaacagctgtataagtctgtgaaaagaaagggccctggcttggctcaacctttggcaaatacatgggtattatgtaggcagcatgtcgagccaggagaggaggcaatggaggagatttcctctaatgcttcccatattgttaattgctgctttccctcccagggccttctggacttcccaccagaaatccagggcaggaactgcaaggcactatgggaagacagcagcttgagtcctgcctgcccactcagcaccttccactgggaccctcagcgggctcacccaaggcagttacgaagattatctcatatgccacttacccacagtacattcagctatcttctcaccctttcctgccacctggcccagagccatttaactctactgttgcaaggctaaacttctgagtttcatggcatttatactgtaataagggactaatcgatgttctaccccaaacagtaaatctccaatggtcagatttcagccatggaggaaatatgatgaagatattttataggaaaacctcaatagttcccatgatattacaatgttgcctataggcaattttccacatctcagctttgttagctgacagagaagcaaaataacagcaaataaccccttgtatgtcttagaccctcaaggttgctctactcaaaagaattaagtatacttaaatctccttcccttggttaatggtgtcctaaggaaagaaagcaaagaaaacctcttcccatttcacaacttagtgtaaaatccattcagattttacaagatggtgacagagcaataactcttgagaaaatgatgtgacaatagctaattgtcaatggctaaggactcctcaaaagctgctcaatatccataggattaaagtaaagcagaaccattcctagagacccaaggactagttaacaaagagaaaaataaagtactaacaatattttactacaaatctgttaaattctctttaggaccttcaagaggcaaagtagtatggaagaacaagcacataaccttttatttcaaatagaaaagggttcaaatcctagatccataatttattagcactttgaaaaaaattaatctctctaagtttcagttttttcatctgcaaggtcacttacttcattgggctattataatatcacatgtatgaaaagcatttgagaacgggaaaacaatacgataataccattagtcttccaaattttgtttctacacattccacaaacaaaaagggttctacaaatagcaatcctttaaaggatgtattcaggttggtttaagtacccttataatgatttaaaatcccattatacaaaatgtacttttacttagcctttcattaattttgataatggtcctgtctattgaaactgcccatactcttagatttaccaaggtatgagtccatcttacaatgcacatcccattttccttttaaattatgcttttgtcctccaaaagcaaatgaaaatattttatctaaaatcaaggcttcctatagtttacaaaatgtctttaaaatgaaatttgtacttatcagaatatacaccatctcattatctcccattttagagtataaggagcatattttttctatttctgttataattcttagcccactgatggccacaaatctgtagcttattaagtatgtgcagattaactgatatataaattctcctctgcccctaacccagtaaagcaatcagccttctatgtaatggccttgaatgatgactaagaaaagagcccgtaatttaaacacttcaatgtggctgaactatgaaatctcaattgctaagacaaaattcctttacataatgatattataaccccaagctttaattagtgctggaaaaataagattataatagcaaatatggcaatctggttgacaccataaacaacctttctgcacacaatcaatttaagctcctggcagtactaaattcagactcataaatgttttttggctcttatcctatcttatttttataatagctatgcattcagaaaacatgcatttataaaaacatcttttagttataatttaggtttgcagatgatattatatgtgatttggctctaaaaagacataaatattctgttctgaaaagataatccactaaagcagaaatccattcaaatgctagttattccatacaaatttcttacattaatacattacctaggaaaattatatgtcagtataaaatatcatacctccatcgtatgctttaaaggtagcagataaaattctactgctataaagtaaagcttgaatatgttggagttattaaattgtgtgcagaaattagtatgtgctaacagcctttcttgtcttgtgatattttttctaatatttttcatcatttctgatttctccacacaattatccttctgttctgatcacttcaaattttcttaatatcttcatttcaccttgtttacatctggctgtcttattgtattttgttctactctcagaattgaattgccatctcacatagctaagtctatagagaattctatagaattctctagaacaagaaaagaacacaggtcccataaatagcaaaaacaaaatatttattttccctggaatataataataattccatagaacccatatactactgaaattttttttcctttctagtcttttttccaaaaagagtaaaatgtgatataaatattgagcatcagacagctatattggttaagatgtcttacacatactatttcctaaagttaatgaagttacaactacactgaaaaatataatagttgttaaaacaaaattaagtttgggtaggcccgttgtttaatatgttatactatgactaggaacctctggtaagctgatattctaaggagtatattaagtaaataatctaacttgcatactctgatttttcaactctgtactttaaatatataatactaaacgctcataatcttttaaattgtcttccaaaaataatactattgctgggctataactaattaaatttgatttgtatctacattagttaattagccttatcatttttccaaaacagttaagctaatgttagaccttgaaataccaaacaatattttgtaataattattaccattaaactagaaccattaaagaacaatcattaacagcacttcaaatgtgtagatattacctaccaaaccacaaatcaaattagcatattcttaatttattttttattagctgttaacattagacagaattccctgttgtaagtcaaaattagttggcattggtttagtatgtgtcattgattgagtttataaaaaagcatgtgctagctgttaattatatctatttaatgggattttgctttgtaattttaaaatgttttgctgagaatatattttattagaaattacaagcatcacttatcacttatcaaattgaaataaatcaactcatttatgtgagaatatgaataaatatttatagacatttttatattataaatttaaatgactatttctacactaaaaataagatcaaagattaggaatctatcttgtttttggaatccaacaatcattaaagctgtagtgcctcttattctccatccttgatcagattggaccttatttctacctttgttagggacttcttaaaattagcctttaaatttaggcttttccaggaatctctttatggtgctctggaaagaataataaagtctggctttgtgcacaacattaaacaaacatttttttttcaaagtacttaataaagcttggtggcgccatcagccatgtttaagtactgtaggttttgaaggaggacatctttcaagattaactatgtaatttgatgagatataaattcattcttaaagataagttgggtttaatctacatagtctgactccattgcacgatgacaaactctttcacttggatctgactgtatggaaataagacaactgccaaaggaaaaataatccataaaaaaataatgttttctaagctgctaagagggcagcacaactccatttgacccagcaatcccattactgggtatatacccaaagaaatataaatcattctgttataaagacacatgcatttgtatgttcattgcagcactattcccaatagcaaagacatggaatcaacatatctttgataatatgtttttctagaaaccttgtgtttgaatcttggtgcttaatttaaggttaagtcccagccaaacaaatctgtacaatcaacagacctatttagcatctacaaagcttgtcagtaatacaactctacgaagtcaagatgaaatctcttcaaaattaaaaatctagaaaaaagaaaaatgtagggctgtaatttcattccacttataagttaaatgctttgccatttctaaaatttcacatttcaattaagcaaatgaagtatagtaacaattttatagagcaagaaacttgcgattgatcttcaatactcctaagaacatatatatagagatggcatgaattattagccaattttcaccaactccaccaatgtttaccaattctcacaagaaatctaaatttctaaagatggaatgtggcaatattccttccaatttaattgcataggatgaatgttttaaatggaacttggcagaataagttattctatcaaatcaatgtcaatcctttttaaaaatccttttccttattcttctgcatcgtaccacccaaaagaaggttatttatggtttggtaaaagtcctgaactgcagaatagatagggaaagactgcttttcagataaaccagtatagagtccttattcttaagaaaaggtaagattaaattttcaaaagaaaatatgcttagtcaaacaaacaaaacaaaacacagatttaagttgttttaagggctacccttatgagttcatttaacgacatgaaatatacctttaacaacacgcagtacacttttagatggattacaagtgctatctactacagaagggttcaataattgaaatgattagaaaacataatcattagggaaaatataatcaatagggaaagaattcctagcaaaggaataaagttcatttgtgttaacctgggcacacatgaactttccaatgcaagaccactgaaaaaattctttcttggatatgaaggatattaatttgctactagatcactatctttcagtaaaataagtatcccaacaaaacacatctcaataagtgtaacactaacaacattagaattaacataaaatagatattaatcaaaacactttgctccctacaaacatcagaagatggatattataatccctgctttgcttgatttcattgtgatattgtactcgacactacttatcactatagtataacaacaaagagatgtaaagacactggaaggctctctcaggaaaatctgttctctctgcccatcccctccccctttttggtttgttttctctcactttcagtaggagaaatttcatatttaaagagcatgcattcaccatttggcatatcatatgccattatcgtaagagttaactattttcgaactgtatttatatatttatttttcttccctgaaatttctaaatgtccagtgcttcaaccaacataatcattcattttaacgtcgtttgttgtactgaagatattatagtcagcctccctccctctctccctccctcctttccccccagaaattgttcatagagtcaaattttctggtttgcttttggtgagttgagtgcaacacactttcctaggcaaagggggaacagccctctaaatatcaactctcagtcgaagaatcacttaacaactgggtacttcatattactacatgagcacagtgccactgtaaagtaccacgaggaagaataaatttttccttcttttctctgacctgctccctgacaactagacacgtggacagaaccttatttctctctccatcactgtatcagtggggtacagggtttgtttaataaggatgtaaaataaaaccggacttgaactacaaaagggctggatggcctttcccatgttggcataacactgaagaagcaggattggttatgaagtcataatttagcattggcatttaagcagaaacattaacttatattgtcacaaaacacaatgtcacataaaagccacaaaaatattttcagccagccctggtagccaagaaattattttcagggtgtttcctttttgggttttcccaatttgtactcagaaacgaagttagagacctattgtgatgttttaaatattccttttctgagtatataccatgtgattcaaaatagaagaccaatttctcagcctgtcttaagtcatctgataaactgtgtcccatcactcattttatcatagtcacaatgtagttaaaatgtgtaaatgtataaaagtaaaaataaaattctgatgtaaataaatttaagatctctgtgtgcagagcatattgataactggcacccaagcaaagactgatatcttgaaagggatcttgtataaaagctattccattccttgcatgctatttaatttaaaaaatgatgcacagactcacattcataaacacactgaaccacacacacacacacacacacacacacacatatataatatagaacttacacaatttcatcattctggaattcgagctctccacaagtgtcctcaaaatcctcccctccacctctggcagtcccttcgatggttttatatggaacgataacatttcctcgagctccagatgttctcaatactttcacctccatgatgccaatgctctcactcacatgagtcacaggttcctcaaaagtaaaaatgcctgcgtggtcatcatcaaaaatagttacagtggcagtggagggagatccgaggcaagcaagtgtagaaacatgattggcttccagtatgccatcttctgaagcttcagaagatactttgacattgctgagatgcacaaggaaattttcatcctcctcaaagatatcatcatctatgatacccactctgatttccttctgggtatcaccaggcttaaacaccacagttccttcagtaaattcataatcagacccagcatttgctgtgccatcctctgttctgaagtcaacaaacacagtgttagtcaaatcaccacctctgcggataatggtaagggccacagtaccacagttctccagacactgatatgtcccttgttcaaagaagatcttactaacagggtcattttcagtcacttcagtgttgacctcgtgcatgctgacagccttccttgcttggtcagctgcatgcctctttaaaatgttgccagctccagtcatgaggcgagtagcttgaatgcgataaaatgctctacttttttgctgctgacttaggacttggtagttagctaattctattaattgctctatttctttatctggatgcttctgcttaagttccttcagaatcctagccatttctcgcctagcttcttcatcatcttggtccctctcatccacctccagaaccagagcaccatctaagaaattttcaacatgagaattgaccactttcccgtccatttcaatttcagtcttagaagatggcctgtctccttcatgttcaataatcatccccctctgcttgccagctcgatacctcttgtagacatacttgtaaaacagaagtctcctatccgctacccaagcgaacacaacacagatgggaaagaagaagaaagtaagcaaaccttcccagacctccacaacaccaggagatatgacagacaaaataatgtaaagccaggtgtaggcaaagatgctccaggctgctgtcacaaagaagacacgcaaatgcttaatcttccttgtctctccgtcaggcaccacataaacacagagtgcaataatgatgaacatattgaatgcagcacttcccacgatggtgctaggaccgaggtctcctgcagtgaagttatggccacacacttcaattactgaaaggagaatctcaggagcagaagatcccagggccatcaaggtcaggttagaaactgtttcattccagatcctcacagttgtcttggtggtctctccattgggtttctttatggttatttctttttcttgagatgtgatgacttctatagaggacatgaaccgatcagctatgatagagactccaagaaacatgtagaccatggccacaaaatacacagtagctctagcaattttgtccccaaaagaagggtcttggggttcccaaatgggcaaaatcacccctttcttacagtaatatgatccagtacattcaccagtttcatttccttctccttccatttctgtctcagcaattacatggtccacatgggaaaataagagactcacagtaactaacagatgaaatcccattgaaaaggtgggtgaaagacttaatcgccgcatgttgtacatgacacttccaactgtcacaacctactggtaaaaataagatgggggagagggcagaaaaaaagtcatgtcattagagctgcagccaaagcattactaattacttatttttattactcttaccaaaatttgtttatatttgaccatcacaaaaccgaaatttgtttatatttgaccatcacaaaatctatggtgaatgattgttctaagactccatcagtgactaagcaatcctttgtaaagtttacaactcaatctttctgtgaatttactacatgtagtacccattcactgagcaagatacacaattgacttactggaaaggaaaagttcaatttatatagccttgccttattaaacacacatttatgcatgctaatagccaaaatcacaggacttttgaagcattaaacaatttcctcctttttactaaagcagattttcttctaaatttgtgttagtacatcatcttccaaaaacggtttcaatgccaaaagcaccttattacaattgatgctttgaaaatcagactccgaaaaaatcccaccaacacaaggcctggtgattatcttaaacgccagagagcatcttacactgtatttcatgaaatcatgtcctattgctccacacttacttggaaacaaaacttcaagcttgcctgaaatcaaagctcaatggcatttgttcttgaggagaaaaaaattctgctataatgcaatatttccacacattaagtacagtttttaaaagcatgttttgatgagagcacatttctttctaattttcagccagcccaggtctgctgatacattagcagctgggcatctggttcttcaagcacagctcttcacatctgtgtacagagcctgtttttctgcaggctggaaagggagataaacaggccaaggcctagttgtgggtaagcgcctggcaggctgtggaatcagcgtcaccaaccttaaaatgttccttctcggtgtcggtcatattttccatggtcattctaaaatacatattagttctgtcgagggttcaagtgaccaaaaaatgcaggaccaataattccatttaaattagctcatgtggcatgacaagagtgaccacaaaatatacacatgatgaaggactgtaggcaaggagggccatggcaacagagtcagtgagcagcacacaaagcttggtaggcatagcagtggactcaaccaccatggccttaagtccacccaccagctcaagcaaaactctactcagaccttacatcccttctgcttccagaacctgggatggaggtgaggggaaactgaagtagaggaaggtctgctccaagtcaaggtgactgtctcccaggccttgcaggatggactagttatgacatcagataaagcagcaataggaagaagccctgagtcagaacatacccttatgtcctggaaaaagttaaaagaggaactggattacaggctttcatagcttcgggctggctgagagccaccccacattcgcctacactctctggctcatgtttgctgctgatggcttatactgcaaactgcaccagtgcccaggagaacaccgctgcctaggacattctggcagaccctgagagatcccaccatagactaaagccctttatagctcatcactacagggagataagcttctttgacatttttcccatactaaagaaaatcagaggagggttatagcagtagaattcaaaactaagtaaaaggctgaaaaatagaggtagcatattttcaaaatatgcaaaagttctggtcagtatgtctgcttgttcagtctttgaaaggctttgagatttctgcttgaaacaaggtgaaatttaaccatcctgcaagaatgttggaagatctagttccaactcccttgtgtatccatttcatccacaatatttatgcatgcttaatatgtattttagaaagacttactagtctgtcttctagatcctgagaattcaccagtgataaaacaaagtctctgtcctcacagagcttatattctaatggtggaggaaacaaacaaatataaatatcagaaggttaaaaactcctatggtacatgtgtgtgcagaacaatctatagaggacaaggagagtgtgagattgtgtgtgtgtgtgtgtgtgtgtatgtgtcagtgtgtatacacgtgggatgcatgatttcatactagatggttaaggaaggcctctctgataaggtaacacttgagcaaagtcctgaaggacacgaaagatcaagttttgtggatatctgtaggaaaagaattccagcaagtgcaaaggtcctaatgggaatcatgcttggcacagtctaaaaacacagaaaaccaatgtagcaagagggtaatggaccaagggggcagggctcaggagtgggaatggatcagagaacactgaattgccataaggcatgggctttgatggggtagaagatgagaatcactgggaggttctaatcagagggtgatatgatctgatttttcttttagaaggatctctctgctggttcagtgcagaaaagactgaaggggcaagggtggaaacaaggagaccagattttgcctactatataaaatctaatttataagtgatcccaatacttggcaggtatacaaaatggtacagaagatatttaacatttaaaatggtgaaagaaatgtcttggggacctgaaagaatcagaaaggtgaaatatttgtgataaatagtagtactgaacataaacactgaagggagattcaaacctgtgtctgtctccaagactgatataactaaccactcccttcaaattactgccaaatcgcatcattccattcttcacgtttcagccaaaatgaaattcctaaagtgcagatctgacactcttcacgtcccttaaaactcttcattggtttcccacttccctgaggacaaagctcaaacccctcaacaggctttctaagaccttttatgatctggcatctgagctccagaatatggaaattattcccattccctgaacaaggtaacaatttcttacatccaagtctttgcagattattctgtgtccaaaactattttgctttttccttcttagaagcaagtttcaaaagagctgaacaccaaattataaccaatttcctgagagaatactagattccattcttaaacagtcacagataccatgctaaattgtctctatacatatcaattatatttaatatttccattagccagcattgctgttataaaatgcctagtgttgctatttccattatagtccatgagaacagcacccctggagatgtgcaatgcacagtaccctaacaataatcctaaatagtaggtactattagcccatttggaggttggataactgaggcttagataggttaagtacttgctgaaagtcatacagacagtaaactcctcaactaagacccaacccctggtctttttccaagactgatataactaactgctccattatatcatccctgatagtgtgtgaagtaatctttgagaactattggggttggcttggactagcccgttggaaagcctcttggcttccatgcagggtcaggagggcctagttagcaaaagtcttgtggaaggtttccaatagcctggcttttatcttatgcattagactcaaacagacaagcatcaataactgtgatgtaacatgagggctagcatgttcctagagacagctgcccttcaatctggtcttttagcaattgcctggcaacctcttcctgcatgcactgtcagggcaatctcctgggccagccaagaaaaagccctgccctttatcccttccctagcccacatcccacaatatgttcttagccaaaaggtcaccagatgtctaaaggtagacaggtcagtaaaaatccatcatcattatcagagaaaaaggaagggggcttccggtgttaactaaaaacattacaattatattcaaaagagagcagtattataatttgtgaacagtggacacagcacactgatgtagcttattggcaatgaagcaattggaaagaactctctggacttaaatttctttttcttattaaattaataccaaattcaaatgcccacgaagatgtggaatagatgttatctaaatgtgagttccttcttcatccttttgttttctttctttcggggtctttcctctatcatcagattcaaagtagttctactaaactctccccattttccctcaaatatacatttccatacaaattaagcagaaagataagaatagagactgtggatatgttgatttgctgcctggctttcttatattctgccttaatttaccaatacaaagtataggctgatttttatggtggattcagatcaactcgtacaactgtgagcagtactaacttaaaatatccattacatcatgaaatgagactttagcacagtatcaagaatacccaaattatcttctgatcactatttattttaaaacaacacacaacccatcacccacagattacagacccaaatgacactgacaaaggatggtaaaaagatatccagctgtgagtagtccagccagttgtgtcggaggaagaggtcacagctacaaggaatagaaacccacatctacaagagatagatccaactgctttgtaaaggaagagggagagcttttggagcagaggcctgaagagtggttggcagcacggtgaccattccctgctggaagctatagccagttttgactaccaaggaggacgtgactcagagcaaaggcatatgctggcattcctaacagcccaatatattggacagtcatcctaatggcatcctcttgattggcagctggggttattccaaggaactccttgatggccttcatcagtacttggaattcccttctatgtaattcttgctgactgaaagactcaaagctaagcaattaatctgtttctaaggcaacattaaagcaaccataaatccttatccactaccaaggcaagcacttccaaatgtttctagacaaagagatgatgccagaggatgaaggcttttctcatctgaccatctcacctaaagtgaaaattactgccctggctccagcctcaggctatcagaccatggccagatttcaggaaaaaaaaaacctcatttacacagagaccctctactaatacctaattttcccttccaaagaaagtttcctctctgctgtttaatactttgggacaggtgccgaaggggatgggctatgagcggtcacatcataggctcaagcctttctcttaaactcacaaaacagaagtcaggcccctgccttatgaccaaaaatacccgctgaaattgtccaggaaatgaagaaactagggtgaaggtaggcaatgtggtcacaaaaggaaagatagacttaggatataaaataacgaagttgttgaaaactcatgagatgcactgttggccctttcccctactttatttttcgagatagcacttattacttttttgtttttgtttttgagacatagtcttgctcctgtcgcccaggctggagtgcagtggtatgaactcggctcactgcagcctgtgccttctggattcaagcaattcttctgcctcagcctgccaagtagctgggattataggtgcctgccaaccatgctcggctatttttttttttttttttgtatttttagtagagacagggtttcaccatgttgaactcctgaccttaggtaatctgcctgcctcagccctaagtgctgggattacaggcatgaaccaccacgtctggccagctcttattacttcttacatgctatctattttattcaatggttctatttattgtctttctctcttcaaaagatgcaactctctaagggcagggattttcatttcttttttttcattgaggtattcccagttcctagagcacagcctggcacttagaagatgcacaacatctgcttattgaatgagtaaagtaatgctcacagggtcacgtgctgattcaccaaatctccagtggtaaaccagaatctgggaaatgggcctaagcatttgcagttaaaaaatgttgtctgtgtgaaatggttgcaccctaacatgagcagagttcaaaatcagattgtaaagtcaatgtcagtgttaggaagagaggaaacacatgattcagactcatgagcaaagactcttgggctggaaagactgatctccagcataacgagagcacctgggccctgacattttccccacaacctgggtgtgtgtcttccagcatcagccctggcttgcttattttatatgctctgttaagagggccctaacactttggacatactcaaggaagtacatcttcccatccttccaatacaattaaaagacacatattcaagcacaacaaaaatcaccttcattgtagaggccctacacaagggaaagaacaccaagcatttaaatttaaatattaatctgcatgctaacacggaaatatgggtagaaaaaagaaagctggagaagagagagtctttcaatagaaaataaataaaaaagaatgtagaaggaagatgctctgataatcttgggctccatgtgaagttagccaggtttgtcctctaattcattatgccagaaccacagagcagggtttaagggccctactcagggcactgatggcaataatgactgaaatcatggactgagcatctacttgtcccaggtactgtgctaattactttgtattcactgtccctgacttttctgacgatactacaaggagatattatcattcgcattttacaaatgagaaaaataaatggttcatgaaagtaagctggctagagtcatatatacttaagtgacagaactagaattttaattcaggcattttgcattaaactataacgatttccaaaatggcagacacattttattttcacgacaataagttaacaatgttttctggggacagagagctcaagatttaggtacttaacctgccatgctgccccttcttcccacctgaataaatgtgtgtaggttgcattagctcatcaaggagcctcacatgtttccactcctgcctgatgccttcccactccccaagtaagtattgtaagcacttctattcgtcacatagcaagggaaagatgatccatgtgaaggatcatcagctgaagacagaggtctgaaatcactccaaactcatgtagtaaactcaaggtttttccatttggtcaggagaaaagcaaatgaagaaagaatccctagcagtaagcaagcaaaactaaaataaaagaggggaacggataatgaacgggagccagggagaatgatacagaatgttgctataacaagtaggttaacactttgctctaataacaataattcagtattttttaaaatagaatttcattgcagctcaaaaatttactgtcttgggggtcatttttcttaacatcttaaatttaagccaataagtaatccaaagaaatgcaaaaacaacacattcgtttatggttttatctgccaagcttttcttagccactcatatatgccagacactgtgtttcaaagataaataaaacatatctccaaaggagcttgtattctagtggggcactggcagaatcaaggagtgagtcccttctgtggaaaccaggacccttccattactagagattcactgaagagaagagactttcctggcatttgaacattgacactgagcactgaagtggactacctagtccccaggttaacgtaccttgagtcttgagttaataaacccagcattctagaaatctcggactgctcagactgtggtcctgcaagctagagatttcaattataatgagctcccagaggcagagccttggactctgtacatctttcaaaagcctcctgatagacaatggtaattctttcacataataattgttcaccactaaccctgaagagaaacagcagcctttctttgatgtttgaccttaaacactgaaaaagaatgaggtcatatacatgcttttatatctaggtcaccaaaaaggattttctacctaaaaatatttccccaatagctggttgacatttaatcttaaaaatctgtatatatagtgagcccttcctatgtttctagttctagaggcaatgaacccttcatttattcatcaagcctctatggagtagcttctatgtgcaaagcaccataacagacactacagggattgcaaatatgattgacacgtggtccctgtacttactaaatttacagtctgcaagcgacagttactccaatgaccattaatactaggaagaattgacaaaatgtcataaaaggaagggatgggaaggatgacaacggctagagaatgtgacagcacattctaaaaggaagaaatgatatggacaaaggcatagagcaatgattctccaacttcagttcacctaagaatcacctggcaaactaattaaaatgcagttaacagggccctataatcagatacagttgaggaatctccaaatttgaattttaacaacaatcccaggtgattgtcatgtaggtggtcttggaccaccctttgtgaagtgtaaggcagaaagagcagaactgagtagaagcacaggaacagcacacagggcatggggcttgtttagcaaacagactggaagtgcgtgtctgaaaatcagaaaacagtgtttgttctaatatcagtaagatgttgatgttaagtaatatgtcagctgtgctttccctctcacagactgggtctccaggcaggatcaaaatatgaagccccgtagtgaatatgtgtccaggaggtgggggactagagggcagaggaggacagatcttaataggagaaaagaggggccccaaaagggagattaaagcactggaggtaatataaagttcctacttcatgatgttgctgcaggtgttttgtcttctctaagaagaaacaagcaaggattactaggtcactacattggcaggtgacaaagacttaggataaagggacatcttcagagacctattcagtttctatatccaaaccctaagtagaggtagaaaacatgcagaaacatgaaccccaaaatgaagtactgggtggtaaggaaagctgtgctcttcaaatgacaagttctttagggggcagcccctactctttttcttcatttcaactcaagaacgaatccctgtggtcactctttcttctttctagtctgcctcttggaactggggatgtttaatacagaaaccaatctcaagttgaatgacagtcaatccagcaagatttttttcttttttattttttaatcttttttaacaaggtaaatgctggttgtgtgagcagaggctggtgaatttcatcagctttttcagtgagtcattaagattcatcttcaagtagatagcatttcagaagacagaatcctatcaacttgaggtttttaagtcttagattttcctgcatagtttcaaattacagtccttgaaagaataagctcttcttgaaaagagtggaagtaggaagtaaaaagaaacatattttaaaaagtcaaggtgatgggtgctcacataagggtgactctccatcagtgttgtatgctacaattttctaaagttcctgacaatatactcagtgacaaagttctaacaccaagtgtctatttacatattacaatattgtatagtatatattacctattacaatacactttaaaaatgaaactcaccttagaaagaaactagtcaaatcttattatttagaggaccaaagggagtgttggtgacatgggaaaacacaacattcttacagaaatctagtagagaaatacatggtttttctctactagctagggcatctagtgaatatgttctttaaaccaatcttatatacctgtgtttgaaaaattattaaaattggcttaagtggtatggttttaacgttagtaactatgctgacactgctagattattgtcttttggtgacagatgaggattataatagatgtgaatttatctatcacaaaggtggtcctaaaaggagccattgaaaaaggtagagaaaaaagtcactggaggaagaaattctatttaataatttaattagcaattgaagataatttctatctatgaagcctttgctaatgcaacaattattttcatcaatatcaatgattaataggagaacattcattcattaaaaaaaatcaaacgtcttttatgtatatagcaaagtgcgaggcactggggctagaaccatgagatagacagacgtaatctctctccttaaggaacttattacctagctgggaagacagatgacagatgttcatttaaattactacccaaaatccataattatgtccatcacataaacagaaccaatgacaaaaaccacatgattatctcaatagacgcagaaaaggcatttgataaaattcaacatcgcttcatgttaaaaactctcaataaactagggattgatgggacatctcaaaataataagagctacttatggcaagccaatagccaatatcatactgaatgggcaaaagctggaagcattccctttgaaaactggcacaagacaaggatgccctctctcaccactgctgttcaacattgtattggaagttctggccagggcattcaggcaagagaaagaaaaaaagggtgttcaaacaggaaaagaggaagtcagattgtctctgtttgcagatgacataattctatatttagaaaaccccagtgtctcagcccaaaaactccttaagctgacaagcaacttcagcagtctcaggaaacaaaatggatgtgcaaatatcccaagcattcctatacaccaaaaatagaaaagcagaaagccaaatcatgaatgaatttccattcacaattgctataaaaagaataaaatatttgggaacatagcttacaagggacgtgagggacctcttcaaggagaactacaaaccactgctcaaggaaataagggaggacagaaatggaaaaacattccatgttcatggataggaacaatcaatattgtgaaagcaatttatagatacaatgctattcccatcaaactaccattgactttcttcatagaattagaaaaaaaaaaaaactactttaagtttcatatcgaacaaaaaaagagcctgtacagccaagacaatcctaagcaaaaagaacaaagctgggggcatcacactacctgacttcaaactatactactacaagactacagtaatcaaaacagtacggtacgggtaccaaaacagacattatagaccaatagaacagaacagagacctcataaataacactacacatctacaaccatctgatcttctacaaacctgacaaaaaccagcaatggggaaaggattccctacttaataaatggtgctgggaaagcaagctagccatatgcagaaaactgaaactggaccccttccctacaccttatacaaaaattaactcaagatggactgaagacttaaatgtaaaacttaaaaccataaaaaccctagaagaaaacctaggcaataccattcagggcatgggtatgggcaaagacttcatgactacatcaccaaaagcaattccaacaaaagccaaaattgacaaatgggatgtaattaaaccaaagagcttctgcatagcaaaagaaactagcatcgttttcttaatccagtctatcattgttggacatttgggttggttccaagtctttgctattgtgaatagtgccgcaatagtggtggggtggggggaggggggagggatagcattaggagatatacctaatgctaaatgacgagttaatgcgtgcagcacaccagcatggcacatgtatacatatgtaactaacctgcacattgtgcacatgtaccctaaaacttaaagtataataataataaaataaaattaaaaaaacaaacaaatgtataaatctttttactaaaagtgataattcaaaaaaaaaagaaaaaagaaaaagaaactagcatcagagtgaacaagcaacctacagaatgggagaaaaactttgcaatctacccaatctgacaaaggtctaatatctggaatctacaaggaacttaaatttacaaaaaaaaaaaaaaagaaaaaacatcaaaaagtggacaaaggatatgatatgaacagacgcttatcaaaagaagtcatttatgcagccaacaaacatatcaagaaaagctcatcatcactgatcattagagaaatgcaaatcaaaaccacaatgagataccatctcacaccagtcaaaatggcaattattaaaaagtcaggaaacaatagatgctggtgaggctgtggacaaacagaaatgcttttatactgttgatgggattataaattagttcaaccattggggaatacagtgtggcaattcctcaaggatccagaaccagaaataccatttgacctagcaatcccattactgagtaaatacccaaaggaacagaaatcattctactataaagacacatgtacacatacgtgtattgcagcaatatttacaatagcaaagacttggaaccaacccaaatgcccatcaacgagaggctggataaagaaaatttggtacatagacaccatggaatactatgcagccataacaaggagtgagatcatgtcctctgcagggacatggacgaagctggaagccatcatcctcagcaaactaacataggaacagaaaaccaaacaccacacgttctcactcataagtaggagttgaacaatgagaacacatggacacagggaggggaacaacacacactggggctttctgaggggttgggggcaaggggagggagaacattaggacaaatacctaacgcatgcagagcttaaaacctagatgacaggttgataggtgcagcataccaccatggcacatctatacctatgtaacaaacctgaacactctgcacatatatcccagaacttaaagtaaaaaaagaaatccataattattaactcgaataaatggctatggaagtaaaaatgtgactataaaactaagtaacagaggacttcacctaccagagtattagaaaaagttcagctgaaaaataacatctaagctgagatttaaaagacattctgcaggaaaccagccaaaaggttgttgaattgtaaggtcttaggtggacacttttgtaattacccttctctgtaacaggattattcacagacgtaccttcttagatatgctggggtatgagatcatgtttggaagggacaaaaagtagcttctataatttatacaagactttttctctctgaggtcagagccatgcaactgcatttaattgcattctaccacacttatagggtcaatgtggtagatggaaggttcactggtctagggactaaaagaaatgagtgctggtctcagctctactgaccagtcatatgtccttggagaagtcattttccctctcttagtatcatctgtaaaactgggaaattctgctaacaatctgcagctgtgatattcgaatcctacactttggcattcagtgccatctataatataacacctgtccatctgtgcaggtttactgttagtcaatatatcagctagtagtcagctgagctactaaatgaaaattacccaaatatgtaccacatcatcttttctaatgctttgatggttatcttccatgacccatctcaaatgtcaaatttcccttataaaactactttgattgctaggaaggcccttaaacgtcatctaggccaggtacagtagctcatgactataatcccagcactttgggaggctgaggaagaactgcttgagcccaggagttcaagaccagtctgggcaacatagcaagacccctgtctctacaaaaataaaattaaaaaattagccaggcacagtgacatatgtctgtggtcccagctactcaggaggctgagccaggaggattacttgggcctaggaggtagagacagcagtgagccatgatcatgccactgcaccccagcctgggtgacagagtgagaccctgtttaaagaaaagtaaaattaaaaagtcatctgtctccctagcccccacctttcccagtaagaaaacttggggcctgataactgaaagagacatttcaaacccaaatatctcagaagtgatggagctgggctctaaaacaaattctgtgaatttctaggccatttctcttcacactacaccaacaccaattgctaggattccccaagcccatcaatgtttcatttgcgtctctcataatctatactgtgtgtgtcaagagttggcaaactatggttaatgggacatagtcaacctcctacctgttctcgtaaggcgcacaaaattaaaatgtttcttaccttttaaaattactggaaaaaaaagaatattgcatgatgtgaaaattatgtgatattcaaatttcagtgtccacaagtaacattttatggaacacagccgtgcccattcatttatatatcatctatgattgctttcttgctataacaccagagttgataaattatgacagatcctatagttcacaaagccagaaatactgactatctgggcatttaaaaaatcagctctctgatcttcggtatatgccattttgcgtgtacttatcttcctttaccttcctgtggcaaccccttcaccacaccaatcagtgtattcacctgggggcacacaggcaggaacaaggctctctctcaccatttatatcttcagtaatgagctaacagttgctgagcacccatgtgtcagaaactgttccaaatattttactaatattaatttattactcctcacacaaaaccacaagcctttttaatatttttattcccatttaatagatgaagaaagtaaacacggaaaaggctaagtaattagcacaatgtcaaatatgccatcttttgaattcaaacgaatgttataactatcatgaatatgtctgctgacctcagagacctttagtctgaggaccctaggttggttcattttgttagtcagtattctcaaactagatgaaaagtcgtagttccctttccaccctgaagaatccttattagacattcaggaattcctgaggcccagaaaacacaggcaaatttctggaggctttctacacagggaaagaaaaagaaaaagaaaaagaggtaacttggatgaaatgatttcagagtcatagaactggattctactatctcctatttcagtcttataaaatcatttaattttacatggcctccatttgcttatttgtaaaatataaacacaaagcaaaactaggtgatatcagatgtctcttccagtgctagccatggtatgaagcaacagaaggactgataaagagaagctcttaaaaagaacttctgacagctagctgcatgtccaggggaagaaaggcagacagggaggagtcaggggaaaagaagcactgactgcccaacactgattcacaaatttcagctttgaagggtccatatcccccaacatttgaaagatcattttggaagagtgacttgaaacttctgagagacatttgatgggtacctctccaaactgtctgatgccacccacagttgggtctctaacacggcccccagaggaagttaaagcttggatgtagagtaagcagtctcattctctcaacctgctaccaggatgggatgctattcatggagcacagcagagaaccaaagggtggccctgggtcctgagctttaagggaaagctgaagaaatgggaagctagagaagttccagaagctcaactgtaaaagcaccagcataaccatttggtgctaaagagataaataaaaaccacctaccctagtagaggaaacagaatcatcacctttaataaaggaacaagttagcaagtggtctgtctcttgcctcacctctgactggtatagcctctctcctccaaggccatgctggaagttcatcctacattttggtttcaagtataaaatgcatttgtacaatggcttatgttgttatttgtttcagatcctgtttctgtggcatggtcctgactgggacacagaacggaatgaaagggtctagaaactgccctaacatttctccacggttaccttgtcgtaaataagctggggctctttgacatgtttcaaaagtggctagccttatttgctttcaaaatccttttcactctttctgaataaattaaaatgcttcctcctccgtgaaaccacgtccaatgttctcttcttcctttcaactccttcagcactttgctcagttgcagtggagtgatctttcttgctcagccttgtacttcagcataggtgttctagaccatgacatccctgggaacagagaacagtgtagagcatggcttttggagagccttccttattaaccattacttgttagcccttggcccaagttatttcactgaaccatagtcttcatccttaagtcagaaaaatgatgcttccttgtcctgcagaatactcataagcatccaatgagaaaacgtgtgtaaagcattcagactagtccctggcacataaaaagtgctcaacaaatgtcactaacttttcttcatcatctgcattctttgaaaagccaagcacagggccttgtatacactgaatgctccataaatatcataatttggttgaagtaaattgctgaatcactaccttgtttgacttgctctcacattggatccaaccaggaaattattaattgttctcacttaccatgcaatgatatcaacaaagtaattaatctgtctttttaaaaaaattaagatgatctttaatatttacatctagtttcctagatctattacatgtacaagaaaccatttgtctgaattggtatcacactagcattttctaggttacgggcattaatacatattgcagaatgatacagtcgaatctattcaagattttaaggatataatttcactctagggaaaatattttgcccactcctcagaggacttaaatggctaaatcttcaagaaagtatcaaatttgtattacccttgttgctctagaagccaaattttggagagtttatctttgcctttgtctggctactctctatccctccccatcaacagccccattcctgggcactcacatcgccccaaacttccccaccaaaatggccctgagtgcactaactgggcagcaacctagttttaaacctctttcacattctctgtattttcctgtgttccaggcccccaggactttgtctgccagttgacctgataaaccaatccaagttaaaaaaaaaaaaaaaaaaaagaaagaacatatgctaatgatttgtgagaattaatggtagctccttctcggataatatttcattttattagggtctattagatagaattcctttattcaaatgaatggttctaattgtgaaagtttcagatactattttgcccaagaaataaatgctttgaacctgggaatgctttgcccaccctcaaatcactgtatagactgctgcctgcaatgcacttgcccttgatcacaaaagcattttctttgcttcagctgccagagcttttcctcttccacatgttcccctccttctactgaaactcactaggaagtttcaggtaaggtggaaatgtgattcacttaaacttttgtcttgttactgtctacactcttggctgggcagatcaaaggacaatcacaaatgtaaatttaaaacacctactgttcaatatagtctctgcaaagagaacttacaaaaatcacttgaggcagcaaggactacgagcaactgtcttataagtcaatgcactggaaaatacatcagaaaatggactgtttgattaataagtactactgagaacctagtcattgattaggtcttcaaaatatatattgtgtaaaacgtattttgtaatgtatatgtgtgcatggaggactggggatggaaggtgacagagtggggaggccagggagagaaagagagaaaaagagattttggaagaggaagaaagaaaaccgaaagtaatcccgctgcacttaatgaggccccattggactagtcctgaatccaaatctgaatctcaaaggcagacgctgaaagctcacattctcagaatctagtccatcccaatgggtcagaaaacacctgatatttatttccactaaatctcagctatatctctagggaacagaaataccttcgtttaaaaagaaaagtggaaacagctagtacagaaatccactggttttgttagccacctttactaccaagaattagagccaaagtgatagacagctaagggaaccataagtgatgtcagataggattctggaacccagagaaagtcaggcagaacgtttgccacaagagggagcagtagaatttggtcagatgggagaccatttggtaggggttatgatgaggggtgtatgaggtatgggaggttatgatgaaggatttaactacaagtatgggtgatatttggataatattttagcaaaacacatttatccttgggggcaaaaacaaaaagataaagggaccaggaagagtagagagataatagcatgttgattcctaaattcttagcaaatataaagtgacaatttaatgtttacttgaaagcaacatactacgaaaatataaaacatgcaacatatgtgctctaacagcctcttctagaggctgcatttctttttccagatctaatttatatttcagtttgaattttgtttattgccatatttttagggcagtctccttcttatctatatactatcctccctgtacctaaaaggcatcacaaagaaagaacttgtctcactgaattgcaacattaaaaaaaaaaaacaaaaaacaaaaaacaacaacaaaaaaaaacacacagacattaatgtcccaaaatgcacttactttgagacaaccacatctatgagctaaatgaatgccttggctggctttttaaaggggaattgcaacttccttggatctgcacagcttttctcatcatttattttgtcaaagaaatagattgaatactaagaggaatcatgtgtttattttgcaagtaaataaaagtctatatttgcctggcaaaagcatgttaaacatagctttttaacagatgctgaagttctcttggaatatattttattttttcaaaacacagaaagcttaacagagcaattaacataattcctgcaaatagtcctatagatgttactgactatacctcactttccatttgtaattttattgggagtcaaagcactgttactcccatgctcttttcttcccctggtcaacaaaagggctatgtgcttaatctgaaacgttacagtaggaaccactatataataatattaaagtaaagacataggtagatagatacatagaaaataagccttcatattttagttcattactctcctccttcagccctgttaagctttcaagacagtaaagtctgattatcatgacactcttacatcctttgtagccctatacagctcaacaataaataatggtttatctctgttcagtcctttttgttgctgttgtttttctaggaattaatcatttttttaaaaaaagacaacaaccattttaaggggacaaaatcagggcttcttttatagcaggtgtgagaaatcttagctaaagagccgtgagatccaaatggaattcttcaagcaggcagaatttgtaaaacgaaaaccatttaagagcacacatcttgcctcttgatgaaataagttggtcctcccccaccttctcactcacaaggccccaaagatggagctagttttcccttccttcctcctgctttcacacccgcctaacctcccaattaagcaagtttagcaaacccagggagctcaatccaagtaacacaggatttgaaagaggaacctaaaaccaatcatccctcttccggctttgtcttcttatttgaaatgaatgaaacatctagattcattttcctttttttttctgactcgctgcaggagtagctttgagagagaaagagaaagcatgtgagtgtgtgtgtgtgtgtgtgcacgcgcgcgcgctggtgggggcatgggaaagagaggtatactttcagaattctctcctggtggctccctctttcccttgggaaatcttcgcacaagtctcagattgtgcatgttcaactgctcatatctggagatactccagcaatgcctttaaccagatctgatcagaaatctccacctactcagctagaggctcctccatgatcaggacgcttgtactgtcttcaccacatctgtcattttttaaaaagcttcttccactacacctcccactgatatcctttttttctctttttagtctttacacctccagcaggacaaagtttgtattgttatattcacaaccactagtagctgactagcaggagagagagagagcggcttcaggagagccaggttcgggggcttcaaaaggatacctagcgcaaagcatgactttccaatgactgcgtacaacatgcacattgctctcttctaaaaatgctttgttaaatttcatcacccctgttctcaactcaaccactaccactttggagagggaaatacaaattgccagcccaagccattcatcaaacagcaacagaatccacggggtggtgggggggatagagaagaggcgggggtgatgcagggggtggatttaaagaatcaaggatgcacacgtactgtattttcaagagcatcgcctgggcggatttggtttctttggccggctgtccagctataagaccgccctcttcttcattaaggaggagccaaaaaggatatcttcacatctcagaacacagaccatttcccccaagagccagcaaagctccagaggcagagaatgcagctgcaaagttcccttccaatctcttggggaaagatgcctgtgtgtgcagaatccccaaagcacaccacggcacagtgcccagagacgtggaccccgcagcccactccctgctaccccctacatttcttcctcgtctgtctctgccccgccacacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcggacacccagaaaaatgtgcaggcgcgcacacaccacatcacacacacacacacacacacacacacacacacacacacacacacacaaatttagaagccgctcgtttgccaaagcagagggaagtgtagccttatgagcagcaaatggaaaatagttcttggtctctgactaaatgccttctgcctgtccatcataagatcctacctggtttggggagtgtgaatggattcttcctccgttcctccacgctagtagaaaatacggcgcactccctccttttaaacagctcccgatcaggaagaggtcgctcccatcttctgtgggaagcacaaagcaggcggcggcggcgggctgactaccgtgcagcgccggcgcgagcgggagccgcggcagcgggcagcggtgcgcgcgggcgggaggcaggcgcggaggccgggaggctgggagggccggggcccgggcgcgcgcgcgctccccctccctcccgcgcacactcgcccgcccgccgcccgcagcctcgcactcgctcacacgcgcgctcggccccgcggctgccgggcgccccggggccccctgcgcgccccttgggctccccaggcgatcgcgtcggggcaaagccggcgcgtttctggagcaccgagcgggtggggagcccttccagcctcccagcctctgccggcgagcagctttttcgatttcctgccggctctcggccccgcagtgcgttgtggccgcgcgctagcgctgtctctcgcacccagcccatcgatgacacgcgcacacaggcgctgcaacttttcttttgaaccctcttcttctcttccgcagacagaaccctgacccccaattcgcctacccgtttctcacctctgactttgttaatccaactatctttcttccctcacttcctgcccttctgctaaaggaagctttcttttagcaaaaggatctgggcatatatcaatgattttttttttaatcctcaccctgtgtttttctacgtatcagatatgcacaactatacgttggctactagatgctgacacaagcaaacagagatattcgggggagggtgtcccccggccaagaactgggacagagtctctgtgttggtatttccctcaaagatgcgtttcacctgggaataaagacccagagtctgtttcgtgtgaaaggcgtgctggttttaaactacagtgaggagtaaaagccgagcattaaggttgagtgggaaaaaacctaatgcagcaatcgacgaaccattctttgccctttccaagagaagcattatcattgccaataaatcactttcctcataattaataaaggaacactgcaccaggcctttcctctcttgacagctcattcattcttacaaacccttaatgacttcacgtggtgaaaggctagacctactgtggagttcactagcttccaaacctggctgcgcatcacacacacctgggaatgtagtcagatgctgtagaatctgaggccgaatctgatgcagactctcccgttgtaggtctcaaatggggctccaaattagtatttttaaaacaccagttgctatcggccactggtgtcgtttgccaaggtgtgtgggggggtcaggagcagctacttggggaaggtgggagaaggagggacctgcagagcacaaggcagaaagttagttttttttcgtggagacgtccccccatacttacagtgcaaccagggcagtcaccacgactgatagattctgactccaggaacctcagtttgcctccgcaacaaagagggggcggaatggaagaaatagcctcttctgcccctgtgccagtggctctcaaccctccttgcacctcagaatctcctgggccgtttttaaaaatcccagtgcttaggccacacccccaaactgattaactttgactctctgcaggtgggccccagacagccttaatttgtttttaagatgcctggttgattcctatgtgcaatgaaggttgagaaccactgctctaggccaatactcctcaaacatgaatgtgagtatgaatcacatggggattgcagattctttttcaatagacctggagcaggcctggggtaggcaagtgttgaagtgatgctgaggccgtctgaatgaggacctcactttaattagtcgggtctgttgccagcagtcttggatactggctttgtagaggacactctaagctgcttcacgtcttataaaatttgcaggaatcgttcttgcctaagaacatttttctttccttgctataagttaaattttcttggaagctactttccacaccaacttggttagactacacttactagtggatataaacagaatgacctgtggggagagacagaaggtcactgtctcttttagaatatgtcctctaccaaaaattacttagagtccctgaatttaaggcagtgtgagtagcagatatttggctcacactcaatgaaaggggcttggagagaaaagtggctgccttctaaataacactaaggaaagcttataactaaagactccactcaataggaaatagaacacagccaaatgaaggaaccaagagaaagctaaatgaaaatgtgagtgggccatatttcactggaatagattttgtggaaagagtgtagcctcttattgctatgacgggccgcttagtgaaagctgagattttcttgaaattttaggcatgtttgtgacatggagtgacaagaaccctgttctttaaatgtttatactccagtgatgcccaaagtctgtcttaagactttttttttttttttttttgctttgaccattgaaactgaaaggctacatcttggccacttgattcttcctcttttccaatcgaaactgcttttagactgatttggattcttgggaaaaaaacaatattaaatggtcttctgtttatctagaactattggagaggcagcctagtgcctagtgatttggcatcctttttggttcagtcagtttctgagcccctaattttctttgcctttcatttctctttaaaggcatttttataatggttccagggccccaaggcaaatcaaaccttttgctccctcctaaatgtcatacatgagtgagtttttattgcgagaattatcaaaggctgcatcacaggcacaaggctgaggaagactatggctctaagaaaggaaaaagtgaggctgctgcagtctgtggctttggaaagaagacatgttgaatggaggaaggtggtaatttacattctaatagcagtaatgtttcttaattgcagtcttccatattgattgccattctttcctctggacttggaattaagagtcaccgggtctccactgttatctaaccaaagcaatacgacacaaccattcaggggactccacagggatatcactaagatttgatatattcgaaagatgttctgatgttcacaaactatttcctaggaaaccttcaggggatctgttagcaaactcattttcagaccaagtgtaaatattgtgaattaggccctactttttatctagtctatagaaaatttagacatgtgatcaggttaccaagatttttaaaaatatttaatactttactaaagcactcaatatgttttcatcatagggaaaacaagcacaatactctgtttaaattcctttcatttttactttgaattacataaatcagaggtacctctattgtctcttccattgcttcgggcttctgaaatatgttaatacagtcttagtcgtccctcacctcatttcttactctgccagccttcactaatcacctatctgttcagtcacaggctcagtttcatagtgatttctacataagaaaatgttattacataatagcccctagcctggccagtgagtggagcttagaattagccatttttccatacctaagaatctcaggtgaaccattgggttcccagttttgttctttaggttttctttgctgatgagtagatccagggttctttgctttggggatgactttgagaattctttgttgacttctaagtgctgttgttcctcttccctggagacttgttcctgcagttaaacttttacttctctgttttgttttgaccaactgaacaccactcttgtacctcacccagttgtaaaccctgctactgcacaacagtccacagactggggcagccttcctggcagactcacagtcacaactctcctcctctctgcattaccgtggggtcaaccacttcctctgagtcgccaatgaatttgtcacagtctttggacatcagggacctgcaattctacatttgagcaactgatattaaagaattgggtttgggctgggcgcggtggctcacgcctgtaatcccagcactttgggaggttgaggcgggtggatcacgaggtcaggagatcgagaccatcctggctaacatggtgaaatcccgtctctactaaaaatacaaaaaattagccgggcgtggtggcgggcacctgtagtcccagctacttgggaggctgaggcaggagaatggcgtgaacccaggaggcggagcttgcagtgagcagagatcacaccactgcactccagcctgggtggacagagcgagactccgtctcaaaaaaaaaaaaaaaaaaaaaaaagaattgggtttgtacaaaattctgagacttctgtttttcatttctgccccttattaaattaaggaaatatctagtctctgtcctgcaactttatcaatggtaactcaatggcagaatcattatctagagctattaatttagaggtcagaaaataatagcagattggttaagagccaaggctttagagtcagaatatctgtgttagatttttcagatccagctgtgtgaccttggggaagctttttaacctcttaaatctcaatatctttgtttggaaaacatggatcataaactctccctcaaggtgctgtgggaaggataaaatgtatataggatgcttggcatagttcctgatcatagtaattgctcagcaaacgatattgctgttattattactggtaaagtttcataaacatgatgtcaatgtaaattttaaaatttctatataattagattctacataatcaggtcatccaattattgatattgattatgctgttgtttttgttatacagagttctatgcaatgaataatccagaaaaatatacatttctacatcaagagagtacttttcctctctgtaatgaaaaaagctgcttgtgaactttctgattttgtaagtacatagtgtggttagtgattgattaaaaggggcaatgaattcttctctccttcacaataattctgttcccttatgtctgggtatcaatttgatcttatctctattataaactgagggtagaatttcaaagacagtcattttacgcaaatcctgctacaactaaaattttgattgtcacattacattaattttattaactgggaactttttctgtagggcgtaaacttcttcactaagtttacacaacacactttcctcaacattgattcaaggactcttcatcaaataggggctcaagataagctccctggggtgctttgtaccaggcagttgttccctacaatccagttcagaagcaatgtccctgcgagattacacttcagcctttttcataaatctcttttccaaggcaccgtttatgatatatatctccctcgctgtatcttcaattgctggtcactgattagactcttctgagagctgccactgttttagtgcttaccacaatgcccagacagtagcccttgaagatgaaacctaaggggaaaattgactaaacttatgggtgttgtaatccatgattttaatgatgctgattctgctactactggaagtgtctggaaataatgaaactgtatgctctcgtctctttaaaaatgtagactcatacagtgtgacctaaagaatccttagtaatcacaaacaagtaatacttagaaactgcattctattttcccattcttttaaaagtattatccagtcacacaaaagtcacctttgggtttgtttcagcattcctaagaatgtctttatcaaaacaaaggataaattgtttgtatagacattaacattttttgccacctccaatttaatttttatgtaagaaatccttgtgaactagttggggctgctatggttactctcattttacagactgagaaagaaagtacaaagggatttgccgaatcctggctgtacgcatgtatcagctgggttatttaaaaaaatactgaaagctgggtcctacccttagacattctgcctctattggtcagaagtcgagtctgggcactgttttgttttgttttcaagttttttgggatggttctatgattcagccagggctgaaaaccactgacctaaggtcaaatagctaatttgtggcaaagacgagtgataaagctcttttacgtctggcacaactcagtttcttttctgctgctctatcaaatttcactattaatagaatataaaaatgaggacttttctgggaaatttaagaggacttacaaacgtttaagtgcctttttgagtccctaaggggcaggtaatgtaattcacctgacataagcagattggaggatatgatctagaaagtccagtccattactatggggcccccttctacttgaacatttattcctcagcatctagagcagtttttggtgcatgggacatgaattagtagaacatgtatcgtcccctgtaaggggactggtgtagatggaaagaaggattccggtgatagggtaaactctttggcctctctccagtgcaaattgcaacttaatagcaatcatctctttgtggctgcagttcaggctctggttagctgacacagtcaccatatctacaccggtgttctgcctggccacctgctctgcgatgacagacagattgtctgtgacactgcaggacgaggaaccacacagagacagcaatctgaccgagcctcaggcttgagtttgtaaactaaccctttgtcagttatctcaggaattacttctaagctcttatttggaccaatttgtgactaagtcagagaatctcttatctcctctattaagaagggttcactaggcatggggtttataagcattattcttgtattcttatttattatttttcaagattcaaggaatatgtaagtttcctgattatgtcaatcgttggtcatcaagcaactcttattaaaggaaaaaaagctgggtagaacagagaaaaataaaacacagctgagagtagccatgaattcatttgttcactcatttctttatggattttttcaacaaatatttataaggatggactccggaccaggcactgtctcagacactggagagacagcagtgaaaacatcagtagaagtttctactctcctgggactcacattctagtgaaaaaatgacaggcaacaagcaaaataaacaaattaacacattgtagggtgtcatatggagaaactgctatgaagctcataaagcaggaaaaatggaatagaaaggtttagggaaagtactagtttaggtggtcagttctgcagagacttgaattaagatttcctgttgacaccaccaaaccttttttgagagtcccaaacagataaaatgatataggacagtatatttttttttgttttgaaaatttgtttctgccctgtactgagttttattttgtttttaggaattcctgcctcaaagccatcggactttatcagggtcagcagcagaggcatggccatatgacttgtaccactgcgttttggagcatattcatattaaatacatccaagagttgtttcaaaaagacagactgccaccaggggttgcacataaaaataaccattccttctaaggcacagttgacacaagaattctgagtgcctctttggtttatattatagcatcttattagtgcacctggatgaccaactttataagtaagctctggtgggtgaacctcttgccacaaagtcaacagcattggtgggcagtgttgggggaggccatgggaatcatgcatgtgtaacttaatggtggtcccagtgctgctttctatgggtccatcatacctccttttcctttttcctgaattgttacctgaaattatactatacacaacacacacacactcttccacaaactcacatactcattcgcatacatggcttgtaaatatggccaaatatttaattattgaaaaatcaccaattgcaaatttgcaaatacccatgaaaatcatagctgacctcttgtttttgtaaatgttatttaacgtcaatggtgtcaatggtgttttatttgcagagtcttgtatacttcttttcacgtctacttggagactcagggcctaaagcagattacaactcatatactgtgcttttttgaaatgaatgatatcagatttgaagcctaaaatagatatatgaattatgtatctcatggatcttaagaaaggatttaatttttctcttattgtttcttttgtaaaaagaaaaataaaaatctctgaatgttgctcaaggaaaagcagagcttggatagaaaattattccacacagcaaagtgcatacttcacttgtaacagatagatcaataaatatctgttgaataaatgatgcaatttaatggaacatgctactttatagggtaatcatttatattttgtagcagattactggtttaatttttaagtcattccagctgcaaatagggagtgactactccattcagagccatgaactaagttctgtggtgattaaaaaaatgaattagacactctccatggcctctaggaatttagacttataggtaaaatcagactgtaagtattttttaattttttttttttttttgagacagagtctcgccctgttgcccaggctggaatgcagtggcatgatctgcaacctccgcctcctgggttcaagtgattctcctgccccagcctccccgagtagctgggattacaggcaggcaccgccatgcccagctgattttttatatcttttgtagagatggggttttaccatgttggccagactggtcttgaactcctgacctcaggtgatctgcccacctcagcctccctaagtgctgggattacaggcgtgagccaccgcacctgactataaggatttttcaagaagtaagtgctatggccggatatgtactttatgaaggtaaatcttgacagtgtgtctgagatgtgtttaagtgggcatgaccaaggataaagagaccagagactcacataaaaggactctaaacaactactgagggcgaaaaggaagaatatagccatttttttctttggcccaattcttagcagaatcctattaccgctcagcttaatcttttaaaaaagtactgagttttcattttgagaggaatcactctggatggtttcaagtgcaacacatataatttctataaagtcgatactattataggaaaaaaatcatttttaagactggcatatcaaggtgcggatggagggtgctagtctgctgtaccaggcagagaggatatttcaccactgagatgatgaatggtagcaataaaaagcagacagacccttcgttggttttattattgtgcctaacttctctacagacaatgcaccccctgatcctttgcaacgtggatttactgctcccactgcctgtcccccttggtgtgctggtgtttctaaaacagattatagtaatctgagaatatccggtcttctttctatgacatagaactgacttgcaagtaaggaggaggtgaaaaaacccttgcccactccgcgcccctgcacaaccaccagacatttaaatttactgtgagtgaaagctaagtctgacaaaggatggattttataaagagcctcttacttcccttaactaccactgattttactattatttcagaaatatacaagaccagtgaaggaaatctaatatatttgtaacatttaatcaagtctttttgtcttttgatcatatatattcagaagaacattgttttgttaaaggcagtcttatttgttagataacaagtccaaagataaaataaattgtttgatttttcatgtgtatttttgacatctttctgacactgttaatctgacacaaactaaaacactatacattcatcgttataagaaatctagtgttgatttaacagtacttgacattataagatatatttataaaatggaaagaatatgctagatttttcgatgtttatcctctcattttaaagtaaaatcctcctttttttttttttttttttttttgaggtggagtctcactctgtcgcccaggctggagtgcagtggcacaatcttggctcactgcaagctccagctcctgggttcgagcaattctcctgcctgagcctcccaaaaagctgggattacaggcatgcaccaccacacctggctaatttttgtatttttagtagagatggggtttcaccatgtttgccaggctggtctcaaactcctaacctcaggtgattcacccacctcggcctcccaaaatgctagtattacaggcgtgagtcattgtgcccagccataaaatcctacatttaattaaataaatctaatactttttaattcttaatcaactataactaaataaatttaagtaaacttatttaaataaataacattctatttatatatgaatcctagtgttagaaaaatacctaatgaatttcctgacaagttgggaatcttttcttttttttttttctttgagaggcagtatctcatattagagaagatcagagcaggcggggcatggtggttcatgcctgtaatcccagcaccttgggaagcctgggtgggaggatcgcttagcccaggagttcgagaccagcctgagcaacctagtgagaactcatctcaataaaaaagtcaaaaattagtcagatgtggtggtgcatgcctgtatttctagctacttgagaggctgaggtgggaggattgctttagcccaggagtttgaagctgcagtgagcccagattacgccactgcccttagcctgggtgatagagtgagactcagtctaaaataaaatataaaataaaataaaataaaataaaacagcaggaatgagcttgagttttgtgggaataaacttgaattttggtagttgcctgctagctgtgttatgatagataaaaattattcgttcattcactcatttgtttattgagtagtttttgagtgaccactaagcaaggtcctgtgttagacacaatggaattatcagtgaaaaaaaaaatggggctttcatcgtggggaagaaaactaaccaaattacacaatttagtttttaattaacattgtggtaagtggcagcaagaagacacagagagtgggcttagacgttttctaagagagagagctaaccttttttagtagactctgtaaagctccaaaaggtaaataagcattggctaggaaaggagggagtgaagtgagttcagtagagccctggacaaaagcagcttcggacacaaaggccctgagatgagatgcagttgaggaactgaaaggtcagaggttctaatgcacgcagccagtgagggagaaaggggtgtcagcggcggctgcaagataagcatagtacgtgttgaacttgtcggaattaattttttgcttttgtttttcctaagatcaaggtgatatctgcttcattctaaagaatcgccttagttccactatagaacaattagccttacagttactaaattttctgccctttttcacttctctctctcatacaaaatttagcagaattccttctaacttaattattaaggggagaattgacaactggaagattaaaaacaaattaactcatattttctatgcatggttttactttcattgctatcccttgtctggggtctcctgtgtgattattagtaattgccacaatgaccagaattatccaccagattgcttttcagattgcttggtggaatcttgttctttttttgcccatatcccttcttgatatgctattctaaattactctcagacttacagacaagggaggaggattaaagaggatatatacatacacacacacacatacacacacacacacacacacacacacacacacacacacacacacacacatatatatatagagagagagacagattgatggtgtctcgctctgtttcccaggctagaatgaagtgacgtgatattggctcactgcaacctccacctcccaggttctagcaattctcctgtctcagcctcctgagtagctgggattacaggtgcatgccaccacgccaggctagttattgtatttttagtagagacggggtttcaccatattgactaggctggtcttgaactcctgacttcaggtgatccattcacctcggccccccaaagtgctgggattacaggcttaagccaccacacctggccaaaagaggatacatacaaatatatttcgggcagttccctgaaccagataggttcagagagattccctaaagaagaaatattggtagccaatgtaaacaaaaacagcactggctgaattctagcatagagacaacgcatttcataactttaaaagattccttcatttctacctctttgtttgcagttaagttttctccattgtggcatatgagcaaaacaacaattagacccagtctactgtgcactctattaggagttgtgaaggagaggacccatttgtttctcctctttgaggtaaagggaagaggttccaaaagaattgctttaaagattgtaagaaggggagactggcatctgtttcccaatcttagcttccagctttcttctgtatcatatacccctagagttggtgaaagactacagaggaggaatggagtggtgtggggtttgtcactggagaggtatttaaaacagtctgagaagtggggatgtggtgggggcatgacattggaactgcagacctgccaaggactctaccataggacacaggatgtattttgagtgaggccaccagttggtgggagtcaacctataagaataatctggtcacatgtaagttcccccagtgcctggaggagatgctgagtaaagagtccatctcagtggggacagttgagtatttgatccaaccacactgattagataataaatgagattgatcagaagcaggtgccaatatgaaggagctgcaaccttgccacaagaggtgttctctccttactcctctcccacccccagctgtgccagaacactatagaagcacagaggaaaaagggcgggtgagagggtagataatatctctcttctttgcaaatctctagagaagaagttgtcaactagggttgtaccactccctcgggggcaattttaaaattcatggggtattttatggttgtcatgataatacgaaagttgttatggatatttatttgactagagccagggatacaacacatcttgcaatgtatgggacagtctcctaccatagacaattgtccttcatgccttatagctttcaagtgttttacagggcattcatgtaggtgaggaacctattacatatatatatagtatttttggcatgcttacatttacactgatttttccaggaatataactactgtgtatattgaagaaaaagtgtactgttttacttggaatttaacaaaagtttttcaccattttgataaaaatcacttcactgatggcaatgttgcctgttagcaagcatttatagctgttgcctttggggtagttctacataatggaacaagcatctgattactacatcatctcttttaatgtggttctatctgagtgtttatacattaagtaacgtattaatttattataaaatgttaccatttatttcccttgtatattatagttaggtcattataaagaattttaatatatatacatggaatatgttatattcgtaattttatttcagaataaggtgcgatagcgtatttttttatacaaggagtactatggtctgaatgtgtcccctaaaatttatttttaaaataaaatgtgttggaaaacttatcttcaatgcaacagcattgggaggtggggctgcattggaagtgtttaggtcatgagaaccctgccctcatgaatggattaacaccaatatagaacggtcttttggggagtggattttctctcttctgcccttctgccatgtgaggacacagtatttgtcttctcttgccctcctggcttctgctatgtgaggacacagcaagaaggccctgacaagatgccagcaccttgattgtggactttccatcctccataactatcagaaaataaatgtctgttctctataagttacccagtatcaggtattttttcataacagcacaaaatggactaaaacaagggggaaattgagtccgaaggaattgataccctcacatttataactctctagagttaaagaaatatagtccactgtggcaagggcaggggttgggaaagaaatttgaattgattatgacattgacatttaacaataaataggactaagtcaatttcaaaaatgaggctctttcaatcaaaagcgatggaaaattttgtggaacgatatacccgtcaggaagctggggcagcaaagaagcttcacaggggctacactcaagcatattattaaaacatgtcttaaaggtcctctacagcttttacatccaataagatggtcagctgcctgccataagtctgaggtgtatgaaaagaaaatatgtagtttcagttctgctactaattaggtgctggtaaatccacaactgctctgagccttgcttcccttgcaaactgagggtgctaatctgcttctttctatattacgaggatcttgtagtgcaataaggataaagtgctctgtaatgacaggaaatatgattctttaccctcttgcattacacagtacccaggcccatgctgtgcatattataatacctaataattcatgttggtttgttgaatgtgtcttttttctccctaaggagcatagaggctgaaaattgcaacttggactctgtatttccaatacatgctgcttaattttttcattcacatatttatgcacctgaaaaactatatatgattacttgacatcaactcattagaaatagccaagagagcattaaatataaaagtgcccagatattgagattagtaaattaaataccttacaggaatgagttatctaaaaaaaaaaaaaaatgtgcagagaacggaagagaagtgacatagagctttaaaagatggattaatttgagagtgaaatcccacctggtgcacaccagggggacagttaattaaagcctctgtagaaaggaccagagaggatccccaaggctggctggaggctaagctggttagagcacagtgcttatgatgccacttagcatatggatctgactcccagaagggttgctcagcttcaatttttacgtgtccaaagactccactattaaccccaagctgcctatctgaaaatgctgtccttttgcatacagctgagagtgtgttggagcactgatgtatatgaactcaattttgttactaaaggagcatctcacagggaaatgatttgccccataaagcactaccctatagagctacttctgatgggggtgggggtgaaagtgctattaactgctattcagtacagatggagagaggacaaaagtcaaaacaattttattcactcctctaaattatctttctctcaattaaaaacattggcagctgctattgttgtctccttttatgttccttctacagaataatgatttgctgcctttttgttccttttagagacaatttctttcttaattaaaggtcatatagtatgtctttctatttgacattcgcataaataactgcatagtgtcggtcttgttattcctgtcagaacgctgtccactttaattaaatcccaattaatttcctcttttcccaaagaaaacaatggtggttttctgtaacacttttgcattcactagtatgttcaccatccttatctattacattaatgatattaaattttatggttaccacctttgcaatcttcacaaagtgatttttgacaacaaagttggagtaaagaattgtatcatgcatgatcataagactgcatataaataagccaaatgtattcactattaaatatgggtataactttaagcaaatcacttcagcttcctagatctcagtttggttgtctataacatgagaatgttgaactgatttcagtctcttttacccatttaaacattgagatattatgatataaaatctgtgtttaatcttttggtttcaatgcttcctacacataatatacccatttattttaatttgatctacattataccttacacacaagatgacatggaaatgttattatttccctccactactgacaattattttatcatgtacaaagtatactcattcatttttctctggaaaaataattttgagatattactaactttagtaagcatttacgtatttaaaaataagtggcgtttagtggtgtttatgtatattctacatattactattattggccttgacagaaatacagactttgtccatttaaacagtttcttctaattgacaattacttagtttattttaattatgaagactttttatgtctttctacataattcttagcacggctcattaagtttaaataagcgccttctgaaacacgaataatttttagattattacaattctctatttttaatttctgcttaattaaaagttacttttcttttctgtattttgtgtattcccagtgtgcataaatcttaattatatagtaatctatgtttaaatacttttttcctccttttttatcatagtaaatttcaaacatatgcaaagcagaaggaatagtggaacaaaccccatatacccatctttagcttcaccagttgtcaactggtgctcacttttgttgcatctaggtctcttcttcacccttcaccttcgatgactttaaagcctttcctgggctgggtgtggtggctcacgactataatcccagctattagggaggctgaggtgggagggttgtttaatcataggagttttataccagcctgggcaatatagcaagatcccatctctatatttaaaataaataaagaaaatcaaaaatcaaagtaaagccaatcctggatataatattatttcatcagtaaatatttcaatatatgcttctaaaagaagtctgtatttcataagtgcaaaaatattaccacacttgaaaagttaataataattccataatctcatcaaagatccctgatggtctcattaacagtgtgtgtgcagttggtttgaaagaataatgattcaagtagcattaaagcattaactatgtttgcaatgctttttaaacatacatgatgatatggtttgactctgtgtccctagccgaatttcatatggaattgtaatacctacatgttggaggagaggcctggtgggaggtgattggattatggggtgaatttccccatactgctgtcatgatagtgagttctgatggttaaaaagtgtgtggcacttccctcctcactttctctcccatgccaccatgtgaagaaggtccttgctttgccttccatcatgactgtatgtttcctgaggcctcccagtcatgctttctgttaagtctgaagaactgcaagtcaattaaacctgttttcttcataaattactcagttttaggtagttcctaatagcaatgtgaaaacagaataatacacaaaacaatgtttataaataccactccctcatcctttttatttttattttttttgcaatttaatgtttgaggaaatcaagtttttgttccatcaagtttcacacattctggaatttgctgattgcatttctgtgttttcttttcatggatttctctgtcccctgtctttcctatatatgtttataagctattgaatgtattatggattttgttgtgtatatatcttttattttgtcatatcaaaaggaaaataatgtctgcttacactcagtgttgctaaaattgtcaatgtgttcaggtatcgtcaacttgattcgtttattataaaccttcccattgaatgttttcagcaaccattgctaattattgcctaatcctttatttccttggtgatttcaaaacgtttgtatcctaaaactataattactttatcattattaactgggatttttaaaataactttctctcatcgactatttggtttccctaaagttcagtttcaacattgttttagtactttcactgaattctacttacgcacactctttccctatttttctgcatactcttcttattttctctggaactaatccacattttaatgtatctttttccctttggataacagcattaaaactcagtttctttcaattaaagctctacactttgggaaaacttaaaaatttcccattgtgtttaaatcaaaatagtttttctgtagggcaatctagcaaactttataaaatttttaataagcatagccttagaataattatactagaagtaaattatcctaagaaaataattgaaaagtatgcacaaatataaaggcaaagaagttcaaaatggcattatttattatagcaaaaattactgaaaacaatataaatgtccaacactaggctaagacattattataaccatggaaacccattaaaaatgggattgtaaatgtatattgacatgaacagaatgaagtattgattaatatagacctatattaacataaacacatattgtgttaagagcaagttataaaacattacatataataagatcctatatttataaaaagaataattttatatgtatagctatagatatatgtatagaaaaaaataaaagactatccctcaactgatatgtgtgtttgtcaacttctggatggtggcttttgaataatcttttctttctactttatttactttcattaagacttaattttttcacaattaacaataaaaataaaattaaaattttatcttttataattagggaagtgttttcaatcaacaattgtttaattgccaaattaaactatcaattttcaatgtggaaataaaaaaagatccttgtcacttaaatgtaacacataccactgtatcttcttctcttaaatctcatggtacagattacaaacacataagtggttttgctattactatgagctctacaacccagcttttaaaatgggaagacttgctgctttttatcatctgtgaaattgctgattttacactgaagtggctgctggaagcttttcactgaaggcttggtttctgaaacagcaaacctctgccactgctaatggagactacatatgaagcaatttaatctttagaaccaccctctgacataagtattgataactttattttatagggaagaaaaaacttcatgtcattcagctcctaagcagggccgtggacccagggtttttttactgcagtgtccgttctttacctgcttgaccactgcttttccacctcagctgcatttccttcttttctaccttgaaagtcctacctgacaagcctgtgtgacaatcacacagaaaacatcttacttaattctctatcaccatatgaggctggaatagatgacctcatccatcaatgtctaaactctcatggcattagcacactttcagtccctgtgaaataggggcgtactacctcccacccctgatcctatggagtgagacagtaataaaccgtaagctaagcacactgacttgcttttgctgcctaaaaataatgtttctccatcagtcatatagaggaagcacacccctcattaaaataagaagttactgacctcaggcatctgtctggaaataccctattcatgtaacccaaggaaataaagttgacaggaaatctgaaatgattaatgcaattgcaataaatggaaacaaattttttgaaattacaaatagtaaaaacgtcagctacctttggcaagataggacaaggtccattttttaataaaaactttctaagacaaaacttcaaaacatatatttctatatcatgctggcaaatcttaaagaagtaagaaatttaaaatatgttcatccagctacaatgcatcatctaatagatgtaaaaggcagggcatcaatcacattaggatagagaactcttcctgcttgtgaaaggaggagaggaggagactgcggttgactatgaacaaacatgacctatgtctgaaccgggggaattgtaaacatggggcatggaagtggaggaatcaaagtggtatggaaggccaagtgctgccaaaggtgaccttctgactttcatataagaaaatgtccactttatatgacaaccttgcagtaaacttacacacgcatattgtggagtaaagaaaaaaacttgaattggaagatgtggatttaagcctaacaacttctatgtctcaaattattcctttaatctctgtgagcttcgtaaaattgccccttttataagatggaaatgaaacattccatcttccttactccagggagttggagatgacatgagaacacacatgacaaacacttgatcaaatataaaagcactatattaacatgtctgaatttttagaattgtttgccaattatcacaaccctatctgttgtcactgcacactcatctagctgtttcatagatgaaacaaagatgtttcaaccaatgtaagatctttggttaaaaaatatttttttttagagacaagggcttactatgtgcccaggctggtctcaaactcactccttgcttgaagtagtccttttgctttggcttcccaaagtattgggattattggtgggaactaccatgcccagcccaaatgtgttttcaacacctaccatggcccatacccattctaggtgctgccaatatattaataaacataataaaactttctgtcctcatggagttaacataaccaatcagtggaatctaaacttacggattactagatttgtgagagataattcatgcaactaagtctactagaagcacactatgtgtcaagaacaatgatgaagtagaatatactgactgttattgtggagctcatggcttagaatgctctctagagactgtcaagtttaaggtgagttacaatacagcataatacagcacagataatacatacaggaggcagataactcagatttggaagtcaggagggtaacctgagagcagcgctgctcacgttagaagtcagaatggcgggagggggcgggagggttgcaattttcacattctactctgtttcccgagtatagtgttccctggctggggtatgtccaggggaaaaagacctgagatacagaggacctaagaatcacagcacatggaaaatgaagaaagaactgaagatattccacctggaaaatgaaagacatagaaaaatacctaattataaataaattaaacttatttggtatgattccagaaagcaaatttcaatctatggccaagtaaaattttcctaaaatccccactcctgcctcttcaattgcttctgggaatatccatccctcactatttaaccagctaacatctcctcctctccatctcaacattccttttccctctcccctacttgatttttctccatagcacataacagtttctgacatacataatgttaacttatttattattaatctgctttttccccaaataatatgtcttgtaaagacaaacattttacatgttttgttgattgctatatttcaacttcctagaagtgtgtctggcccataaatatttgttgaacaaatgagtgaaagttgttcagaatatgaaatgggttgccacacagagcagtcttgctgtcgaagacaaaggatagtgggcttgtttattacagtattaatgagatgggtaagaaacagaattaaatggacttatatttttttctgatagaaatatatagacttttccttttacacacccagtggtggggaactcatttcctcaagcaacttgggtagataactctattttgaagtttattgttaggttgaaccaaattcttccactttgaaaaatagatttagtgatcctaattttaatatgatttgatattcaatataaatataggcataatctcatttagtatcgaaaacttgccaaaaatgtaacttccacaaatcgtagtcatagtgcaaatagaaaaataagttacatgatctagaacattccagctaagattattccttctgctgtcctttctgtagtgcaaatgttgagaactgcctctctcaatagactatctccttacaagactggctttcattgactctcatgacactgtgtcagaacaattgttctctaggaatatgattttaaatatatggcatcctggcttgggaaacatcaggagattatatacttaggaattaacagattgtcttccctgtgaatactaattttcataagttcagtctttgttgtattctttgggacatgtatttaatctgcataatgtagccttatcacatgattactggttaaagtaccagaaaaagaagtttactcttggacaaaaacataaatggtttctcagaaaagaaaccttaaatggccagattaactttaccattcaatttctaatttttttgacacctcactacttcctaaggttttaatgtcagcttccccttttaatgtcagcttccccgttttcttccagagttcctgctagtattttggtactattctcagaaatggtggtaacagtagctaacaatactaaattggctatgacagttactaacaaatattaatgttcctagtactgttctgaatacttcttaagtatgaagttacttaatcttacaagccctttgatttaggttctaatattattcatattttatacttaaagaaactgaagtacagaaatattgagtaaatccaggcagtttggtttgggagcttgtgctcatggctataatgttagatcatgaaacttttcattggtttccataaattcatgtttgtaaggctttatttaactgtatatgcaaatagtttggagtaatcatctaagtctacattaaaaacttttgctgaaagaataagacataacaaatgtaaaaataaatcattatttgtttggagtcctggtaaagatatataactaaagtgatcgaggttactaatatgtcttcattgttttaagtttaacttataaaaaaattatttaggaatcgatttgttgtaatctcaatgtcttggagcagcagttctcaaaacttgtgaacttctttctgctataaaaattatttatttatttatttatttattttttgagacggagtctcgctctgtcgcccaggctggagtgcagtagcgtgatctctgctcactgcaagctccgtctcccgggttcacgccattctcctgcctcagcctcccacgtagctgggactacaggtgcccgccacctcgcccggctaattttttgcatttttagtagaaatggggtttcaccgtgttagccaggatggtctcgatctcctgacctcgtgatccacccgcctctgcctcctaaagtgctgggattacaggcatgagccaccgtgcccggcctataaaaattattgaggacccaaaaaacttttgcttatatagataatatctgtaggtatttattgtatttgaagttaaaactgaggatttattaaatatttagtttttaattcatttttaaataataatatacccattatgcattaacataaatacatatgtacatgacatatgtacatgtacatatacatacatgtacacatacatgtacacatgcatacatgtacatgtttatgtaaatatataaatacataaatacatattttttacaaaaataactacatttgccaaaataaagctctttagttgctgaaggatctcaaaatcacacttttgagaacttccatcttagaatgactggctaggaaaaaaaatgaaataaaccctagggcattctcttagatcattacctaagccctagattctcctattttcagtactattttcccccaaaaaacataactttctatgatgcatcacatcatagaaaaggattttgggagaatttgtctcctctgagtagttttctgttcaaaagataataaccttaacaaattcccaaactcatttttttctttgagaggtattgttttggcacaaagcatgaaaataaataaatgatgacaaatagcatcatttttcaattcgattaaagcattttgaggttagttgtggaacttcttgatttttctatgcaagtgtaaaagtctattacagaactgtgactcttttctattcatatattcctcatattatctaatttgcaacaaccaattttcacttgtctttctcaaaggggagcctatagaaactctggacccaaggactaaagcaatgctgtttcagtttcccagggatgcctcggacctttatcccttcttcatacctgctggatatcaggcattcttgatacctgctggaggcaattcattcatttagggagagagaaataaagtcttagccttcagctgggaaagactgaaaataaacaaagatatatttctaatgttagatactaataaagcatataaaaaagaaaagcaagctttggggaaatagaatgactgagaggatgtttaggtaaggtgcttagtgaaggcgtcattgagcagatcacatttgaccagagaccttaataaagtaagggagagtccattatgggacaagattagtctgggcagaggtcatggaaaatagtaatttcctgaggtcagaagaaacttgacctatttgctttagaggaaatagtgggagcaagtgtggttagtgccaaatacatggtagagatttagaagtaaaggagggtggcatagctcagggatagatcatatagggccttgaacaccataggaagtcattccaattttatgagagtgcaaaaagccattggcagagtatctaggaggagtgatcatcctttcagatttttctgatacaatcaactttcaatagtgagtcttgttctttcctttatttatggcatcaaatttaatgcctactgcatatttttgaagcagtgagtgaatcagtaaatcaatgaataagagttattggattttctctaattttttttgggaggatgttctggaaaatacaggaattattgttttgtgggtgcatttttcctatagcaaacataatactgtccacgacaatgtcatgcattatttgtcaagttaaatgtttaaaaacatttaatactattttctgaaaacagaaacagaaagtccattaaataataaatttcctgggcaacgtgatctttttcagtttatttttagtagtctgaactaccatggtatctgatatctgaagaaaacactgtttctcttacaagagagaaaaccttgtgttgtagtcatggattgagagctgaagtgttgcagctccctatttctagaaccttctgaacacatgtgagtaaatcagttcaatcctatgtgcttctggttatttgtctgtaaaatgatccacctactccttctcccagccccctccctatttctttgtcctacacggttgaaaagaagataatttattgtcacttaaacaatgtcttagatacgaaccctcaacttttcaagcaccacccaaatgccaaagactcttgatgttttgcggaaggaagacaatcagaggtttggcttagaaagttttccttcctctggctgaagatgaacttcacagcatttttctccactttgtacacgtaagccacatgagtaattttcctttaagttgaactactgaatttaaataaagatgagtgtgtttttgtgtgagttatatgagtgtgtgtgcctgtgcgtagtgtgtatgtgtgtgtgcacgtgtgtgtagggggagatttgaccaacatggggaatgaatgcaaagacattgaataaccaagtttccagccacctcttagttagcatagcttgatgtggcttactttccagaatagttgtgacttggtactttttaggagctatttggactgaagctcagggaataaccagatgaccataatgtatcaagaacttctcagaaaaaggtactgtataaataaatggcacttttattattctagtctgcctcctttggctataggttttgacatcaaactgtgaaagtcagtaatacagtttctgaagagctgttttactttctttttttctttttcttcctgttctctaatatctctattctgttttctgaaaatactcagctatgccttggctggggatgataaaacccttgttcacccagttttcctgattgatatctccacacaagctgatacacccacccgccctcacacacaatcagagtccattaccatttttctgaaaaaccaaacaagttacttgtttaaggcagttctacctgtcatggtgagacaactgttatttgagccttaattagcagagtattgggctgaaccatgtgtcttttgtgtcctgtttgcaggttaaactcaatatgacctttacagatctaaaggtcctaacaaattgcaatatgcaatcatttttgtatctacaaacccaaatatttaaaaaataactatttaaagcaacatgagttagctagtcaaatgtgctgtccatttaaaagtctatgattttctttggtaaaaagctcaggtagttttttcactgagtttttttcagtaaaatattctataaatatgagtgtatttctctctcccttctgaaaaatcaatatctgatgagttccaaaatctctcatagacctaagtttttaatttgacttttatactttgatagactttctgaaggaaatttatatcaatttccctggatgttacatttcattttcaaccacctaatttgtttgtttttttttttttttagacagagtttcgctcttgttgcccaggctggagtgcaatggcgcagtcccagctcactgcaacctccgcctcctgggttcaagcaattctcatgcctcagcctcccaagtagctaggattataggcgcccgccaccacgcccagctaatttttgtatttttagtagagacggggtttcaccatgttggccaggatagtctcaaactcctgatcgcaggtgatccgcctgcctcgacctcccaaagtgctgggattacaggcgtgagccaccacgcccggcctcaaccacctaattttaaacttcaggagaacgtataaatttcaccaattcacaccattaattcagaatgtacaaagatttagacatgtgactgttgtcgaataaacagttaacatatttttgactgaatgttggagctttttggtggaaattcaattttaaattagtatctttttcaaataaatatttaagagctgtcaaaatttgtatcttttgtatgtaacttcaacttctaaatttaaaattactgtctttgtctaattattttatattttagcatagtcacagttaattaattgttctactagagcttgaacccacattcttcatttgcagttcattttctgatcatgcattttctctggtttgggcaaaaaataaacatttttttaagctcataacaatttatatcttggtcatctggttggatattactttctctctcaagatattctcatttggacataatagtagtaggtatttatatattctatagatgaggaaacacagaagtttcttatcttgattagaaagagaaaatatttcaggggtggtaagtgagcttttcatgctcctatctgttaaaataccggttttatctctaactggggaaggtaagtaccaaagtattgacaatgagtgtttccatctcagcttcggcaacaaggtactttggcatcttaacattcctggatttgtgaaaaacaattaaaaaaccattaatattgggagaaaaatataagcccagttagtatcccttgcattgtttgtcccttcatagtgatccacttactagctgtgcagttgcctaccctcagctcccattccatgggccagtaattaatgtaccagggtaatttcttcctgacgccacagtctgttgatatagttatgaaaactaactgaggacctatgataaggtttccacagtgacttgattttactgcaggatgggactaacacaggtcaagaaaaaactgtaaaactggaaacagtgcacgtttattgtttttttttaaaaattagatactgattttttctggtgccagtagagaggccagaaacatttaatcttcagaactaaaccccaaaacctcatgaaacattgaaagaggaaggcaaaagttgctctcttccccaaatgtgaactacttattgcatcaaagattaagctgtctactatggtctgaatatttgttccctctaaaattcatatgttgaaatcttaacccccatggtgatgtatgaggaggtgtgactttgggagatcatgagggctctgtcttcattaaagggattagtgtccttatgaaaaaaagtcccagagagactctcaccccttgcatcatgtgtggacacagaaagaaggcaccctctacaaaccagaaagcaggttctcatcagatacggagtttgctggcattttgatattggatttccagcctttagaactgtgaggaataagttttgattgttgataaggcagccagtttatgggatttttgttataacatcttaaatggactaagacactgccctaactttgcttagattaaggaggttgagtgtatcagctgaatcctgaccaaaatttcttgttggagtggaaaggactcaaggacataatttaacaagttgtgctgggcatgtcaagtgctctagaaatttcatgagtctcctcccagtccacatattgtcgagaatgaatgagctcactaatctgctacaagatgaagaccacgacgttatacaggctaattctgagtcactgcatcagttgagaccagcagccactgacttacaaacacaacccaacttattttttgaagagattcgtagtagccaaaaatcgcactgctgtttaaacacaaatacttaagaatataaaagatcataaccacaaccttttaattataatgatatcctttaatgtgggagaagaagagaggagtatattatttgaccttagatgtaactgtatggaaaaacagggcatcagtcgcaaagtcattttacaaaagaaagcatattttcttgtgtgtgtttatgtgtaagagtgtgtgtgtgtatgtttgtgcatccatgtgcacacttgctcatacaccatagtattttaaagaacatagtttaccatagggaggaatggatataaaaaaggtgattaattagttctgtggcatatcttactatagctttctaaggttcacgctttttatatcacctcacacacaaattaatgccatatttatttgaaagcagcacagtgttaaagaagacaaaagagacattgaattcagccatacctggctttaaattcctgtcacatgttagctgtgtgattttatgcaaaattatttagtctgcttgatctttagttttcttgtttataaaaataagagtgtcacttttcttacagaactgttgtaagaatgcaaccagattttttagcttctagtaggatgtctgataactgttagatccttcttctttctctgtaagaaccatagttcgatctggctaatacagtcttatactgaatagaattatcataatctctaccactaggcttgtgagtagggggagaaagtggaatcataattttttattcctgaaaatacaccaacggaaaagtaatgatttctaagtcttaactctttcagacaagctgtttttacatgctgaaaagtgagatgccagttcttcatgtctccatcgtttctgtctctttaacagttcagaacattcctttccctggacaaattctgcaaaatgaagttaggtttccaattcttctatacccttttagttggtaatttttgagtcaggattatatagatcaaaatttgaatttcagagatggaagagatattagagaatagttcaagttttaaggcacattacaatcatttgagaggcttgataaaaacagagatttgtagaacctgtcccaaaagattctctttctggaggtaaaggtcccaagctcctgcatttttttaaaatacatattttattgtggtaagaatgcttaatatgaaattgatcctcttaacaaacttttaagcgtgcaataagatattgttgactatagctacaccaagtttctacattttaaaaacgaatgtcccagatgtctttggtttagttgggccactctctccagagggagcactactgccttaaagtctttctaattaacttttcacacattgcagggtcatttatagcctctgactcagtgcagaactgccaggggaggctttgggttttgtaagggttgaagcttatacaatatggggcctacattaagaaaacaaagtttaaaaatcttgtatttgtaaattttgccaagcatatggccatgtgaatgtactgctagggcttctctgagggcctgagaaggaactcatgtctttagggtccctgaagcataagcttcatattatatgcactgctgagtaccaccgatgacaattcatccctgttattatttctattttatgggatgaagaaacgaaggaatggagactttaagcaacttgcctgtggtcacacagctggtaagtggcagagtggggatttgaatccagacagcctgtctccagtctttgctctttgtgccatgacaacgtaatgccacttatagacacttcctgttttctgaaacccagagagacaatgtttttccttatttctatgacagaagccacagttagcactttttttttttttttttttgagacggaatctcgctctgtagcccaggttggagtgcagtggcgcgatctcggctcactgcaagctccgcctcccgggttcacgccattctcccgcctcagcctcccgagtagctgggactacaggcgcccgccaccacgcccggcttttttttttttttttcttttttgcatttttagtagagacggggtttcaccgtgttagccaggatggtctcaatctcctcacctcgtgatccgcccgcctcgggctcccaaagggctgggattacaggcataagccatcgtgcccggcccacagttagcactcttaatgaatgaactaaagtgctgaagacaataaataaaaatatacaataattagctgaacatttatgtattagttattaaattaccctatgtatttatgtattttatattttaaaatctaaatttaaaattcacaatcactgaaaatatatatgttaaaaaatatatatatatatgataaataattgatgaagtctctaggtgattaaaagataaagaagatacacatctggcccccagaagcttataatctaatacaccaagggtgtgagtagagggagagggtgggtgagataggtataaagttacaaacagcatgaggaagtatttgaaagcttcagcacttggagaggagagaaagcacaatcctaacctccgcaagagaatagctacagtcaacaaagccaaaacagaagaaaaaactaacagagactgctaattctctagtccagtattttgttggtaacagatccctcaattttatctgctcagaataaggattatattacggtaaagtgaggccacatgactaggttctgcctggtaaataaacagaagtctcatgtggcaattttcagaaaaccttcttaaaagatggctgacgtacttcctttgcttatttctcttccctctttgtcttttctgctggatggaattcaggctgatggctggaacttgagcagccatcatggtccacgagacagtacactaagaatgacaaaatatcaagataaaagaaatcctggtgattataagccactgtatcagccctgaattgcttatctccagattgtgatcatcagagagagacagaacactatctagtttagaaagcatttattgtgagtttctgtcatttgcagctgaacttagtcctaatggatacaaatctttattgagaatgctgacctcaaccatcattctgttaaaaaggttccaatgcatagagagggtataactgtgactaatataacatgactatatattttaaaacaaatgtgttaaaatgaatccaaatgaaattatccctcacaggctgtccctttgggagaaaatattattccaatcacactatcattagtcagatgagtattacagcttttcctttgagactgtgttgacagtggtagtgggagcagcagcaacatccaatttccagctaactgcagtgatgatagtgccatttggaaggactggcattatccaatgccagaggaactgtggtgcaagctttagcacccagggatctgtgatggatgtgatctgactgcctgtccttgtttctacccatgctccaagcctgctgctccactcttctcagggatgctgtgagctttctcgtatctttacaatagattatgtttatgtatccttttcagggaggcctttcctgatgattccgcataaatagcaccccttagcactccctgttgctatcacccgaatctaacgcgaggggctttgaaatttgagaggctgaaatgtgtcttctggaatatggggaacagtgtttgacctaccttcggaaacgttaaacgtgagggttggtactatcagctgagttagcaaggaataaggaaaggagggctgaggccagcatttaggactaaagtgagcaactgcaggcacattccaaggatgcgataagtgcttcttttggactagatgtggaccactaacacagaggagctggtggagggtcatgttaggttctatacatgagggtcacttgatgtgtaatgaaatctcagcagaaggatgctggaggtggaaggggaagccagagagatatgcattgcttgcatcctatatttttaatttaatgttacgtgatgaagtctctgaagaattcaagaaaatttttataaaagaaagtgtttgacatctgctaaattcaaagaagtcatcatactaaagaataagagcttgctggccttttcttatttctattgcttctttcccttccccagccacattcaatctgcttggattagcaaaaatagaggaggaggagtagaagcaggcaggcaaggagagaacaaccatcccctccaccttcacgccgcagacaacctcaacagggtcaagggaaaagggtttaactatatatcaaattaatgtgattattatatggaaccggacattctgctttctaaattggaactacatcaatgtcttaggcgattgtagaacttctcctaacaacaacattttcctacttattggccaggtttatatctaggtaaaagaatagtgggcatttaaaaataactgatttgaacaagcaggactcatggaaataatcataaaagcaacatgctttttccttccgctattcttttaagactattccctatgtctcttgcttgctcaactgccagttacttttaaacgtctggggatgttaagcaatgagccaggtgatatgttcttcctcactctggttatttccctcttttctgtaattcatctttatttcaacaatcattgtggtcattttgctctgatttctcccatcagatgaaaacacacactaaaaatggaatactcttaaatattttattcattgataaaactcttgccttctagagtaattaccacttcaaagaaatcctcaagaagacaactttagtaacaagaaacttcaccaatcatggaatttctagcaaaagagagagggcattttatatgtagcattttttttggcagtgctcaaaaaatactgtgtagaaaattccatatatgatttggtcaaattggacactcaatatttgtttaaagaataaattgatacataaattgcccttatacaaacttattaaaatgatgtgatatggtttggtttgtccccactcaaatgtcatcttgaattgtagttctcataatggccgcatgttgtgggaaggacacagtgggagttaattgaaacatgggagcagttaccttcatgctgttctcgtgatagtgagtgagttctcatgagaactgatggttttataaggggctttcccccctttgctcagcagttctcctgcctgccgccttgtgaaaaaggtgccttgcttcccttttgccttctgccatgattgtaaatttcctgaggtctccccagctatgctgtacctcttccctttataaattacctagtctctgatatgtctttattagcagcatgagaacagactaatacatgattaatgtcttctgaaaaaatacacttatgatacaaaagaaataatatgctgtgaaagagagtactgatatcctctgcttcagtatgaatatcaaacacagtagaacttatttcagcatgcccttggatctggatgcttaatcagatcaagtaccctgaaacacaattctgccattaggcaataagatatattcctctttctaacaaataattttcatactccatagtgtgttttataaacatgacactctgtatttgatttttaaaattgttacattttttaaaacacacagataatatatcaatgaatacaagttagaaagaatgggtagaaaaagggaaaatatgtctaaccacaccatgttaatgaggtttcctattagtagtatcttaatatgttttttttaatttctttttttttttattattatactttaagttctagggtacatgtgcacaatgtgcaggtttgttacatatgcatacatgtgccatgttggtgtgctgcacctgttaactcgtcatttacattaggtatatctcctaatgctatccctcccccctccccccacccctttgtagagacatggatgaagctggaaaccatcactctgagcaaactattgcaaggacagaaaatcaaacactgcatggtctcactcataggtgggaactgaacaatgagaacacttgggcacagggcggggaacatcacacaccggggcttaatatgtttttatgtaatactgcctttaataaagttgcatcgaatcccttttgagcagaagttggtattgtttaaatgtccacttcatttttcaattattcagtctataatatgtatgtataggaaatgtgcctgattaccaagtcagcagtggtgaaaatcatactgttaggccttcctgaggaggtagcatgtgaggtaaaatcggtaagatgtagaaatccatactttgctgatttactattacttagatttttctccttaatatttgacattttaacacttttggtatctaatgtgcatttttcctaacaattctagaattgtatgttacagaagacagatgattgagaggaatatttcacatctcttgttctcttttttaaaaattctacaattaagacagagtctaattggatttcctttatgaaaccactgtctcagagctcttaactgtcttcttaaaaactgcttttgtgaaagcaattttatcaaagtggcatataaaacctttactaatcctatagttttggaaaagatatttggatatattaacacagtagtcgggggaaaaatagtgaattcctactcaacagagaaacagcagctctaccaagatacttccttaagaataaccaaaactgtctactcccactactttagtgttcactgtgactccaagagaggggaacaggagtgaaagaagcccattgcggaacctgctcactcagactggttttctcactgctgctgaaaaggccaagctgggttgcatacttgagagaacttaatggtcagtcatggcattgaaacagacacatgcttaatcactttttcatgctccagtaagtaaattgttcatggacagataacaccatttaatctctgataccacttcatggaaaaacgatactaccagccacagggaaagagaattttaaaaataatcataagtggggttaaaaagtttaaagccagctgactgaatatctggctttgagtttagcattaactttcagatagaaatgagtatctgagtaaaagtttacccttttagaagcaagagctactaaaaggtggatagacagaatactaaaagtctttgtccatgtgtgaaatttcacaagatgagataaactgccagtccagctttttctataaccacaagggggacaccttctgtagacagaaaaaaaaaaaaaagactgaaacaaaagtaaaggattttaatgaataatcctcctctcccctcctgctagctcaccaaggaagctagtgaaagactataaatgacagggaattaccgtgccatagaatttgggagattcaggcccattcgtattctctcatcttatttcacagatgtgcaggcagaccctcttgaaacatgattcccaagctacccactttctagtttgtgtgtgtgtgtgtgtgtgtgcacgcatgtgtgtattttaagcccatttagcacgtggagaaaatgaacatgttcccttttaactgttaaaagggaagtctcatatgacagtgtgcttttgagcaaaaccaactccatgtgtgtttaagtgaccaaagagttggggggagaaaaagaaaaacagacatttttgtactaagccacgaatctcctaattcttcccacctgaaatcgtcttggattttaaaggttatttaaattcacatgagttctttctttgtgccgtgttaatattatatgcaatttgatttctttgcttgtctgagatttttcaggactgtgtttatgtcttataattcttaatatctttattgaaatagttcagtaggagtgaagagagcatatgaaatgctctgtgactgatgtccatcttcagagagagagacttacactgctacatgaaactacatacctgggacagaggaaattatgttggatttggaagtagaatatctgtttcagagtcccacaagataatcctaactatagcaacaatcatactctaacgataagaactgtcattgattgagtgcttattctgtgtcgggaacagcattaactactttaccaacattctgtcatgtaactgttgcatcaacccaaggaggctgtctgagtttctgttttacagatagcacagtgaagcttacagaacaagagaaacctgcctaaggtgacacatcgctagcaatttataagagaaacataattaataatcaagtctgtctgctccatttcacaatctgtaaaacaaaggtataatctacctcaaattttgccaggcttaaatgggattacacgagccccgtaaaccaaaaagcatacgtgcaaacacatgtattaaggtgaacatgccatatagacgaggtacaatatcaaaaatagactccacacaaagcagggtgcaaggcagaaaaaagagaaaggaacttttcttcccatggtcacggtctgtgccttttcacccaccgaaaagtctgttctcacttttctgacattcaatgttactcactagagataccaacgcagttcttcccagctggtgtaacgggactgtgacatactattagaaggggagtagagtagagtttcactttcactttgggattagaacactttagttggagaaggagagaagatagcagaaagcttgaagacaaaagaacaggcccactcagctctctcccttgatagagatttggtacttaaccttgaggcttcagctccatcgagaaccattaagtggcttcttgaccacattccctggggttagtctctgagcatgggaaaggatcagaaggtttgctgccacaggaacaatccccaaactttagccaataaaacacttttctaaatccccccaagccaaaacagtgtccccttattaagaagccattagtcagattttacaacctgatatgaagacaggcagcccccttacattcacttgatgatacactgctaacatttttacattgtgtcactaaatctgtgttaaacaagcaccaaaaactatcttttccctctccgatcaaaaaacactcctgacaatttcaatgacattaagcatatgtaagattttcttccaccatgaaactagtgaaattgcgtggatatcttacttattttcaaggaagctatgcatcatctaaacatcaatcatttggaatatacaatcacgtatttataagggcagatacaatgtacttgactttgaagcatgtcactcattaaaaagcatggcaagataagtttcttgttactgttttaacttttgatttttgatgtggattttaaacagacactttagtatttcaaaaggaaataagcacagaataattttgtcatatagctttcagatcacttagtcctcatttcacaggctataattgtttctccaacttttccactaatatatggaatgcataaactatgtttgtttgtataagtataaatatattaacttaagactgataagaacccagtatttcaataagtttcgaggaaacaaaagtgagtgtcctttaggtactaaatgaatcttatatacatttaaaattttacatatatgctgaagacacaaagttgactataacatcataatgtttttagatgatttgtggggatgggtaggagtagtggattcacaactatctatttggataaccaggggtgtccaagaataaaactcaaaatgaaagacttctaacgtcaacttggcaaatatattgaacacaaggtattaataacactagtgaaaagaatcaaaaattataaagtgcagtgaagttttataatgactgaaatccagttggaacatacgggaaaagatgctgattatattatagagaatcatatgcatcgtactgagatacaaaataaaaagatccgcaaatcaggaataatgaagaattgacaagcaatattttctgaaatctcaacttaaaaacccggccattcactataccttctatggaatttatattcctttaacgtaagaatgttaaaaccaacacgaaagtgtctctctctctataaaaaggccaatatttgaaaacattacttgtttctctcctacatctacaatttaacagttgtgaaagccttaggaagtcatctaattcaagctcttattttatagtcaaagaagcttaggtttgtagttctccttgaaaaggtccttcacgtcccttgtaagttggattcctaggtattttattctctttgaagcaattgtgaatgggagttcactcatgatttggttctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacagtttgacttcctcttttcctaattgaataccctttatttccttctcctgcctaattgccctggccagaacttccaacactatgttgaataggagtggtgagagaaggcatccctgtcttgtgccagttttcaaagggaatgcttccagtttttgcctattcagtatgatattggctgtgggtttgcaatagatagctcttactgagatacgtcccatcaatacctaatttattgagagtttttagcatgaagagttgttgaattttgtcaaaggccttttctgcatctattgagagaaccatgtggtttttgtctttggttctgtttatatgctggattacatttattgatttgcatatattgaaccagccttgcatcccagaccactgctcagtgaaataaaagaggatacaaacaaatggaagaacattccatgctcatgggtaggaagaatcaatatcatgaaaatggccatactgccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctgcaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctattttataaatcgtgctgggaaaactggctagccatatctagaaagctgaaactggatcccttcctgacaccttatacaaaaattaactcaagatggattaaagacttaaatgttagacctaaaaccataaaaaccctagaagaaaacctaggcattaccattcaggacataggcacgggcaagaacttcatgtcaaaaacaccaaaagcaatggcaacaaaagccaaaattgacaaatgggatctaattaaactaaagagcttctgcacagcaaaagaaactaccatcagagtgaacaggcaacctacaaaattggagaaaattttcgcaacctactcatctgacaaagggctaatatccagaatctacaatgaactcaaacaaatttacaagaaaaaaacaaacaacccaatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaagatgtggagaaataggaacacttttacactcttggtgggactgtaaactagttcaaccattgtggaagtcagtgtggccattcctcagggatctagaactagaaataccatttggtccagccatcccattactgggtatatacccaaaggactataaatcatgctgctataaagacacatgaacactcatgtttattgtggcactattcacaatagcaaagacttggaaccaatccaaatgtccaacaataatagactgaattaagaaaatgtggcacataaacaccatggaatactatgcagctgtaaaaaatgatgagttcctgtccttcgtagggacatggatggaattggaaatcatcattctcagtaaactattggaagaacaaaaaaccaaacaccgcatattctcactcataggtgggaattgaacaatgagaacacatggacacaggaaggggaacatcactctctggggactgttgtggggtgggggggaggggggagggatagctttaggagatatacctagtgctaaatgacgagttagtgtgtgcagcacaccagcatggcacacttatacatatgtaactaacctgcacattgtgcacatgtaccctaaaacttaaagtataataaaataaaataaaataaaataaaatttaaaaaaaaagaagcttaggttcagaaagtgtaaataaatttacaaagatcacaaaacttgggagttgggaaaccaagcctaaaccacacttctccctctattacaatccggaaatctttcctcagtattttttttttttttttttttccacgacagagtcttgctctgtttcccaggctggagtgcagtggcacgatctcaactcactgcaacctctgcctcccagattcaagcaattctcctgcctcagcctcctgagtagctgggattagaggcgtgtgccaccatctatgtctattgacaaccagtcagtagctatgttccatctttgtaatgggttttcctctttctttttctctccccaacattcctttcctttcctctcctctcctcttttttcctttccttccttcctttttatcttttcttctttcattctccttcacttgacatcatttccttcttcaaatattaatacaacttggataaacttttttttttccttatctacctgaaagtgtgtgctttctctcctttacaggcctctgcaatcactacaataaaatatttgaatcatttgacctgcattttgtaataataataataatcataataataaactctgacaggtctggctgtcccacttccatgtggtgactcccctatcactcttgtaattgctttcagctacctggacattattttctcctcaatccaatagcttttaagaaaaccctgtttagtgcaatcattaaaaataaactctggcttccaaagaggaaacacaaacatgagagattgctcttgagattaaataaatgataaacatttaaaaccaaatggtgtatatgtgccacattttcttaatccagtctatcattgttggacatttgggttggttccaagtctttgctattgtgagtagtgccgcaataaacatacgtgtgcatgtgtctttatagcaggatgatttatattcctttgggtatatacccagtaatgggatggctggttcaaatggtatttctagttctagatccctgaggaatggtcacacacatatacatatgtaacaaacctgcacgttgtgtacatgtaccctagaacttaaagtataatatatatatatatatatatatatatatatatatatatatatatccaaatggaagctagatattgttttgttccattttttcttttgctcatgctcagaaatatttatatcattcattaatggatgtaatttctgtcagctattggcagagctggcatttgaagcaagtgcttctacctgttggatgatcttagttatatttctaaggaactgaggaacaacactttatcatgtaccgtgtttatatgctttctcatctactctcttatttgcccctataaccctaaacctagtgatatttttattattatcataaatttacaaatgaaaaaactgaagcaaagattgaagtaaaaaaaatcatgcttctgggaggtaaggtttggtacccaaaaaaatcatactgctgggaggtgaggtttggtactgggtttgtcaactttgtagtctgtgtacttttaacataagccctacaggtaaataaaagttaaaagatgtctcagttgatgcatgatttcttgtgttcatgataacaaaaatcattatgaatatatgattatctgagtcacaagacatcatggaatgagtgtagattttagtgtcaggggatacatttaaattctggctattttgcttataatgtagtaggtcaacaaatggagtcatactaattattgttgttattaatctctctatgcctgaaagcaaaagtgttttatgaggaaagtgtataccatattaaaaatgtaggaggaaagcgaaggatccgagttcaggacaaactcttagagtgtttttttcttcttcttcaattatgcctccttatgttttcatcagatgagaatgactaggacaatttaagtaaaattgataaggaatatcagggaaaaatgtgtgtaggagcaagtcacagatgtatctgttggtgagttaaaaatcaacacgaacaatgagaacttcgtgacaaaatctaccaatctattatcttgcacaactgttgatagtgaactttataataagaggtcattccagtggttataaagcccagtctcctcattctacaggaaaaacagaggtatggagaagatcaatgactgaatttacatgtcttgtgacaggattggaacttgtagccaggactcaggattctgagtactgtagttttgcttgcagtctccaggcactgaaagtgacccccatttaaagaattaccttctttattgataggattaggcttcgtcataaagaactgtcaatgattcagttggtagatgccagaaattatgtgattctcaggcaacaaaaaattatctatctgtctatcaatcatttatctatcggtctaatctatttagataaataaaacagactcattcaggggctccatttgaagtgttctttggaaaactctttcagcagttatgaggtgcccactcattatcattgcctgctcactgtcaggaaacattttgactctaataaatgcaagaatacaaagcccaaatcaaacttcagatgccatctgagcatatgactctggtacctttgggatgttcacactgctctaaataaacagattacttggctagatttacttggcatgtctgcccgtgcacactggaaaactgggacaagtttccagatccaaatgggtggaggaatcaagcagtgcctgaggttatctgattaaaattcatttggaaaagtattattcaaaaggatttcagaactatctgaaaagacagcatggctgtatggcacgtatttcaaacagttggatcaagatctgaataatgttgctaaaaatgctaatggaagcttctcagtggcaccatgtgtggattttgcccttgataaccagataaaccagagcttgacttttaaaaggttattctgaggatatttgtgcatattagaagatgaaatcattacaagcagggtattcaattaaaagagaaagatccgaattactttctcgtctgtgaatgtcccctcactttgagcctggtaaaattgacagtttttgagattgatgagtttgtatagtccttacaataaatagactgcatattttgcagttactcacccacagcctacatatccttcaaaatgtgcatgagtaatgttaaaaaatctgtttagatgatttccaatttcatcattctcagtaaactaccgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtacaataaaaaaaaaatctgtttagaatttagtagtcaggtggactttagaatgcaaagaaaaaataggattattaaaattagtttaacagcatggagttaaataaagaagggaaagacctcctgcttggggcatgtgaaatacaaaagaaaaaattaacttctaagcatccattttcttctagtttctcatccaatgagattattttgacttattagctttggtattcaataaagatttatcaagcatacccactgtgtgtcagacactgtgtcaagtcctgagtatatcaagataagtaagattgatatacaccctcaaggcacttagagtctaatgaggagatagaaaaatacatgttgacaatattaagtaccattacagagatatccacagggggcagtgggagcagaaagggaaaatataaatcagtattgggtaagggggagttgagcctcacagaaagaatggttctttaaagctctattgagggttcatcaagtgaaaaaggagggaaaaaagcactcaagaaagaaggtattaaatatgttaggaaatggagatctgagccactctgactagttcagtgaatcataagtagtttggaataactgggacaaagggtgcttatggggagacagtgagagacaaacttagggctactagcaattgataataactggcagaactacaatttcaagggtctttggtattaagttaatgaatttgaattttatcctgagagttatagggatttattgaaagatttttacctgtgggtgtgcttgataaaacttgtgttttagcaaatcactttggcaacaacgtggggaatagtagggagcagccagggtggaggtaggatatctcttagcatgctattgcaataacttatgtaatataagaggcagatggtaatggatatgagagacattcaggaggtatgaactattggattttgggactgatttggtgtgttgtggacacttaagtaaaaaaggggatctaagctgattttcagtttacagttaaccaaagagttagataaatcagaaaggtcagtcaggtggatagtaaagatgatcagtttaaatcacaacatgttaaatttgagtctttagactccgcagaaatgggctgaatagacagttgcatatattggttggacggtgaacaataaacattaataaagtgaaactaaagtcaaatataaacatgatggtaaaacagtacctggctgctccaaatttgttcagacattttgcaaaagtaaattatatgccaatgtattaaagctttttaaaagagaacattgaaccaatcagtagtctttaagggactctagaggttgaaataggaaccacaagattgcaagtataatttcaatgttcaaattaaagtcattctaacttcataagctttagggatctaaaacctatcagacagataaatgctgttggtttctgaccttcactgggatttttaacataactacataaaattacttaaggccaaatagagaaatatggactgaacaatacaatttaatgtaatccttcctaacaactgtgctcaaaaattgccaactctagatgaatagtgagtgggtgatgtgctgcaaggctctgtccttggttttgtccaaatactttgtcaaactattggatgaagatataaaatccattttcactacattttcaatggatatcaaagttgaagactgaaagcaggctagatgacatttagaatccataaaaatcttaatagaggaaatttaataggggtggatctgaagatcctgcacctgagctctcagaattacctaaaaactatttcttggctgagttggggctgtcaactcgctcaacatacaaactaaattaataataaaatagaaataagagcacattcaaagaaaaaccttcaggcactgatataagccagaatccagttacatgataagagaatagactaaagaaactggagccacagagaaaattcgagagaaacacaaataattgttgatctgtggagacttcaaagagtgtcacatggaagaagaatcatgttatatataatcgtaaggactggaactagtggtatcggacaaaaagaagatacttttttcagttcatctctgtgctgcgtttgctcacagtggagtagaggataacattgactttagagtcagacttttctagctctactgtaattagctgtgtaaccttggacagatttctttagcatttttctgtctcattttcctcatctaaaaatgaggatgataataggatccagctcataaggttattgttaggatttagtgagttaatataggtaaatcactgagaaaagtgtctggcacataggaattgcttttgtgccaacttccactgttaccaggagcaaaaggtgagttgttccccaaggaacaagagaattagagagatattcttcaagaagcttttaaaaaagtattggtcatttgtaagccagggtctgtgagttggtgacagttcccaactgtcctagaggctgtctgcccacacacttcccatcagagtttatggggggagccaactgcaggcaacagtgttcatcccaggacctaggacaatcttctggttggttatcggaccagctcaggcactcctgtcattgccaaactcatcttctagtcttcatactttaattttccatacatgtctctgacttctgtgtcaataaccgagtcagaatctgtttttctggaacacagtctttgcctctcatcccaagtccttgctggaggataagggcagtgaagcaataagcctttatttaaaatattctcgggtataaactgaagtccatggagccacaagcacaaagcaaatatttgatgttttatagaaagtgggaaaaggcttctttctatctcgagatcagaacaaccttgagattttactagcagctacattagtgtgttgttgtttctagactgtggtttgtgtacacatgtaacaattcatcatcttgtacacattaaatatataccatctttattggccaactttttaaaaaacaaacaaacaaacaaacaacaacaacaaaacccccaggatttggagtatctcatacttctgagttacctacccagcaatctaattaaaatttctgggtcagatctttgaatcatgttcatcatcctttccactctatctatggaccatacctttctcatattgagttccactcatattgtgtttcattgtttcttaaaacaatgaaatccatggacaaatggccttgagaaacactgcattactataaccgtggcttcaatattcccaagacagattaacttattaaaagccccaataattcctccagaataaattcccctagagtaaatttatctgagtttaacccgtagttgctagtttgttcattcataaagttatttttagcctgtggtccatcaatatcttataaatctaatatttggggaaaaaatggaactattaattttagcagccattatttgaactaagtattcatttattcttgaaaagaggcttttaattagggaaaacatatgtctccattttcttgggacattcccagttcattgatgttgatccagtgtcattattaatagctccctctttctctctgaaaaatataattgttctgataatcaattacatagacactgaacctataaggtaaggtattatcatctgactttttttttttttttttttttttttttttggcttttgcctctctagtgtctatcctgcctactgcagccaggaagaacttttacaaaggtaaactagatcatttatttctcagctcataatcctccagtggcttctaggaccctcagccaaatctatagctctcaaagacctagtgatttagctgctggctatatctctgatgtaatgttcgaaaaactctcctacctgttctcacggggctgcttactgtccctaaacatatcaagttgttcctacttcaaggcctttcctttgctgcatttttctgtctggaaatctccccggttattcacatgacttgtttccttacttcattgagttttctgctcaaattttatttcctgtgatcaccttatctaaaactgctttcttttctctatccttctctatctctttatccttctttactttgtatttgttttctgtattgtttgagttatatatcaaacaccccagtgacattaacaccctggaaacttcattaagttgtatttatgtactctttgtaaaacatttctgctattttcagttcttcaagtaaattagcaaaatagttaggaaataattgcatacatttgctcactttaaaagactgacattttaaataatgttgtcaagtttcatttatctcccttatttctggatattttgattcacaagcactctcttttgacctgtatgcttcttttgatgaatatggatgcaatctacctttctttgggaaatgtatctgtaactaaatcagtaacttagaggaaaggagctttctagaaatcacccagtacattctcctggtcggatagggaaatatactaaggaagataaatgtttctttcatgtacttcaatgtgtggatggacatctattttggtttgtgcttcatcatgtccttttgggagttgccccttgcccacgtagtagggatctcaatccaaggcctcatctcatttgccacttatgtgggacctgacaaaagctttacaacaagaatatgtcatctccctgtggatgcagagtgtcccaggtctcagattatcttataaccagggaatcaaagtgtcaaaggaacttttctttctatctctctactcagatgtactctgcaccctcaatcaagatcttaccatgaagcatcaaagactgttttcatcatctctagacgtcttaacatcatcctcacaagaatttaaatctccccttgcccagcatccatagcaatcctccaacaggattctgatatgttccatttggttctttctaggccaatggatatagacagaaaagcaaacaaagtgaatataatcctagaaatggatctaaatactattgaacttatagtcactacaaaactttctttagaaaaatttgtactcattgctacatggtttattttcccaatttagcttccctttcctcatgtcattcatctaacccactgaagaaggcacaatcatttagccagacttccatcttccctctcaggtttgcggactatggtctggttttcaacctctgcaattttcttttctttagattctcaaatttcattaataaattatttgagggtaagggctgtgtcttagtcatcattttgtacaccaaaatatagtgtttgaaagatagtagatgtgcaataaatgcttgttgagtgactaataataactaatatttattgagtaattactaggtgacaaaaactaaacatatactttatctcattggttcttacaataagaatataattgcattttaaaaatatttttattcctttagtacagttgtgaagatttattagagcattcaaatactttcatgtgactttgaataataaacacattactcagattaagtaaagaatactcatttattcacttaattattcatcaaacattaattatctactttgggtcaggaaatagcagtccatatgcaatataaggaagatgtcacagatctggtcacattcctggttagaacccttacctcctactctccagccactgatttcagaacaaagttccaacttattagcaatatacaggattctcatcatcgcctcttcaatcttattcctgactatctcatacctaaaagctcgagcaatagcaaaaccctaatagagattaggctagtggttatccttgaggggaaaatggtctggaaagagggataaaggggccttctgaagtactgagaatggttctgtttcttgatctatttgatgggtatatgggtcaattccatttatgaaaattccttgagctgcataatcacatgtttctgtaggtatgatatacctcaataaagagtaaacaaaagaaaacaacaaagcaccttttgtaataatgaactatttctagtttcccatccataatttgtcttaattttcccttttctctagactttgcatatgctgctccctcaacccacatctctactggtctgtgccattaactctgtctcatagttctcaccgagctgctttgcaacggcctgtttttgcatactctaagttcttcagaaccatgtctccagctactaaatgaacttggtatagtgagatagtcacacaattacactggtgtactttttattcaacatagtgctagaagtcctatctagagcaatcagacaacagaaggatataaagggcatccatatttgacaggaaggagtcaaactgtccttgtttgccgatgatacaatctggttttggaaaaaccaaaagactccacatgaaagctattcaactgataaacaaatttagtaaagttgcaagacacaaaatcaacacacagaatttagtagcatttccatatgccaacagtgaaacaatataaaaaagaaataaaaagtaatcccatttatattagccacacataaaattaaatacctaggaattaacttaaccaaagaagtgaaagattactacaatgaaaacgataaaacattgatgaaaggaattgaagaggacaacaaaaaatggaaaattaatccataatcatggattggaagaaccaatattgttaaaatatctgtattacccaaagcaatctatagagtcaatgcaattcctatcaaaatgccgatgacattcttcactgaaatagaaaaaatagtcctaaaatttatgtgagactacaaaagacccagaatagctgaagctatcctaagcaaaagaacaaaactggaggaatcacattacctggcttcaaattataatgcagagctagagtaaataaaacagcaggttactggcataaaaacagacacatagaccaatggaacagaatagagaacccagaaacaaatccacacacctatagatagtgaactcagttttacaaagttgccaagaacatacactgggaaaaagacagtctcttcagtaaataggcctaggaaaactgaatatccatatgtagaagaatgaaactggacctctgtctctcgctaaatacaacaatcaaataaaaatggattagagacttaaatctaagacctcaaaccatgaaactactacaagaaaaccttgaagaacatctccagcacattggtctgggcaaagatttcttgagcaataccccacaagcacaggcaaccaaagcaaaaatggataaatgggatcacatcaatttaaaaagcttctgtacagcaaataatacaatcaacaaagtgaagaggcaacacacagaatgagagaaaaatatttgcaaattacccatctgacaaggaattaataaccagaatatataaggagctcaaacaactctatgagatacattctaataatcagatttttaaaaatggcagcagatttgaatagacagttctcaaaagaagacatacaaatggtaaacaagcatatgaaaatgtgctcaacaccactgatcatcagagaaatgcaaatcaaaactaaatgtgatatctcaccccaggtaaaatggcttttacacaacagacaggcaataacaaatgctggtgaggatgtggtgtaaaggaaccctttgtacactcttggtgggaatgtaaattagtacaaccactatggagaacagtttggaggttcctcaaaaactaagaattgagctacatttaatccagtaattccactgctggttatataccctgcaaaaaaggatatcaatatatggaagtgatatctgtactcctatgtttgttgcagcactgcttataatacctaagatttggaagctccctaagcatctatcaacaaatgaatggataaagaaaatgtggcacatatacacaatggtgtactatttagttctgatgtttctaaacatcaaaagaattgaactcatggacatagagaatagaaggatggttaccagaggctggcaagggtagttaggggatgtggggaaggctaatgggtacaaaaatagttagaaagaatgaataagatctactatttgctagcacatcagggtgactgtagtcaataacaatttaattgtacattttaaagtattgtaaagagtctaatgggattgtttataactcaaaggatagatgcttgaggcgatggatatcccattccccatgatgtgcttatttcacattgcatgcctgtatccaaacatctcatgtaccccataaatatatatactatgtacccacaaaacatttttaaaaattactaaaatagaaaaaaataaaaaagtcacattggtggaaaatgctcatagagctcaattctaggtgctacggaaacacaataaatgtgtgcatgcatacacacctacaaatactcaaacatctatagtaggctgaatataagtcaaaggggagcagttgatttgtgcaattgtcactccccaacaaaaacaacaataacaatattcagaagacttatctgtacttttagaatcactatgcatacatatttggagtactggtgttaaagatgtcaacggagcttaaataggcattctgtaagttaggcatcccactcttttcacatgtagacttgttaaatcacttgtcccagatgttaaaaccataggtccatgtcaaattaattcccttagataaatgactaatcttgagttagcctaatttcagtactgagaggttagggagcacaccaaatcaattactctttgtctggtttctaaaccatcgttgaacataacaagcttgcgctcagattaccttctgcagaatttctcagagctagtcatgtgttagtgtgccttctggcacctgagatggagacacattttatgcaatatttcatagatcctttttttttttttttttgaccatggaaagctttacttcaccaaagatatgaaaagacaattcttttccaaccaaattttgaaaactgtgatttagaagtttacaacgttggtgaatttttggaggtctgtttctcacctgtttaatgaatatttactgtatctttcctcaaaaagtagatacaattatccagtaatttgggcatggtaacccaaatggattattgagaagaaaaaacaagttttgggggcatatactttttagaatggttatctatttagtctgtgttccccaaaagagcatggacttttaccttggctcagggacacatttgttgaacataagctaaattcataaatgttatgtaaatttagtttctttataacaaaactttgggatttggtttttagcatattgggttcttattttgtcttccaaatctttacattcctcaggaaggtataattgtataaattactctagtttattgttgacatggttgttgataattttaaaaaatgtaatctatcagggtctatagatttatgggacctgaaggaattcaattttgtgtttaaatctctaatctcattagttgtttttcctttcccctgcctgtagtagggcagtagatatttatctttttaagcaaaagaatatttaaatattaatgatagcaaaatcatctctgggaaaatgatataataagtgttcttaaatgtgtggtagagtgaaaatagggttagaaggtggacatgacctctattcctccgcacatgtctggtagaatgtgaggaagaaagaggtaagctttcatttcattcccttttacaaaagtacaactgagcaatttccctacaccttatatgtaaaattattgctttataacttttacaaaactaaatgcacaactcacaaaattggtaaaaattgtatgttgaatttccaaaggtcatatgctcataagcaaatgtaagttaattgtcgagtggatttcttattgttcattttagattaatgaatgtaaaattaaatgaaatttagcacgtatgggtgataggtccctcaatataatactaactttcctttaaatgattcttatctcattttccaatcgtctttacttacataatgttgcagagtgaagggaagggtgttaaacatttcaacatacgttgatcgaaacatgattaatatgataggcagggagactacaaggatgaaatatggccacaaaataataatttaactctgacattcaaaaaatgtctactcaacactttggaaatgttagttcataaagagcatttaatgttattttttatagagttggtattcacaaaaactttttcaagtgattatttattaaactaagtggactgtaatctgagaataataatattattttgctcttactccttgccataacactactgaatatctttcacacattaattttattatttgctttcatttttaaaaggcacggaaatgactgtggagcagtgtagaacagagcttaaatgcagccttcaaatcctacttcctctttttactagttgtgtgatcttaggcatattatttaacttttctgtgtgtcagtgtttccatctgtaaaatgggtgactatctcatagggctaattgtcagaattaataaattaatacctgtaatttgcttagaagtgtgcttggaaaatagtaaaaccttcatacatatcaagatagtttttaggtgacttgcccagcatggcagaaagtaacatagttgggatttgaacatagatttgtctgaatctagaactcaggattttaactgcaacaacaaaaatagtttttatttcatagaatgtattttatctatataagtgaagcaataaaagtagtaaagatttaaaagtagtttgttagaattgtgtttctttgcattaaattcaacaatagcttgcaattggcaatggttcttagaatcatttcatatataattgcactttgtctctcagaaggcaagctgctgggcagattaaggaactagagttctaatgattattgtgtattattatttattggaatctaacacattgctcagaatagagtacatattcaatggagtcttctttctcatttgcctaaaacacctggttcagaaaatgattcaagacatttcctcgtcctcatcatttctgttaaggtatgatttcatttttaaaagtttaggaagttctcgacacttcctagaaaggtaaaagtaaaaaaaaaaaaaatctaaaaaaaagattttccttttttagaataaatttgccaatgttttagaaaattgttgctatccaaaattaactaacatgctctttcaatatgtctgtttgatgattttctaaaacaatataaaatttcatttagtatctgtagttaagaaccataatgtcacatatatatattttatagctttcaataattgtgggtagcattcacatggattcaagctaaggactatgatagatatcaaatagacacatatcaatcctttattatagagaaaacttccttttaaacatgctgaaacttttaaaataaggattctgttagcaaagaatatgccgtcgataaaacttccaaagaaattatcctgggagaaagtacatttttttcctaatcttcagctgtggttttgttaactcctcttctgaaataaattagactggcaaccacttttctttaattgcataaaggaaatgattcttaatcttggtttcacattagaacttcatgggatggacttaaattacccttgtctggaccccactaacatttaattcctcaggggtacaatgtgggcatcacctaccctacgtgattttcatgtgcaatcagagttgataaccacggctcatatcagggaaataaatcaatgggataagggaggccattttctcctcaacagtaccaagtgcctcttgaatttgtttcccttgtattacttcacagaccttaaaactacattgaaaattctctggcatacaattttcttccaataccttgtcatgagacttgaaaacgtcatgtaactttaagataaaaaattgaaagcggttcttcataggcagatcatgtctgatcagaataccaggtgaactggatcctaggaaaccttcaccttccaatgattgaaggtggagaaatcctatagcctttctggctttcagattccttaccagcacctttgcctagtctcaggccttttgtgtcatttttaacgttcttaaaatctttactattctgtcagggaccactcagtgtctcccagcttttaatcacctgatcaaggggatttggaattttttttttttttttttttttttttaagaattgccaatgatatcttttcccttgaaacataatgaccttttctgtgggccaaaattttccaggcttctggaagtgtacattcctactcttactttcatacaaactctctcccaacattcagaaatactcttccccatcgaatcctctaaaaagtgcttcctcctcttgttattgtcacaccatagaccaggcccacagctatccagacaggtctcatgatgtagacagaagcctccaacctgtgctccatgctatttggaattatttcaaattttttcatcatacttaaccaccatgaatttgcttcatacctcagctaactataacaagatcattaacagccttttttttgttttttttccggtgcagtctcactctgtcgtccaggctggagtgcagtggcatgatctcggctcaaagcaatctctgcctcccagcaatctccgcctcccaggttcaagcgattctcctgcctcagcctcccgagtagctgggattacaggcatgcaccgccacacctggctaatttttgtatttttagtagagaccgggtttcactatgttggccaggagggtctcgatctcttgacctcatggtctgccctcctcagcctcccaaagtgctgggattacaggcgtgagccaccgtgcccggccgccattttgtttatttatttattatttttttacgtaagactgccaacaccttcaattttcctctcaaaatatgatttctttaagattttctagatgtatagtcatcactaaatgcttaagaagtcatgaaataaaagggcaagtagcttgactgtcatgaattttcttccacaaatgttgacatagtatatacaaaattagcagtaagtcattgtctattacttatattatgcttcttggattagttttcaagagaaaaaacaggagcagacatttctcatgaggagtgcacacttgaaatgcacttggcagtaggcaaacgagaagatagtagctgatatcatatatgcattgcatctgttcacaaacactagtggcatcatttatgtcaaccttttacatattgaaaattgcaaagactcctgctgtgctgtttcttttgagaagccggctggtatatagtgtttaattaagtattttaaagccatcttttcgtaggcctgttccactttagcaaaagttatgacagcttgtctctgttagtttaaaaaaagaaggcatagtttattctctctctctctttctaactctctcacaaatatagaatattagtatttttaagtaaaatagcctattttagaaatatagaaatatgttattttaatgtgctctcaatgtaaataggcatataaaagaataatttgatggaaacaatcccttagtattgtaattattttaataattatagtgcactattgaaataaaaacacatttcctctttctctgccacttttttggtgtaatgggacattcagagcttgaaagaaaccaccacataagtagtcatttcatctgtatctgttaaatgaattgcttttcccagacatctaatttatccagagaacatctccttggtcagtattacaaattgtttttattttcttacacttgcttattaataattttccatgtcatgtctgtcatcagagaaggaaggtcacattcaatatttctccatttctcttttcttttttcccactcatactctagattgaaaacttagctaagtaaaaacaattggttcaaatcttatttgaattatggacacattattctcagtaaaataaatcttgagtttaaatcccattatcttgtgtaaatttttttaattcaatcttggcaaaacatgcatattttaaagatatgacctataattttttctcttgacttttgtgtttggcaggagttcacagactttgctaacaattttaacagatatgctttaatttaataactacaatttggtaattagctggagtcgcatttcaaaatgcaattgatatgatttggctggatttatctgtattctagaaaatacaggacagtcgtatagatactggtgttgttactctgttcatattcacacttttaccttgcatcattcctgagacacagaatttttgatattctgccacaatctattcccaaaacatcactgatgacaaaacgataataatctttggaaacatttcctctcaagttccaaagttttcagtcagtagaaaaaaaagaaagaagacaaaattttaaaggtgctgagaaaagcccagggctcacagctggtttcagcaacttcaacttgcgtaagaccccgtgtttgtgaaaacaacccaagaatctttgaacaggatgtaatcaacctccgaactgctgagaaatattgcaaaaatgacttcagctgccaaaaataatgtcgtttacaagcagctcttcctatgtctaaggaagaactagtcacacatgcgagtttttgctggcttgagaacaagcaaggaaaaagacaaatcccacctaccctagcctaaaatacacagtgagtctcagaaccccgcggaagctgtggctcatttctaaaggtgctggcaatatcgaggaagacttgtatccacaaaattccaaatggtaagtgacccaggacagagggattttatttggcagcaaatctgtgttgccactttccttccgttgcaaagcttccctgtcttgtggaggcagagctgttaaatacctcttagtcactagctccaacctatttttttgtttgtttgtttttcttttcaaaatattatctggcaccttcccttaaaggacatcaagggctctggaggaaatatttgcaaatgatcctttatagaagttccatcacaaaagcccggcacctacctctgtcaagctttggctgctcagtccgcatgggctggatgtgaaaaaagatcccagtatgatgccttctctaaatttaccagaaag

SEQ ID NO: 1984 - DNA, 318159 bp, Homo sapiens; identical to SEQ ID NO: 1981

SEQ ID NO: 1985 - DNA, 318159 bp, Homo sapiens; identical to SEQ ID NO: 1981

SEQ ID NO: 1986 - DNA, 98052 bp, Homo sapiens
taacatggtaaacaactcaaatggctttcttttaatgctaggaaaactgtccacctttcaacggtgacagggctgttaacacaggtaagagcaaacaaggtaaaaagtgaaagcacatacagatgatgcacacaaatatatataaaaattgaccagaaatcacaggacatgtaagcaatgttttcttaagcagaactttttttgtactttaaatagactaaaatatttggtgtaggtgggagaaagacatcagtattcaacaattttaacttgaaaaccagctgtaataaagcctcagctcattgtttaataaaaataaaaaaggaaccacatcgtacttttgacaatcatagaacgaaagctcacaaagaacacatttaatatctccatcacagtgcaccaaggatgcagccactaaggacttccagagggaaacaagaacagggtctgcatccatcatattgcattacaaagttaatgccatcagagaaaaaaaatctcacctcacgtgctcaatgttctagctggtaagcaccttatgagtatgaggctacaattgagagaaactgctcagtctgcatcaggacacccaattccttcacttgccattggctgatgcatttaatcattttaacacaacattcacggaaaaatgttaacaacacattctggcttctcgagcagaacagactgggaaatgcagtagacgccagagcatcaaaggccatgtatttcctcacaagaaaagaaatctgcaacaattggtttccttttactatgaaaaatgtaaatttcagattaagtttaaccccataaggacgcatgatttgtacttacatatacacataggttcagaagaacttagctatctagttggcctcttctctgttccattataacatcagttaccttagctggatcactaagtgtgagtctcaccaccatactggtaccttcagctattacctgtgttataaatctcatgttccattcaaagtactaaatgactggatggcacatatcccaataagtatcagaaatgttgacagccatagtgcagctgagtttagaagcaactatgacaacatagggaagtaaggataaatcacaagaacacctaaggtggtcagctccttctggtgtgcctgggacttgttttgagtttagcaaaaactttacaagattaaaaatcagagcaaatgaatttcttaagttcaagatatgtactctcaatggagaatcgcttttgggcagtggttaaggcctctgatgtgctacttatcagaaaaatccacatatatacaaaactctgctaaaagttttgtatccagggaaagtcccgcatccagggaaaccctcaatcccaggcactttagggcagctggtcaccctgagaacactacccactcgttccttaatatcactagagaaaaggtaagaactttcaagggcataacctttaagggcatcagtccccaaaatatttttacatcactagctaatggctagttcctctaagcttgctaaaaggctaggaagtccagaaataccttaaacgtgttaactttaagaagagttggtagtaatcaagcaaattagtgagcagtgtataaaagctcactcttgaaatctgttttcagacaaatcttctaaaggttcttctagctttgtccagttatatggtattttactgtattctctttttgcaattaatccagttttgtatgtcttttctttcttttttaggtgaaaatattctatgccaactgttttccacagtcctgcattatatattaaaacaaaggctgccagctggagacacagccctccgattacaaaggcccagaatgttacttttaactgtgctccaccaggaggtctggccttgggaaaagatggcgaaaggaatattctcagatatgaacattttttattctgcctacaatgctgtgatctagttcaacaactgcagaactgttctcatcttaatcgctgtagtttttctttctttactcttttgtataaaaggttagtgtcacagcttcactatcactaataaaaagatacaaatatgcctttcaagtcagggttggaaaagcaaaactgaggtgtgaggttacactggtctaagaaagtaccaatttgggttctatattttgtcaaacagttgggtttttaaaaaaattcaaaactcatgcatgttacctacttgtcatgtgtgaattatttctcacaattttaattaatctgtgtgtatattagttatataaagcaatggatttccacattcttaaagcaggaacctatattcaccagaaaaggatcctcctgtttctcatcaaattttttttcagctcgaacaatccaagattgggaatagtaagagtggcaaacaaatgttttcttagggacttactgagaaaagaaaaaacttactgggagaacagagacttagtaaaatttctattgctacagacaaatgctaaaaaccagctttataataacagcattataaaggatagaacttaatatagaaccagaaatatggcaagttacctagtgattaacattgtaaaatagtcaaaaactttaaagccacagagaaaggaaaacaattatgaaatggaaaatatataatatttaagtacttttataattctaaaacttcacttttgtccttaaatcaatatattacggatttcattgttcaataaattaccatctttaattaaaaataagtaaatcaaagagcatatttggagaaactaagagctgttaactgtttggagggtaaaagaatacttttctcgaaatttttttgaagaaaaatctaaaagccctctatgttgagttaatacaccttctgacccccatcatcagtggcattattcttccaagggactcttatatctaagcaatggtgaagttctggattcattatggatctcatggcaccaaaccaactggcactgaagttaagttaatatactccagcgagatcacctgtgggtcaaggatggcccagagaatcttggaaaatccatttatattgagcaaagatctgaatcaccttcaatcaggctgtaagatactagaaaatttgaccttgtagtagtatttcccagggtaacttaagcagcaaccttgcaccagaagaagaattaaagagggagcaatctagtattatcaacaacaacaaagttaaccctaagttagtacatcccagaatctgctggatgtataataatttagtaacggggtatatggcagagctttctttgatgttaacaaattttggctgtgattcttagttaccaagttgccaaaaaatggtatattaaatgaactgccaaatggcagattaagaaaattaatgtactccaatggtctgtccatgaaaggaaaatgtacacagacaaattaagaacattttaccaggatctgagatttaaacaatggaacaattgttttaactgttagaatgaccccaactgttaagtttgtctatgagtgtatatgtatatataaattcatacacatatattatttatttccttcttaaaaagactgaggcagttctgctatatatagttagctacaatattcaagataaaacagttcctactcaaaaaattacatgaacacacgagataagttcttatcgtaaatgctatcatgaggctatctagtatagctcatatttcctggttgtaaggctcaaaacacaggaattccactccaagagataatttgcccctcaatccctacaaagtgtagtctaaacaaacaaaatggtaataaaaaattgaaaaggaagatataaaaagaactcaatagcaggattctgactacctctggagaccacacactatcattattctgactgtcttaaatacaacaatccaatatgccccaagatggaaatctggtatcgtagggaaaacattggctgcaactgtcagaaaagttcataatcttaaacataatttatgccatttgccagtcacaaagacatttactgaacagaatttttgagccatttgtaaaattaaaatgattgatcaatttgaatagcaaccttcatgatgaagaaattaggactctaggtatgaaaagcatgttccttttttgttaataagttcaaaggagagaaacattctgatatatgcagataaaaatatggctaggctgggcgcggtggctcatgcctgtaatcccagcactttgggaagccgaggtggacagatcacgaggtcaggagatcgagaccatcctggccaacacggtgaaaccccgtctctactaaaaatacaaaaaattagccgagtgtggtggtgggcgcctgtagtcccagctacttgggaggctgaggcagaagcatggcgtgaacccgggaggcggagcttgcagtgaaccaagatcgcaccactgcactccaggttgggcaacagagcgagactccctctcaaaaaaaaaaaaaaaaaacaaaaaacaaggctaacaagaaagaggataaccagcaagtaccacctggatgtgtgttgtcaggtagaaaggaagaataaaattcaggcaatgaatataatagatttagcaaagtaaagcatatgaaaggaagaaatgtttgatatgtctaagtatcaatgccttcgatcagagtaagaaaaaagtattcattgttcatgtccacagactagatatctaaagagatacttggtgggcaggggcttgggagggaaggcgcaaattggaatgttcagcttttaaagtaaagactgtacatgaagacatattttatgtacagtgaagattgtcttgtgttactttatatcccaacataaacctacgccaccctcagacgaagagggtatctaacactgaataaatgctgaacctatttagtagttaaagaaaaaagagaaggatcttaaaggtatatatgggaagcttttaagaggtagagaaaccaactgggtatatattttcttttatttgatttcaactagcaagagactaagactgatgtttgtttgtttgttttaccttcaaagtcttagtcttaaattgacaagggcacaaaaaaagtgaaattaaaataattttaacaaaagggaaagcatttgacagtgtttaaaagacagacaaatcaagcaaaactcaatgtggcttaaggtaaaaaatacaactaggtattaaacaatttgtaaaaacttacaaagaaaatttagctttcaagaaaaattaggcagatttccttctgccaaagtgacaggtcctgaggaaaaaaaacacaacctctacaagaccaagcacagctcaagggtcagggccccgtcctagtcatctttttattattcaatatccatcacagtggctgggcaaacaacaggcatcaataaatgtttactaactgaatgtgtattataaggtataatcggtataactgatatagctcaaatctaatcatgaaagcttctttaaagtaggataaaaagagcacaatcagcggtattccagaaggtaggcctaaatccagttatatttttctaatcgttgaccagtggttataaagactttctgagcttctttttaaagcaatgaaactctttccaaaagaaaccccatgcagttcttcagtacagaataaatatgccactaagtcagtgagaactccaacagcctcccctaagccagcccccaaggtgtctctgtggaacctactggaaaaaatattactcatcttagaaatgtgatagaaagcatggccattcggttctcaggtcatcattcctagaaaattaacagtattgtgaagaataaatcctaagtaatgttgctaatttaaataaagacaaaaattcaacaaagaggggattctatcacttagaaaaatgaaaaccacacctataaatggggggaggggcagaaaacaaaaaaaaaatcaggccacagtagataaaatacaaaaaacatcatctcgttaaaaagcatcaaacacattcacacaaatgtaattacaaccaggaagtaaactgctcaacaggtataactgctcaataggtgttttcaaagagttgagtcccaatttcatactgtacagaaaaatcgcatcagaactgtagagatgcgctccactactgaaacagcatagtaggcactgcttgacctaacacagtaatgcaagagtaaccaccaagatcaggaccttctaccactttcagagttgttttctgcccctacaactgttccctaacaccattacaagttctcaagtaagaaaaagaagggcagaggctccactgagtatctcctacaggcctgatagtggtattacctaggacatttactctgctcacaagatgggtagtggaagacataattactggacagcacaaagtctggaagcaagcagcagggcactaaaacagtgagagcttacacaacaaaagcttgttaaattaagtagtactgatgtggtgcaaatgaaatttttacagcaaaggttgaggaaggagatatgttagtgagaatcacatgaagcagactatcacaaaataaggccaccttcaaaatgttatgaactgtagaaccattctgatcttcaagtttggatttgtatagaggtttctgtataaagcattaatacctaatcaggagtttcctttagtgtgaacctttttgcatttgatgctattctctttgccaggaatgcttatctcccctggctcctcacttggcttgcttctttaatgtcaggtgttagctcatgcatcctttccttagaggctttccttgatgtcctacctgaagcatcccatctgttattctccagtacagtaccctgtttatctccttcatagacaagtaagataattaagggttagtgtaactgctgtctcagcaaaggcaggaactgtagttgtcttgttcacctttacccaaagactaagaaaagttcctggtacaaacaggtgaacaataaatatttgttgaatgaataaaaaattactataccaaatttacatgaacacatacatatacacacaaatataggaaaatggggagtacccaatagaaaaccaccaaatgttgaaagtattgaaaatgatacctatagagacaggtggatatgatttcaaagaacaagtaccaaagacagcttcaaaaatatgaaaatttatgaaaagacgaccaggagtggttattttccatttctactaagatgcaaacaagaagaaatgtttaaactgcaatgagtcaacatcagacataataattatttgctgcagaatgaactagcaacagagtttcggaaatctcctctcactacagagcatgaaatattgtcaatcacaaaaccaggatcagttaagaacagctcagactgcaggtaacttataagctaaaaaacttgctaaataaatggcttttcccccaatttttaaaattctgaattcataattatgtgtagaataacaatcaatttataaactgaatacaacatactttaaaaacagatggcccatatctgctgatcctacctcagcatcacttttctaggtattttgcagaaacaattacatttacaaaaggcccatttcataatgcaatctggttactaaaccaaatcaaactactcgaagagcagaaggtctgctgttgaaatattgtaaaatacctttggaaaaacggtatttatagattagcttttttaaaaagggataaatatgtggaagtaattctagcatatccctgaaaataattatactgccacctatgcattttttatgaggtggaaggataaatcaacagactgctagattatacaagccaattattcctgttgaaatttgggcataagacaaagggactttctccatatgaattcttactgtatcccagaattaactggtgccagcagtatcaatgcaactattactggtgatgatgtcatgttatgctgttttgattatgaggacaaaaatgggaatggaaaaaagaggcttggaaaggttttcagtatggtttccttataataagatttagcagttaaaaaaaaaaacaaaaaaaaacaaaaaaccacaaaaagaatgactgtttaagccccactgaacacattaaggtcaaggatttcaaaagttaatccacttttcttcccccaagagtttatttttggtaaaaggcagaaaaattagtttttctacaggaaaatctgcttctaaataatttgaaaatcttgatatatattatatattaaaaaagacacacaaaaataacagagaagtgggaataacagattaggtactgcaactttataaaggtttgcctagatcaagaagcagcgcacacacacacctcatctatgcaaactaaaaatgtatataaacagcacaatactgtgatactggatcatgatacattacctgtacacataactactactgttattaataaacctttgggacactcagttttatgcccaataagacatcattaagtctttaaaatcttctcttcctctttaatgggagagtatttctagacactaattttcccatctaatattcaaatataggaaacagattccacaaggtgctttaattgatgagacctcaagtgctgttttctctcttgaacttttggatagtaaacagtccatagggaccacacacaatgctatgacagaagagttgttacattaagtcttttcatgggacttgattggtgaagctttatgacatgcttgagcaacgcactgaaggggatcccatctgagttaatactttgtccaaccactgtagaggtccattcagatgaagttcaatccagcaaggagtacttgttaccgtctgccttctgtttaaaagaatacaggaaaatgattatgaaattcaagtccacaggcagggaaaatggctatgtttaggtacactgcattaaaaatttacagaaattaaaaggttgtgtatataattttggacacgattattccgcaaaatggttgatcctcaaagtcaaagtacttctgatgaccttgttttagaagtgatttacaagaacatctttttctcatcgcactaaaattaataaggtgatcttattattcaccatcatccaaaatggaacacctgagagagaatgtagatactattaatatcaggccagggccaggcgtggtggctcacacctgtaagcccagcactttgggaggccgaggcaggcggatcacaaggtcaagagattgagaccatcctggccaacatggtgaaaccccgtctctactaaaaatataaaaattagctgggcgtggtggcgtgtgcctgtagtcccagctactcgggaggctgagacaggagagtcacttgaacccaagaggcagaggctgcagtgagccgagatcatgccactgcactctagcctggcgacagagtgagactctgtctcggggtggggggcagaaaaaaatcaggccaaaaggagacacgtgaatcaggattgtccaagcaaaccaagacataaagtaactgtacttaccaaatcaaccacagaatagtagatactcaaatatcaaacagaatctaagtaaaagtataccaaagcaaaaacaaaattttggcccaagctaaacccacaccacagagagtgttaaaagctggaattcaactttccctgccaaagccaatgaacatccctcttagcaacaccattcgggcttttaatagtgcttcaacaaaaggggcaactctaagagaattacaaattattcaatgacatcctgtcacttccatgcgctgattttagttccatcttatttgctatacagaataaagtcaataaatccacttgcttctacaaactaacagcccttcaaatatgagaaaagcccattatcaactcttcatctccaagcaacacatgttcaatgtaatttaaaactgtacttccaaggatgtcactttctgaggcagatggtatcagtgccccactgtaccctttggatttttcagtgtgctctagacaacttccaactgcaggtatctgcatttctgtgcccaggaacttctctgatatacccaaaaaggctagaggtgccaggaaagaagcatccccaggagcagccctcaaccaaggaaacagaaattgacatttacatgcccagcacttctgttcccctgggtaggataattctgtagactgtttactgtttcctagagtttccccaagggtgtcagttctagtgacccacccactctggtagatggcttaacaatggtcctggctgccctgttctcccctgtcccacttccctttctagaataatccataatccaggtcacccaaggggagtaggtttaagaaggctgccactcgattaaatacaaattcttcatacatctaaatttcctgtttactacatttcctcatttttgtgctaacaaccaagatgacattaaggaaatttaaaaaaaatagttttagaaacctaaacattaggtctatttcctcagctccagaatgattacagacagtaagttcctggtagctacccacatatccacagatagatggatatttgccattttgatttgtaaatgttacaggaaactacttgattttccaaagtcagatgtacctgactcccaatactcataaaaacatactgcatattactgcttctgtaattacagattttactttatctgtgagttaaagaacagcagagtccacagtgaatgaagaagggcagtatctttaccaagtaaaactgttcttagcagatctatagatacacatggaattctctctgtaattcactcttacttccactaaattcctaccatattttgcattattctaaccttctgaagaacaaaaaaaagtctgacctgaaatcttattagacaatataatttaaatctaattttgctatcaactcaggtcaagtctaattttaaaaaacggcattcagcattcttaacaggtaacaacatctcaaaagggtaataatcaaaacagaactacagcaaaatcacaaaatgaattattctaccaatataactcagaaaaaaatagtgacaagtcttcattctctgatacaaatatataccatatatttttaaatgtattcaacaagtagacctcacattgcacaatctcaaatcagatttctgacaaaacttaagatagacaagcaagtccaaaacaaataaatttggaagggactaaattgctggaagaagcaggaatacaatcactatattacatgaatatttcttaagcaggcatatggagtaagcaatacgaattgaagaaagactaagtattttacttaattcctactcttaaatatggtcaagaagtcttctctctctttgatgtgaaatccaatctattgtttaattcatcaataatctagactatcttatccactgatgacaaattagtttttgtaaaacttaaacataattgttactactatccttataaaagaggtaaagagtccaggagaactatcttccagtcccatctcaaccacttataatgtaaccttgggcaaattatcagctttctatgtctatttccaaatatgtattagtttgaaccatgtgttacctgcaacgatggcaatttcatatatttcaaccttacaaagaatgaattgacaacagaaataataatttttagatactacacttaaaacagcacagtgcctggcacattagcaagtattccttctacttctgaatgaagttcctcctcttaacctacatctagtttgtctcaatttaattgtccagccttatttttctattctccaaactgaattgctatgctattgtcaagattatcacttcccaactctgcccaccccatttatgactattgaaatccaatgcaccttttacaactagatcatgtgccatcaagttttccttgagcaccgtgtgcaaacatctctccttccataaactgacataacccttcatatacaccccttttatgatatttaacactctgaattacgttaaaatgcacgcctgtgcatgttttaatatcttccataatggcagctcagtaatttgcaacagttttgaatttggaggcctccaactttattttacataaagatcagctgactctataacctcattgaaaatagatacaaatgaactccagaatatgcaagaatgcaatgaaacataattacactgtggaaatttaagaaccaaatatgtatttcataccggtattctgctccccaccctttcacaaaactcattcttatggtgcacattctagttagctgatagacggcttcaaaaccctgattaacagactgagccagaagagcagcaaattcctggttgttgaagatcttcagattacagcctatgattaaaaaaggtaaaagaaattgtcaaaagagtatcattattaaaaagtaattttaaaagggttacaagttttagaatatgagcatgcaatcatctactgattcctaaaattagcaacaagaaaaactaagcaagttgacatgataggtttatgtacattattgaatccatacctggtggaattttacacactgttgcagggtgccagccatatctctgattacaattggggctctgcacaaagattgcactatcacttaggcactcagcaaaaacttccccacctatgtagtataagcgcactcctcttcctgaaacaaaatacaaatgagattagttttgtaacatttactatttcagtgtgactttggaagcattttcttggaaaaattctaaaatgatataaggtatttccaggatctttttcacagataatgtctttctgaagtctaactttaaatatactactgtatatttctcccaagtattttctaacaataattttattgattttaaaatacatgtgtactgactgaaagtatttaaacaatgtagaaaaagtacacatagtaaaatagtttcatacaaatgatatatattaagataagtaaaagattgagttaattttgaaggaattcactaatgtttggagaaatatatcttcattacaactgtagtttcttagagatcccacttaatgttaagaaaaaagatgtaaaaacatcaaaaagtcatttgccattttaaaaactatatattatggtggaaacccaacctctagatgtataagcatgattaggtgagaaaaaattctactgggagatttttaatatacttctttcagaatctgagagatcacagatgcaaaataatatgagatataagaattaaaaaaaaaattgtgagaagcagagttctaacatgacacctaagagtctcagccctgaggtgcacatacattctctgttaatcaaacactaggtgctgctgttaaggattttttcagatgtaattaaggcagcaaatcagttaaccttaatcaggcaatcctttaaaagggactagactgtcataggctaagtgattcaaagcatgaaaggtattcaacacaagagacattctccattgctgactttgaagatggatggcaccatgtgacaaggaattcaggaggcatctaggagctgaattctgccacaaccatgtgggtttagaagaggacctcaagctccagataagaacacaagccagctgatacctcaattttggccttgttaaaccctgaaaagaccgcctaacccatgtctggactcctgacccacagaaaccgtgaggtaaaaaactgatgttttaggccactgagtttgtggtaatttgttacacagcaaaagaaaactaatcaaacaactaacactccagatttaatacagaacctggtacggtggttctgttaagactatggaatatctgtaaaacagtcatgcacgtggtcattgggaaaacactaagtccaaaaagtagagatttttcaggctatattccctgatcaatatcacctataaaactagaaataaaaaatttaaaaaaatccaataacgacagcaatctaaaactttggagggagaagagaataaggcagagaaaacccattaaatttttttgcagaaccccaattaagtcacaaaaacaaaaaactattttagttaaagcacctacagcgacactgggtatcttaataagattatccaaatttatacatcaagcaagatttgagaacttccacttggaaccaagtaatagatcttctagtcactatcattttgcagtatcaaaatcacactttgataaccagcattacttctcacaggaggtaatggttaattagaaaaaaaacagaagcaaactactgttaaaagaagttactttaaggtgatgagaatgatgttcaattatgaatggttctcacactttttcacttcatcgttaaggaaatactgaggaccccaaagagcttttgtttatgtgaatattatggaaaatgaccatattagatataaaaactgagatttaaaaaattcatttaaaaatcaaatccattacatattaacaatgtttataaaaaacaactgtatttccaaagcaaaaaaaaaaaaaatagagtggcaacatttcaccatttttgtctatgaaaaacaactatatttccaaagcaaaaaaaaaaaaaaaaaaaaatagagtggcaacatttcaacattcatgtctagtgtaacagaattggagtctcattatcaaatctacatttcatctcttgcaaaatcatatgcatgtaggctctggaatactccactgtacagtcatgagagtatgagagtagaaatggcaaacagcatctcagtactactatgaaaatagctttgacctcacaaactagctgaaagggtttctgggactaccagaagtccccagaccacattttgagatgtccctgaattatattttgaactatattaaatgcagttcttgttttagatatctcatttcagatgaacagcaagcagatttcatttaatatataaactcaccaaagggggaaaaaacctgggagctatataaagaaactgaaaaaaaacaaaaacaaaacaaaacaaaaaaacatgatttataaaaaagtattaacccccaaatctgaacatggcaattttatgactggtagagactcagcaaattaaacttatcttaacacatatttattgaagaactttccagtaccaagggtgccaaataaaagttgaagagtttgcagctgaagcatcaccaggatctattagaagcagtgaagcctgtgcacttaaatgtgtcggcacttaaaccaccagagagaaagctggttttactgcacacaagctcttgatgtggcacaccatgcaatgcctacattatgagtatacagcatttatttttcacaacaaggaaaataaaacatacctatatgccttcttgtcatttctaccgtggcatttcggttaacattggagagtaaacctaagcagaacctctctgaatttgatgggtctgtaaagccatctacagtgagtgagggctgtgatgcatggaaggtttctccaaccctctgatttaattcataatatgctatcgaacaccaaaatgcaggttctgagtaagtaactggctgtaaatctgaaaaagaaaaaaataaaaaaataataaaaggaagaaatgcgtgaacaattcaagccaaaaatagatttaatataatcatctttacatgctctatgccagcctgcactggcaaaagctcaggaagtagacatagtatctgtatcggtttccacagatgataccagattttcagtatttttcacacaaaactccagtttcatagatcataccagattttttcaaatttctcccatgtcattaaatcactttatgttggattctttgttttaccagtagttttagtctagctcctgttcaaatacaaaacaatcataggcaaagtcagtcaacttgccatacttggtgcatttctaaagcacataaaaaagctaaagtggggtaagataaagccagagcaaagattaatgagtcaaaagccacacaaagaaaaacagtaataataaaaggatacaaaatatgacatatttttgacatttgtctattttaacatcaaactcttggtgagataccctagctacaaaaagagaaaacccactcatacataagaaccagaaagcagtaacacacaaagatcatgcaagtagaaacagaccatagagtcaaaagactacttatttcactggaaaactatatatttagcttctgcagtttgactaaaacatatcataaggaatactgcaaaagaaaaaaacctcacaattttgtagaataaattccaaacatgtaacaaccgaagagaaattgtgaaatagggtaaaatgagggcaaaaataataatagtaatacagaaatgtatgtatatatatatatatatatatagtcatcccttggcatttacaggggattggttctaggaccggctccccctaactaaaaacccttagatgttcaagtccctgacataaaagggtgtagtatttccatgtaacttaaattcacgtcatcctgtatactttaaataatctctagattacttataatacctaataatataaatgctatacaaatatttgttatactgtattttaaaatttgggcccagcacgatggctcacgcctgtaatcccagcactttaggaggtcaaggtgggtgattcgtttgaggccaggagtttgagaccagcctgggcaacatagtgaaaccccatctctactaaaaatacaaaaattagctgggtgtggtggcatgcacctgtagtcccagctactcaggaggctgaggcagagaattgcttgaacccaggaggcagaggttgcagtgagccgagattgcgccactgcactctagcctgggcgacagagcaagactctgtctcaaaaaataaataaaaataaatacaatttgtattagtttttactgtcgtattgttattttcattttttcccgattattttcaatctgcagttggttgaatctgcagatgctgaactcatggttatgaagggaccatacacatacacatttgtacatatatgtgcacactctcatatatatattatatatagtatatatatattattatatatatgtataatatatattatatattatatattatatatattatgtataatatatattatatattatatatattatgtataatatatattatgtatgttatatacatattatgtataatatatgttatatatattatacataatatgtataatatatattatatatattatataatatatattatatattatgtataatatatataatatattatatatattatgtataatatatattatatattatacataatatatattatatattatatattatgtataatatatgttatatatataatatatattatgtataatatatgttatatatataatatatattatgtataatatatattatatattatatatatattatatatattatgtataatatatattatatattatatatatattatatatattatgtataatatatattatatactatatatatattatatatataatgtataatatatattatatactatatatatattatatatattatgtataatatatattatatattatatatatattatatacattatgtataatatatattatatattatatatattatgtataatatattatatattatatatattatgtatattatatattatatatattatatatattatgtataatatatataaatccccatactacgtatacatgtatacatatttatgtcaatgtgtatatatgtaatacacataccttttattaattacatcataaaataaacataaccataaaaatctagccataacaggttatataattttctatgaggaatatgatttcaataataaatagattatacctatttcttatatgtgccagcagaaaagacttaataattttgagggatggtgtcaatattctttttaaaaagcactactttaaccacatacataattatttggctattcattaggatccctttctcggatatataaaaaataactcctagagatgatttttattattaagtaggtgatacagtataaaaatgatgaggggaacatatgtgcaacttacccaagctatgattaacaggggaaagagtagtaggagatagttctgctggagagcctaaaacaaaaggatttaaaaataaatgaagtatttccagaacttctgatcaagtaatcataaaactagctttatctggttataattatcaacaataatacaaagataatttaaataccaagaattcagaatatgtaagtgcttaaatttagtttaatttgtggggggtcgggggaagagaagggggggttccagtataaaaggtgcaacagttttggcttctagcccaacagttcatcttcccaaagatatctaatattgacggttccttgggtatctttccaaaatactctatgaaccacataagcaaatacatttttgttctgtgtcctttcttttcatatacaagtggtaaccgtttttcatcttctatattattctatcagattgttcacaatgtgtttccttatttgtctatctacatatcaattagtcacataacatcgcgatcccacattgatggatattcaagctattttcaatcttttgctataagaaccaatgctttgagattgcaataactaatcttgaccgttttgcacgcttccaatcacatctgaaagatacattcttcaagaaactgccaggtcgaaaggtttgtgtatttgcaattttgatagatttgggtaaaattatcattcatcaaggttgtaccagtttacattcccagtcacaacatagtaaagggatgcttgaggtgttattgcttctagatgaaaacatggtcacaagtacagttttaattttgagtagctttacacatgtttatattatatttccttcctgtgatagtctgttcttttcttttgcgatgttgatcattttcttactgattgtttgaaagctctttatgtgtattagggatgtaagtcttcttatggtatgagctacaaatatttaatcattggtcttttgactcttaatcctaattttgatcatgtagcactaaaataaaagcccttctacaagatttatcaatcatctttgggttagcgtcacactttgggataaaacagtgatgacggtggatatcttactcttgacttttagggtaatgtttctaccattttcccattaagcatggcattggctttcaggctaacagtaataaaatatttatttaggatttttgcatcaatagtctcaagcaatacaagcctgaagatttacatgagtgctatgtttgtaaggctctgtggtcaatgttatgacaatctagcagctttatcctctgcaaaggtttaaatagtattataacagcatattctttaaaagtttggtagaattcttctgtgaaattatagttagtaactttctagggtttactacgagacattattctatgaagggtgacttgttcagatagctctattttctggagtcagttctggtaaattacactttcttagaaaatgatctgtttcttcttttgggtaaacaggctaaatctaatcaagaaaataagggggcacaaacatacaaaataagaaccaccacagacaacatatgaaaaatcatggcgcaactagtctgctcagttccatgcaactcaattttaaaacacatttgctataaacattgttaaataatcttattaaaaatataaaatatattttcttttatgatcatcattctctacacgtttaggcacagttacctaaaagagcatgacccaagcttcaaatgtataccaagagcataattgtagaataagataggtcaggctgggcatggtggctcatgcctgtaatcccagcactttgggagactgaggtgggtggatcacgaggtcaggagttagagaccagcctggccaacatagtgaaaccccatctctactgaaaacacaaaacttagtcgggcatggtggcatacacctgtaatcccagctactcggaaggctaaggcagaagaatggccgtagtatacccctggtcgtgtagcagtgaaagtggtttggtttagacgtccgggaattgcatctgtttttaagcctaatgtggggacagctcatgagtgtaagacgtcttgtgatgtaattattatacgaatgggggcttcaaccgggagtactactcgattgtcaaagtcaaggagtcgcaggtcgcctcgcttgaatccaggaggcggaggttgcagtgagctgagggcatcccactgcactccagcctgggcgacagagcaagactctgtctcgagagggaaaaaaaaaaaagagtaagataggtcagaccatcttacacacctcctccctaccacacactattataaccatgacataaaataccaggcaataaaggtgaaatggtagcccctagataaataaatgaatcagagaagggatgcttagtttttagaagacagtacggtcttccacaacataattaagttatgttccttttttctcagtttgaaaaatctgctggcaagtcacaaatctgctggcaagtcacaaatctgctggcaagtcacaacaggtacaactaagataggtcaaaacatatttggaacaatgagctaaaattcactgctgtttcctgaaaccaacataaaataaacaaagccactattagaaatggaggaaactgcccaactattcatatcttttaactgtttactcctctattaaatacttagaaatgaccagtaggatcatttaaattaacaggcgttcagtcagatgtgacaggttagaattacagattacaaaaaagacaaattttaaaaacttaaaataagctaacaattaatagaagcctttaaaaaaaaaaaaaccagaggcaacgaactgatgattagcctatgaattattcatacataaatgctgctattggagtctcacctaccacaggtcttccacttagaatattataaatatcctatttgagatccagtgtgaattagcagtgtctacttacagctaaaccatctacagaaatccctgtgcatgtatcttcgcatacaaattcacatatatttgtaggatacattcgtcaaacctttgacaaattaacaaatgtcaaataaaatgtgttaaacttttataagtgccaaaataccctctcaaaaatgtttcatctcactaagaatttataagctagtgtttcttcacaccgtgtcactacatgttgacatctgccaatatgataggtttaaaaggagcaattttttaatttcttgtttttgttgtaaacagtgtatttctgttcttttagccaattctattaactatctttttcttcttgatttgtaagtttttaaacttaaaaatcagttcttagacttgtcatctatttgcaaatattcacccaggtttttttttaaaaaaaatctgttatatcttttaaggtgacattaaattgttttaatttaaaaaagactttttttttagagtagtttcaagatcacagcaaaactgaacagaaagtacaaaaagctcccatatgacccctgccctgcttccccaaattccctataacatccgcaaaccacaatggtccatttgttataataatgaacctacactgatacatcattatcactgaaagtccataatttacattagggctatgttatacattctctgggttttgacaaatgtataatgacgtgtatccatttacagtttcaaacagagtagtttcactgccctaaaaatgccctgtgctccacctagtcctctttacctcccacaaagcctcagtaaccacttatctttctactgcttccatagttctgccttctccagaatgtcatatatagtaagtcttcatttaacatcttccataggtttttggaaactgacttaagcaaaataattgtacaacaaaaccaacattccccaatcatcaacactgtaacgaaatgacattattacttgaggacctgttgtacattaattggatatatcagtttatttatctagtcacctattaaaacatcttggttgcttccaagttttggaaattataaataaagctgctatgaacatcaatctgcaggtttttgtgtagacctaagttttcaattcatttgggtaaataccaaggagaagcaagactgctaaaccatatggtaagaatatagttagttttgtgagaaatcaccaaactgtcttccaaagtggctataccatttttcattctgaccagtaataaatgagtgtgcctgttgctccccatcctcaccacaccagcactgatgaactccctcagcttttgtctgaaaaattttttatttctccttcatttctgaaggacagctttactggttatagtattcttggttggcaggggtacttttttctttttttcagatggggtctcactctgtcacccaggttggagggcagtgtcacaatcttggctcactacaacctccacctcctaggctcaagcaattttctcaccttggcctcctgagtagctgggaccacaggtgtgtaccaacacacccggctaatttcagttttgttttttaattctttcagcactttaaatacaccacccatctctcctggcctgcaaactttctgctgaaaaagctgattgtctaatgaagactcccttgttatgtggcacgttgcttttactcttgctgcttttattcacaatagcaaagatacagaagacaacccaagtgtcccatcaacagatgaataaataaagaaatggagggttatacacacaattgaatgttatcctgccttaaaaagggagatcctaccacttttggcatggatgaatctggaagacattatgccaaggaaattaggtggacatagaaagacacatggcataatctcatatgtggggttttttttttttaagccaaatacatagaaacataataaaatggtgattacaggttggggggaaaatagggagattataggtcaaagggtataaagttgcagatatgtaagatatgcccagagatctaatgtacaacctgaggactacagttacaatattgtgttgtatactggaaatttagtaagtcaattttaggtgctcttatcacacacataaaaaggtgactatgtgagatgatggatttagttgactacagcaaccatttcactacatacaccaaatatcatgttatataccttaaacatatacaataaaaatgtatgctttaaaaagtctaatttactgaatacagactaaagtgttcacaaaccttccagaaaactgggaatcatcctgggttgcttcttcaaccttaacccaaatatgatcactagtcatattctaagcctcagcaatatgtatcaaaagcacccacttctcccccatgtcacctaaaaccagccagacatatagtgtaataaacaagaacaggaactctagaatctgacatcctactgaatttctctgtcattttctagctattttttaatgaggttcattacagcattgttttttaatttctggtaaaagttgaaccttttaaaattttaattttttgctagatgcaattacatataatgcttaagttttcctattttgcctaactatgctaatttttttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgactatgctaattttttataatgaacatccatttgttgtataatttgaaatgctgtatcataatcttatgtgtagaacactgtttaacttttatctgacacagaataatggtagaaataagagattaagcttccctgccaaagtgatacaacattataatcatcaaattcagcttatgaaatatataatgcatgaatgatcattttttcatttcttgttttaaaaaacttaatccccagtgcgatagcatcttaggttttacatatttccaatttttctatgagagcataattctgttcataatgagaaaaaaggctgcttttgtttttattagaaactcctacagagttccccttatagttagtatgtagaagattggggaaaacctttgcttctgaaatagcagtaagaaaacagtggataaacaaagaaaaattctatttttctttaaagttatcacacagatatagatccaaataagtccataggaactaatttacagagagggatgagctcctccccagttaacagagagtggtaatcactttcactactgacagcatctgccaagtcaggacacagacaaaggactgagcttgccaaaggagaagccaactaaaatttcaatggccatgcacagacgacaggaatcgaagaagctgcaagcacagagctcctcttcaccagtcagttttaatacatgtctttagctgagtacatgttagcataggaagtcctgggcaaggctggaaagaaataagaatatgcagtcttgccatatttgtatctgaaagttctgataaggtagggaactgaccctccctgaaacctgagtgatgtgacattaaagcaccaaattatcacctttccaactcaaatcctaagggcagggaaaggatcagctcctcaacttggcaaatagagaaaagagttggtctttccaaagaaagtgttatctattttaatctctaatattattatatatacaacacccactatccaattaaaaaacaagagatattcaaagatggagggggaaaaaaatgaccccataatcaagagataaaacagtcaacaaaagcaggccatgttacatattaactggacacaaattatcgaagactttaaaatggaaattatatagctaaaaaataaaggatctgaaatgaaaaattcatttaattggattaagagcagactcaaagtcagggtcacatacatattatcacttgattttcaacaaaggagccaatgtaaatcaatggagaaaggaatgtctctgcaaaatggtgctaaaacaactgaaagaaatgtctgtagtaaaggaataaaaagcagcaaaaaggagccaaactggtaaatatgtaggtgaatataaaatacttctttttatcccttctaatttcctttaaaaatcaacttgatatcaaaagcaaaaaataacactgaactttggggtttatatatttttattaagtaaaatacatgtcaataatagtacaaacaacagaagtagatgaatgaaactagagtggtgtaaagttcttaaattttacatgacgttgtaaaatattacaacttaaataaacttctaggtataacataagtacaatgtaatcacgagaatgccaactgagaaaataatactaagtgttactggtaaaaggccaagagagtaaacagaatgaaacaaaaattatttgattagtctaaaaggcaggaaaacaaacagataaaaaccagagagaacaaatagacaaacaattgcaaaatggtagcctaaagccagtatcaataatccctctaaatataagcggactaaattttccaactaaaagacaaaaattgttagattaaataaaaccaaaaatatgctgtccacaagaaacacaccataaatataaagattcggatagactgaaacaattaaaaatatatcatgtaaccagaggtaagaaagaagatatggtgatgttaatatgaaatgcattttataattagggcaaattaatttggaagatgtataattccaaatgtgtatcatctaataacagaggttaaagacacacgaagcaaaaactgacaggactaaaggcacaaacagatgactctaaaatcagagctgaaaattttaacacttatcataactgacaaaataaggagattttaaaaaatcataaagaattaagaagatgtaaacactatcaaccaccctgacctaaatgacatttggaacactatagtatatacattctttccaactatatatggaactcttatcaagataagttacaagttatagcataaaataattttcataaatttccaaggactaaagtcacacacactatatgctggactgttaacagaattaaattagaaattgatgaagtatctagaaaatcctcacactcctaagaaaaacccaaacttctaaataactcatgaatcaagaagaattagaaaataagtgataatttaaaaacaacataaaatttgtaatatagagctaacataaagcttagagggaaatttatagctttaaatgtgtacattataaacaaatcaatgatctaaatgtacaccacaggaggctagaaaagaccagattaaatgaaaagtaagcagacaaaaagatgaatacaaacaaaacagaaaagagacaaagacaacaaagactactgattaatccattacaagacattctaataaaaaattaaaaagtcaaattactaacattataaattttaaaatggatctcacatatatgaaaggaataacaaatatcagaaataactttatatcaatacattctccagccttggcaacctggtgaaatcctatctctaaataaaacacaaaaattagccaggtgcagtagcatgtacctgtggtcccagcttctcgagaggctaaagtggggaagattgcctgagcctgggaggttgaggctgccgtgagccaaccaggccactgcactccagcctgggcaacgaagtgagatcctgtctcaattaatcaatcctatgacttaaatgaaatgaacacatttctaacaaaatccaagtttatcaaacacatacacaaaattaaaaatgtaaataattctcaatttaaaaaaccttttcctacaagagatggtttctctggaaaaatcaaactttgttttgaatacaaggtctcgctgttgcccaggctggagtgcagcggcgcaaacatggctcaatgcaacctccacctcctgggctcaagtgaccctcccaccttagcctcttaagtagctgggaccacaggtgaatgccactacccctggctaatttaaaaaaaaaaaaatttttttttgtagagacggggtcttgctttgttgcctaggttggtcttgacctcctgtgctcaagcaattctccagcattggcctcctaaaatgctaggattacaggcaagaactaccatgcccagccctatcaaaaatttaagaaagaaataatgccaaccttaaagaaactcttcgagaaaacaggagaaagccctttccaacacattttatgatattaaaactaataaacacattacaagggaaaaaaccctacagaccaatctctcataaacatagatggaaaaattctcaaaaataaaacaattcaaatccatgaaactatatgatcctctttataaacgcagaaaaaaaatttgacaaaattcaacagccatttataaaacacaattagaacattaagaacaaaaaggaaaaagaacttcctcaatcagatacaatctccaaaatatccacaattaacatcatacttaaagggggaattgtgaaatgtgttcttcctataatcagaacaatgcaaaaatgtccattcttatagcttcaacagtttattgtaggtcttagttaggacagaaaaagaaaaaagcatgaagactggggaaaaaaagaaaaactgtcagccgggcacagtggctcacggctgtaatcccagcactttgggaggccgaggcgggtggatcacctgaggttgggagttcgagaccagcctgaccaacgtggagaaactccgtctctactaaaatacgaaaaataagctgggcgtggtagtgcatgcctgtaaacccagctactcaggaggttcaggttacagtgagctgagatcatgccattgcactctagcctgggcaacaagagtgaaactccttctcaaaaaacaatcaaacaaaaaaaaactgtccttatcaacagatgacatggctgtgtatgcagaaaacctcaagaatctacagaattctagaaccaaaaagtcaatttaacaagaatgcaggagaaaagaatatacaaaaatcaagtatttcccatatcctaggaacaactggaaaataaaatgtaaaaacaaaaacgtataacagcactaaaagtataaaatactaaaaaatttatctaatgaaagacatgctatacatctacatcaaaaactgtttaacacatggcagagaaaaggcattgttataagactattatcctgaagttgtcaaacctgacccctcatttttgacaaaaatcttactttcctattttatagagctgatcctaaaccacaaaaatcaagtgcttctgtgtctggatctcaattcttcactttccttcacatctttgtgcaatccactatcttcctttttcttaatggttaactcctcttaacattttaactaccttcatacagtgcttattacaggttagaacacatagatgccttataaatatcagtcctattaatactctatgagttaaatgctattattgtccctattttacagatttaaaaactaggttacctagctagcatatgtaagaggaacatttcaaactcagatagtctagctcagagtctcactatgctattttgattatatgcatttagttaagaggagtaagtcttgtaagtggagtgtatgggaaaactgtctaggagtacaaaaaactagtagtttacaagaagaaaaaattaaaatgtattttctatttatttaatctcatccttcaatttctaatttttgtatatatttttaaatgtacttgaagtacctgtatataacttacaaataattaagtgtacatattagtaggatactctcaaaatcttaatactcactgtattagcttcctagggcttgctctaacaaaataccacaaactgggtggcttaaaacaacagaaatttattttttcagagctttgaaggacctaagtcccaagacaaggtgtcagcaaagccatgctctctcaaaggctcaaggggagaatctgttccatgcctttctcttaagcttttgggtttcccaacaatcctaggaattgctcagcttgcaggtgctaactccagttacctgcctccatcttcatatagcacattcctccctatcttataaagacaccagtcatatagaattagggcccatcgtacttcagtatgacttcatcttaaacaactacatttacaaagatgctactcccaaacaaggccacattctgaggtattggaggttagcacctcattttatcttctgggacacaggcagattaaaaaaccctttaagtctctttgtgtatcttggaccaagcacagtgtatgtagaagatacaaaactgaattgtgagttatgaaatccacatcttatgatctattatattctatttctctatatacctgtttgaacaaatatgttcataaaaatcatgacttgaaaagggactgattatacaatactacaaaggttaatcgaacttataaatttcttacgatgtccagcctgatctctaatatccactataaaggaagaataaagtcttgaccagcaaaatctaaatcaaaaaaaaaaagaaaaaagtaacaagtgcttgttcgtacacttacttattatgcctaatttatcctctggttgcccttttaaaaaatttcaattcattatttttaacagcaggttatgaaagatgaatttaattatgtccttccttctggaaggtatgaaccagagttagagaggtggccaactttgttctaaattggagccctgcatcagtcagaattgtttcttgccatggccccaagagagaaactgatattgggtaagaggctggcagccaaactaactgttggcatctcatgaatcacatattcccattgccatacagtaatttttaaacctgtcattcagaaagccagtaacactgctccactgaaacagaaatattaggttgggttcaaagttagccccaacactgcaattattttagctggctgattcagcttattctccacttttgtactttgattcatttatcatacataacgaatacttgtattattgctcctcctgtgtttcagttatattgctgaataggtgtctgtgcactaaattagaatccctgcagccttttttttctggcttatttcacttaacatactgctttcaaggtccatccatgttgccacacgtcatgctatactgtcattcctttacatggttgaataattccattgcagaaacatacctcattttattcatccattcatcatttgatggacatctgagttgtttctaactttgaatattaagaataatgcctgcataaatggtcatgtacaagtttttgagtagacatgttttcagttcacttggatacatagctggccacaatatgttaactctgtatttaactttttgaggaacaggaaacttttccaaagtgttgaaccatttaacattcctactagcgatatatgaggactccaatttctccacatcctcaccaacatttgttattgtccttttttgattatagcatctagtaggtgtgaggtagtatctcactgtggtttatgacgttcagtatcttttcccatcattcacttttaaatgtcacagtaacagctgtccatcacaggcaaaaaagaatattattgcttcaagaagagtgtcatctaattttagtaaaacatatgtggaaagtcaaatattatttgcattaagatgtataacacgttatttccaacgttcattagattatctacctttcttagttatctggtactcctaaacacccaaatgtatgattagctacagcagaaacttctttacctgggagtccaaaaaaacggatttaaacaagagaattattgtaacccctccctcccccaccaatgttaatccacttaaaaataatttagattatcataaccaagaatgcattagtgttaagatgtggagaaagactgatggtataatttgtcaggttgtgatattaaggtgtccaacagttaagatacagacaggtaaaatgaatcaaactggacaattacaatgacatcaaagtgatttcactggtagtttattagttctgctgagttatacattttattacgtaagacgtgatttaaagctttaatttttttcttcatcactttttggagttgatagctaagcataagaaattaatctactataattcaaaactcactattaggttaaaaaagcagtgaaaagctgatccccatccttcacccccaaattcctctgaaaatctgttatttgagtaattatggttttttatcacagagagatacttagtcatagggttactaaaattttcaacagaagcaaatacttaaaaagaaataaaagtatgtgcatgttttcaaattttcatttactctaataaaaaataacaattattctgcagagtagcatacgttataatttttcagtgacaacatggacctctttggtagttcagatatgttaaatcaagatagaagatcatcttttttggtatgcgtctcaacttctctaaatttaagagtaacatcttttgtgaatttcaaacaatacaagaaatgtatatctaataactgaggaattttcaaagacattttttttacctgtgtccatactttgattcaactgttggtcacttgtttctccatcttcactgatatatccaggaggtggcgtttctacaaaagtttaaaacaaatcaagcacagctgcaacataatctcactaccttttctctcagctaccagagataaccaatgaatcactccaaataacaaataataatgttatataatattataaaaagtaatattgcatactgagggtgtataattcaggatcttgtccaaattttgcagtgaatccttaacatccacttttaataaaatcctactctctggacatacacattatgtacgtatcttgctcattcctatatgtacatattctggggcaagagccaaaaacgtaactttaaaaatgcctcagatctgaatcagtaggctgcaaaaccatcagtaactacaattttttgttgttgttgtttaatctaatgaacatcgttattttatgagtacttagaaaattaaaaaacacacaagattttggattataaaagtattaaataatacaggcttacaacttacactaagttctatagggtaaaatatggtagagtatggttccggattggtccaggctgaattctatctaaaaagtgtgtttctccaaggattcctaactggtaaagtctaagtgtttgaagcagaaaattcaattcaaatatagactactgtataaagaggtaaaatgctccctgaaaataaccattaggattctaatatattatttccaacatgttgtctgaataaaacacttatgttcagaaaggtatctgaatagctgaataaactgcatgtaaaataaaaacatgtatacaatttaatcaactgtaattccagggaggaaaaataagttcagaagactttcatcagttttacatttacactgaacagttttgagcgattcaagataacaaagacacatatccaaacaattttaaaattatcaaaagaacgaggccaggcgcggtggcttatgcctgtaatcccagcactttgggaggccgaggcaggcagatcacctgaggtggggagttcgagaccagcctgacaaacatggagaaaccccatctctactaaaaacacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaagaggaagagaagatacaggttaagggtctccttcaataaccttttacaatatctattcaataaactaaccacaaactttaagtatcaaacttttcatttaagtgtcagtacccccaaatttttaaaacaaaaattctaagaataaattatcttcatatactcaaagaacataaaaataagggtacatattatgcatattttaaaagttaaagctaataaagttaaacggcgctaagctttttgagtttaacctgtatttcaaagatctaatcagaaagaaatgctgaaccttaaaatacgttatcttactgtgtttattttttccattattgtaataaataataaagctattagcatttttgagaaaatgttaaaatttcttttaagtggaataaaatgtgaaccctttggttttgctgttgcttgaaaccggataaagccccactgtccagaaaagcaaatgggtataatccacttctgattttctactttataaaatactcaaatctcaataattaaaggaataaaaaagaaaggaaaaatgagcccaaacatcttcacaagtgaaagccactaaacattctggtgaatagccttccaaataattactggatatgcgtgttgtccctaagactgcatgtttatacctaaggttagtattgctggctgaataacagtaattcccacactaacgacttaaaatgcctccccttccccacaccaacgttcacacaactccactcccttttctacctagcaattgccctgtttcatagtcccgggttttccctcctcctagtgttatcatactacatcccaccctctccctctcttaacttcagtaagtttgtatttcctagcaacccataaagcagctttaaatcctcttctggaataaaacagtaatcaaagaaatatacattaaaacaatcaaaaaccacttcccatttgtaaaaccagctatttaaaaaaaaaacttatctttcttagttatcttttcttttttttcttccttacatttaaaaaattatcttcaatgaataagcattatttccatgatggatacatgaaagaaataattgtttaaatgtactaaaactgtattttaagaattttgtaaatgctcttaagttccttacatatttttagtgtataaaataagagtggaataaaagaatattacaaaaggaagaaagaaatcgagacactacagcttaatcctcatcctaacatcatgctgtttctgctagggagaaaaatcaaccaaacaaaaaggaaaacatacaagaaaagtaacaaagtattagttgttctccaaaaaaaaaaaaaagaaaccataaaaaacgaaaaggccagatatcatatcgtggagtattactggatcacataatacatcagaacaaaatttgagaaccatgtagctgaattcaattttcatcagaaattactgagatgcagacgaaacataattaaaggaggttttctgacgttcgtgttataatatgtaagtgttgctatgtctatagaactaagtattatatttcttatagaaatgttatatttctgttaaatattaccaagttatctaagaaaaagtgatcattgggtggatattcagttacatgtgtttggggggtacttttctcctacaccatttgttttgcttacattctgcatctcgcttagcttcaacaactaagacaaacttactaagatcttttcttttctgcttctcacagtactttgattaaagtcactgcaaaagaaaatgaaatataaagtaaaactcttctccaaacaaaactgtttaatgtactaggcttatacatttcacaaaataatcacccaacgaatccaatttttctattaaaaactcaaaagcatttttaaaaaagtgaaaccacaatttactaaaacttgaatgcttatgaacaaaatttgtatctatccaagttttaggagattcagaaggcaaaaatacctggaatataattactctgtggctcaattcctgctgggaagttagtgttttctggaatggagtgagtatagtcatccagaggcggaagttctgttaggatctcggtgtgtcggggcactaatactggaggcaaaactgaaaaagttcaagaaatccaagttaatggcaaagagcaaaggggagtgggggaaccttttttaaagttttcaacaagaagagaagttgtagcttaatttttaaagctagggtccacctactcgatatatactagttactgagaaaatgacaaatctgattatggctctaacttaggtagtctattatccaaatttccaagttctaatttatctcaaacttttgggaacaatgtgatcctggtaatattatattaccataaaagttcataaatccccattggaaaacttaacattgtctttatctgtaaaatcagatataggaaattttccaaaaacgcagctactgctatattttttaatagtttcaggtagacagctaactaaatgaaaagtcttgttacaagctttactaaacggtgtacatacaaatgatgtcattaaagtacttctaaaagcactccaagtgcaaaatgcttgaaaatgttactgcagcagggacatgtagaagcacatcagcatagcgctgagcagactgccaatctacaggatttcctggatatgcactttcatgccaaatcatatgctattccaagaaacagatatgttttctcattaaaaatttttaaaaataaaaaaattttaattaccaccaaataatatgcacaatttaaggtaatttattagaatttacactaaaattttcctgggtcacaagagtacttaaatatactgaagttcaggcatttaattcaaaaccaagaaaaaaacttgcaatattcctacctggtgtctcaactctctgatagtggtaagggtttacacatacttcatcctttttaagattaaaagcatattcgcagttttcaattgccttgagttcatgatgactgtgaagatcaggccagcgccataatcggcaatatataacatgtggcaatccttttcgatgggatacctggagacgaccatcaagagacctgttgggaagcaaggggaaaagaaaggagggaactttaaaaaaaaaaaaaaaaaagtgcagtcaaatgggctaaattagtacaataaaagcataaagaaaagaatgacagccatttagttagttttagtgagaatcaagaacaaaaatgtactatttaatggatctgataaaagtatgcagcagcactagcagatgtttcttataaatatgtcacataaatgactcaaatgccaatgaaaggctaacaacttgggaaaaactgattttttaaaaaagagagtttatgcagttatacttgaaaaactttgtcaacttctatgtttagtaaatcaaactcattttagagatgcttctaaggatattaattctggaggtgactgaagagtcagaaaaggaactagtgtgaagaatgataaataccaacaatgatgtgatagtaacttcctcagactactgcaactctttacccagttgtgactgttttgagaactgaggtatatttatgtagttcacaaataaatgtggatggtgatgaatatgatgagatgaaatgaacaaataccatatacgcaaaaaagaaaatgaagtgattaaaaaaagtaacataaaaatgagttaacctactgttaattgtgatataaggggttcattaagtatgtatttattagtataaagatgagattctgataacaagaaatttagcaaaactcatcatgtatctacttaaaaattaggccaacaacagattataatctgatctcaagctaaaataaatatatagttatcaaaattattattctttaggggatacagtaatttaaagaagattcaaactagaattgcattgattaaaacatcagctgaaacatttaatatattttttatactggcaagcagatattttaaatgctatgccttattttacattaaggaaacatcctaggcaaaattatactaagcaaccccatataggtctttcaaaatatacccccctcccacaagatctctaagattcgacagagggcagaatattcacctggtttgttcagagaagctgtaaaggcctgttgtatcccactgatctatcgtatttggtgtactcagtccccaaatttcagagcaagtgctgtgcataaattgaaaaacaaaaaattgatgtgaacatggaagcatggttattcaaaataccatgatgtaaaacatggagaatgtacagaatacttccttcacccagaaaatatacaattgcttcactttttcacaggcatgtagtgctggttactatattttctatatgaaggaagccaataaaatggaacatgtgactccagataagtcatgattatgtttttaaaatgtgaacaccaacgccctctagctcaatgaatcatacctataatgcccttaccactttcctgtattcaaaagatctaaaacctctgccatcagctttactaagtgcttcattttataatccagttttttaaaaaattatctaaaaacagatgtcaactgatttttaatatagaaaaaaatcccaataaaaatagacatgcatccacagttaagattttcaggttatctggtcatgatatttttaagttttactgaaaattattttgttctcatctctagaataaataaagaaatagactttgaagtcattctaatttagtataccaccttaaaaattttctcccacatttctctccagaatatgggcagctcagagataattctccctttttccctacctttatttcatttcatagtaacttctggtcagtgagagaagggaaagagagcttaaaaggaagttttggaatggaactttgacagccaatgtctcaagtactaagttgtacttttctgaaaagtccatttcttacatattacaaaatcatcaaaacttcaatgcggataaaggagtatttcaaaacatcttttgaaaatgaatcaagcaattgattaaatttcatatttacacattgttagtgagcttaactggatcaacagttcaaagggcaatggtgagaagcgctggcttcctgtggccaggcaacagaaccacctggcatccttggctttagtactacaggtgctgtcacatagctatcaggctgcaggaacacatcatgccctgctttgggggctacagtgacccgacagttcaaaacaaaacctgttctgaaattttccagcatctcattcaagtattttatagattctcttgctttttcaggctgcaaaatttaccagactataaaagccagaaaaagccaggtaaattaaggcttagacctttcccttttttccaaagatatactgatttaaaaaccatgacattaatggtttatttaaaagatattttcaaatatctattggaaacatatagcatgatgtagtttaaatcacaacagaatcacctcaattctacagacttctgagtctattaaagaaatggtatacaggagactattctttgaaaataattaacaaaagtgtagcacaagaggctattctgctctgtatcagaacatttcactcaagttattctgggactcacatgagaaccagaatctaaaatagagcatgaagtttacattgtactttatttaatccttgaaaggaatcagagaagaataaacagtaattgttaagaacttgcaatcaatctagaggcagacagatctagaccccaaccctaattcggccactttccaactgctgccatagggtatatttaagcctcagttccatcattatcatgcctaacaaaattggaaggtttattttaaaacattaaatttgcttctagctagtaaaatcattgcctgtttacataataaaaaatattttttaaaataagccaatttataataaaacatagagccctctgtatccaagggttccacatccttggattcaaccaaccgtggatcaaaaagtagaaaaaataagtaaatttttaaaactaaaaaatacaacaattgaaaaatacaaaatttaaaaacaatatggtataacaactatttacacagcatttacaatgtattacatattatgcataatatagagatgacttaaagcaggagtctcagaggccacagactgataccggtccacggcctgttaggaaccaggacacacagcagaaggtgagcagcaggggagagaccattaccacctgagctctgcctcctggaagatcagcagtggcattagattctcataggagcaagaaccctattgtgaactgcacatgcgagggctttaggctgggcactccttaagagaatctaactaatgcctgatgactgaggtggaacgtctttatcccaaaaccattgccgcaccaccacggtcagtggaaaacttgcctttcatgactctgtctcctggtgccaaaacggttgggaacagccgatttaaagtatgagaaaatgtgcataggttatatgcaaatacaatgccattttatttttaaaataaggcttactgcggccttgacctcccagcctcaagtagttctccagcctcagcctcctgagtagctgggactataggcgtgtgtcaccacgattggctaattttaacactttttgtagagacaaagtctcttgagtcctggactcaagtgatcctctcacctcagcctcccaaaatgctgggattacagaagtaagtcaacgtgcccaggcttacaatgccattttttatcagaacttgagcatccactaattctggtatgagtgggaaatcctagaaccaatcccccttagatagtgagagttgtataagcagcatctagataaatgtaattaaaactgtgtcaaactatacaaagaaacattttaaacataactaaagaacacaaaagtgcactgagcaaaaaagaaaaacatacgtccctacacaggaagataccatcatagaggtattaactctaccaaatttatatatttgatgcaatctcaataaaaataaatgttttaaaaatccaggtattagtccaaatactgtaataagccaaaacaaataagtatgaccagaaaattctaacaaatagtaaagacctgtcctaccagattctgaagcacataataaattctcaataattaaaacagtatgcaattagtaaaagaatacacaaaacagaatggaggttctaattccagtaatggcagagcagcctcaattaggctaactttccttcatataacaatgataaactctgaacaaaataatcaactatttgaaaatagcagacacagatcaaaaacagacaaaagctgaagggaggtccaactgtcaaagctgcaaactgtactggatgagagctgcatttctgtggctgtgtacccaagggcactccccagccacagctaggcagggcaactagaattcaaacagaacactgcaggggggttgtttttagaaaactgcagttttactgacctagaatcagaggacacatttggggctgccagagagtttgaaaaaagaaggaagataccctgtaaagaaagaggcacaagggaaaaacatcaacaatgtgactgtgaactctgcccaaactcaactttgctcaaagatattttttaaaagctaagtatatagagatacagcatattcacagatgagtcaatattaagatgtccatctgacctaattccctaatgattgttgcctatttgttttatatctattacagtgaccatttcagcaaaaatatttttgtagcaactgacaagctgatataaaatgtatatggaaatactaaggatcttgaatagcaaaacaatcttgaaaaagaattactgacccatggatgaatcttgggaatattctgatcaagagaagctgaacactaaagtatctacactgaatgactccacttatacgaagctctagaagtggcagaacaaattcaaagtgaaaaacaacagtaattgtttccagaagaaccgctaggaaagagtatgaaagaactttctggatgattgaaatttctttatcttaaaacactggtatatgcatttgttgaatctaactaaactgaatatatgatttgtgcacttcacctataaaaaatttacctgaaaaaaggaaaaacacaaaagaatgcaaagaaaagtaaaaaccaaaacagaaaaagtcccaacaaaaaattcatagaacaatttagcatatgatgaaggcaccctatgaactgatatggaaaggtctaaaatatgctactccctgtattaaaaaaggacaggtaaaaagatctgtaattactcactaatatatgcataaagacacacatacatcatggacagtagttacttgaggtgcagagtgggaagggagaggttccaatgtatgtgtatatgcatgcttgtatgtgtatacatacataaacatacgtatttttgagccatgtgaatgtatattgcctttcaccaaaattgtaaaaataaaacagaagaaaatattgccagagaataaaatgcaagtcaatgtcatcttgacacttctataaaaagatatggttctaaaacattagaggcacattacttcctatactgcatcatttaaagcgcagtttgggcattactataagagacaaataataacatgccagcctgagccctgatcattcttttctcacacaatgtcctttctgtctcacatgaacctttggtaccaattttcttccatgtgcaatttatgttaactgccccttcctagccaccttttaactttactactaattctttaataagtctaacaaacgaggtcaatttttaagatgcctttggtaggttttaatgaggcagttttaatcacccactcttccttaaagattctgtctaaccacaatgtatttcccaacaacaccctgagctcccaaagccctttgtgtaccacccagcaaacaacatatttggtgacccaactggtattttcatagtacaaaagtggattataatattccttatcacattaaatcataacatcctaaataacactggggaaaaactgtatctcccaggttttcattttgttaataaaaagtgtaagttataacttctaggtatggccagtttctaaaaaatattaaaagaaacaaatgcaggaaaaattttagagaagtagcactgattataacaactatataaaaagctttttacacattcaataaatttcactaatctaagattatctactttaaaatgcaacattatttgtgtaacacttgaaaatcctctttcaattttatttataaggggcatctcaaagtgaaaaaaatgtgcatcttacaaacaaatatttaatgacaattgtcttcataagctagctactttatatcaagcactgtgtaagactaaatggattagggacctcaaagtaacctgcaagttatgtaaaaatagtatccatcacctattaaattgatgttaattggaattttgtgggttatataactgagtataaatttgtcttttggttagcgttaagtttgcacttaagtatgtttctatacatttaaataatattaaaggaagtccacaagaaatgtctgtacattactcaaatgtgaaaaacagaaacctgtacaacatcaagctgtttacaaagtactaaggatagaaaataggtctgaaaatgttaaactaagactacttgctatgtaaaatcaacatatcctaaagagattattaagttattataacaatgatagcaatatcccaaacacattggctcaacatttcctaaatttatttgaccatctaacttcaggatattcttaaaactctcatgtattgaaaaatatcagcaaaaattggtctcataaattctgcctgaacaaatttgatactgtttactaacaaattaatgtgaaatattacaatatgttgaaataagatgtagcagaccattaactaactacaatgatgtccctgcatcaatatacagatgaacaagcatacgtatgttatctcacgcaaagtcccaaagttctttgcatggaacagtttcttaaagacagattatcccccatcaactgtgtaatgttcttgcttatatatctagcttaaattaaaaagaggtggggaggagaggcaaaacagctattaaagtcataaacatactaatatagcaactacctttgttggcatacagtatattaatcactaaactaacaggatgacttggtaataaacctaatagaaatccttatcaaatttccctagtaataacttttacaataagtatttcagtaaaacacatcaaagattttcttcatctaagaataagctgacttttgaaaactgaaattaaaatttaatatctagtgtacaatttacaaagtatacactcgcctacatatatacacatctaaattaacattttgcactttgttccaattatccagatattatgtttggtcaatttactactttttttgcgttaaggatatagatatttattcacatctttgttatggagaaagaaaagagaagcagtgaaaattaagttgaagaaaacactaccaactttgggcaaaaggtggctcgcatcacagaatctggtaaccctttaaaccagttttactgttcctaccatatctgcaagatttactgctgcagttagacaaccaataacaaaagtaataaaccccattgttttactaatttattatttttcatgatcttcttgcctaaacagtgtatttttttttttttttaacaaatcaaaagggataacaacctaagttgccaccttggtaagattaaaagcatgctgaacactcagtaaaattagtcaattagcagaatattatcaacaaaaggaactttcctaaggctccagctcttgattactgatctactcatttaatacagacttctaggggagtaatctgtaactatgcatccataattatttctacttaaaataatcctttcatttttatatgtgacttaagactaaaagtttagatttaaacagctcaggaatgaagagttaatcactgtaataatttttttaagtctccataattacaagtactatgtgtggctgtatattttatcttgactacaaatataattgaaagacacaaaatagattgtagtattcaattacaaatgtttaaatgtcatttatcacatcactgaaaacaatgtgactactttgattaaacttaaatttttaatcaatgattaagaatgatagccttttatttgcctcagaatccagtctcttccccatattttatttgcaaaatgtagacaatcctgattgagaaataagtaggtgcaaatgattttttaagttgctgcattacagatgcaaaaaactgtatctcttgaaaatttgagatattcctgaataaaaattgaaaatataaaagaaatatattaagaaatttatttcaaaaaggttgaatcatcaacaatagctaataagtgctcacattccttcataattaaggcataattgggcagtaattaaatctggagacagtttaacagggtccttaactggcttaaaccttcactctgtgtagaaaatgtttttcgattttatcttgtagcaatgaaatagtaaccattcaaaaacaaacagtcaccaaatgtgcattccggtatgtcagggtttcattctaagtttcaaatcagaacagagcatgtctacattccagatacccaagctgtacagagctctaagtagagctcaccacacaatggtgtggtactgttatttgtataattttataagaacacacatgaaacagaattttaaaaaataaactaataccaagtcttcctaatcggtaacatagtaagtccaaataatgtccagatatgtgaggaatagctttattccaaggtctttgatgctcatgtaataagtacaattttaacaactaattctattacaaaagactgcagaaagctctgtacagctggatccctatacgttcttaagaatcaagcaaacagcctgtgcaacaaagtgagaccccatctctacaaaataattaaaaaattagccaggcatggtggcatgtgcctgcagtcccagctatttgggaggctgaggcaggaggatagtttgagttcaggagtttcaggccacagtgagctatgacgcactactgcactccagcctgggtaaccgtgagatcccatcttaaaaaacaaaacaaaacgaaagaatcaagcaaacttttggagaggaatatctcagaaaagaaaaactcaacagtttctaagtatttattccaacttctcagatacttccatgaacaagctttccatcttctcctgagttctgtatgataaaaaatttcaaacatccattaaagttacgagtaagcaccctacacattgatcagctaaattctgtaatttggatttgttttcttttgctctctcatgtatctacttaacctctctatccatcccttactttttggaacattaaaaataagggtgtatgtgggcagcctgggcaacatggtgaaaccccgtctctatcaaaaatacaaaatattagctgggtgtgctggtgcacacctatgctcctagtattcaggaggccgagacttgagcccagtaggtggaggctgcagtgagactgcaccactgcactcactccatcttgaatgacagagctagaccctgtctcagagagaaaaataaaagctgcagataacacaaatctagacacttaagaatgcacataactagagttcgctgttctttttttctttaggttaaatttacacagcatgaaacacacatcttaatggtaccatttgagttttctcagatgcatacattgtacacttctcaaccctgtcaagatcatcacccatgtccatttctcaatgtctggcatccatgcgctcatccccagaggcaaccactaatctgatcttttcaccataggtgtcgtgtcttctggaaagtctatgtatgaatggaatatggtacatattcttttgggtcttttttgactcagcatgattttgagattcatccatgttaatgtatatgacgtgtgtgtgtgtgtgtgtgtgtgtgtgtgtgtggagtcgttttccattacttgaacaagcatgatttatttagtcattcttatactgatagacacctgacctgttgccaggttttaattattgtgaataaagttgtcatgaacattcaagaaagtacatatcattatatagaaatatgatttctttttttctcgggtaaacacctagaagtgaaaatcttgagtcagtggatagatgcatgtttagcttttcaataaattgccagatcattttccagagtacgattttacagtcctccctctttcaatgtatgagagagagctcctggttattccaaagcctcatcaacatttggtgtggtcagtctttaaattataggtagtctgatgattgtgcagtggtatttcattgtggtttcaattgtcattttcctgaagcctaccgatattacacatttttccatttctttactggacctttatcttcagtgaagtagccaactactgtccattttaaaattaggctatctttacattactgagttatagaaatctttataaattctagattcaatcctttcagaaatgttttgcaaatattttctcccactctgacttattttttaacaatgtattttaataatatgttttgtataccaatggagtctaacttagcagctttcatggtcactgctttctatatactttgaacaattctctgtttacccccaagtcataaatattctcctatattttcttataaaagctttatagttttagctttaattagactacaatttatccagaaatattttgttttcactggtgtaaggtggagtcatgttcattcttccacatggatattcagctgttccagcaccatttgttgaaagactttcctttccctactgggttgctttggcaactttgttgaaaatcatataggcacacagtgtttatctatgtggggctatcttatctgtttttatgtcagtatcacactatacagattactatggcttcaaggtgagtcttgaagtcagggtaatttaagtactctaacttattactgagttttccaattcacaagtgtatccatcagtttactgcatggtaattccaacatgtaggtcttctagggttggtctcctcattataaagggtcacattttctttgttctttgtatgttaggtaatttaggattgtatgctagacattgtgaattttatctgatggtagttagaggttctgttacaatcttccaaaagtcttcatttttgtttcaccagacaactaacctggttgcattcaaaccacaaactctgtcctggagcaattcaaatcaggctgattatctggctgtactgtctaccgtacacatgtgggatcagcaggtgattttggcaaagtttgtaggcagaatccagggctctctttctgaaactctccttgctgatattcactcctcactctccaatagttgtgattctcccaagtcttacctatggtgcttcaaggccagaaagacttggttttgtgttggaattttacctaccctgcacactttgcatggacaaaagctgtaaaacagaaaattcgcctacgccatttccttcttccgagtgtcaatcccctctaaaacatgcctatttttgtttattctccagtacttcatgttatttttagaattttgtgcagtttgttattgagggagtgtcagtctggtaagagcatacctggccatatgagaatcacaactccctcttcatttgtttaacttctctcagcaaggtttcagcattttaagcagaggtcattgtgtgtgtgtgtttaatgtattcctaagtatttagtactgatgctactattcatgaattttcttaacacccctatttgtctgctgctagtatttacaaaaatacaattgatttttagacactgaatctataaagtgcagccttgctaaatttactcatttgttttagtggctatatttatagattctttaggatttcctacataaataagcatgtcatctacaaacagaattttgaaacattccttcagatctttaaaccttttatattttgttttcctgactcattgcgcttgctaggtcttctattaaaataataaggacacaagagtagacatccctgtcttgttcttgagggaaaacacagtatttcatgattaagtaaatccttagctgttagtgtttcttaaataccttttatcagactgagaaagtctctttgtttctcatttgctgggaatgcttatcatgaatggatgatgaattttgtcaaatgcttttgaccaagtgaggtgatcttatagtttccctccttggttaatgcagtaaattacatagtttttttgtttgtttgtttgttttgcccgacagggtcttgctctgtcacccaaactggagtgtggtggcgtgatcactgctcactgcaggttcaacttcctgggtccaagtaaccctcccacctcagccttccaaataactgaaaccacaggaatgtactaccacgcttggcttttttttttttttttttttttttttgtggagacagagtcttatgttgcctaggctggtttcaaactccttaactctcaagcaatcctactgcgttggcctcccaaagtgctgggattagaggcataagccatcgcatctgacctgattaatttttcttttttcgggggtgggggacaaggtcccaatgtctcatgcaggctggagtgcactggtgcaatcatagctcacttcagccttgaacccctgggctcgagtgatcctcctgcctcagcctctgagtagctgaaaccacaggggcatgccaccatgcctgggtgggtaattttatctgtctatagaaatggggtcttgctttgttgaccaggctggtcttgaactcctaggcttaagcaatcctcctgccttggcctcccaaagtgctgggattacaggtatgagccgctgcggctggcttacactgattactttttgaaagttataaactaaccttgttggaatagaactcaattatgatgtattcttttctcatgtatgttagtgatatattaatctttaacttttcttttagttgcatctttgtcaggttttggtttcagggttatgtgagcctcataaaacaacatttttctgagtttattgtctataagattggtgatatttgttgcacaaatgcttaaatttaccagtaaaaccatgtgggcctgaagtttcctttgcaggaaagcttttgattatgaagtcaaattctttcattgttatagggctacccagatcttgtatttcttcatgcatcagctgggggtaacctaaatttcatcattacagttagtcatcaaatttaatggcataaaattgtttataatatttgcttataatctttttactgtctgtaggacctaccatgacaatccctctttcagtaccaatataggtcatttgtgattgtgggctctctgtctttttcttgatcagtctaacaagcgtttatctctccaaagaactcgcttttggctttctgatttctactcttaattttattatttcttctttctacttactttctattttatctttttaggtaactttctttcctagcagattatttaaaactataaaattttccattaggcactctttcagctacatcccacatatgtgatatgctgtattttcattataatttggtttgaaatatattttacctcatttttcccctgaataacccataagtcagaattttaaggtttaatttccaattcttaacagatgtcttattggtattaatttcttattctattggtggcagagaacatactttggatttcaatcttttaaaattgattgagacttgtgccctgtaaacagtctttcctggtgaagttaccatgaacacttgaaacgcttgtatttctactcatgttgggtttagtattctataaatatcacgtaggtagttaataatgtaacttaataatgtaacttaaaacttctatgtctttactgatttttttgttctaattgaactctccaattgtggatttgtgattctgtcccattaattctacccagttttgctgcatgtatttttaagttcctttattaagcagatacaatttattgttatgactccctgatgttggtgatttagatatatcactttacaatcttctctgttgctgatcacctgtcatttgtatgctgcgtgccatttttcaccagctgctttaagattccctctttcatgagtttgaccatgatatatctaagtgtggttttctttttatttatcctgtttgtgttgaataagaaatccaactccatttctgatacttgactgctgataggtttcaagccccaccatttcctcttccccttctgcctcgaatctgggcaagctggtaagaaagcccaggtgctccacctgttgatattagagaaatttcaaaccaggcaagtctcagcatatgtacagtgtaaaaaccagcccacagccccattccctaatcaccataaaaccccaagccagtctcctatcactgctctctcaagtcatttttggaccaacttggaagcctgccatgctctactcagacagcatcattatgtgagtaataaaccttttcatgccctcttggtgcatgtaatataggtgacatcatcagtttcacttcaaaatcaaattttatatataaaatcccatcccacatatagttcacacttattaagcaccaactatgtaccaagctcttacacatattaaaccgcttaatccttcaacagtgccatgaatcaggcactgttgtccccatttgacaaatgaggtaatggaaacacaaagtaacacgtctaaggtcctacagccagcaagtggaagagacagaggccacatttttaattattaacattattccgccccatatatagttactaaaaagaaacaagtaatataaacatagcaaatcaaagctaaaacaataaaactggtataatatcccaggtatgtaaaacatttacacaacatgtttaattataaaaactgaagatttcactgtaagagacattttctcaggaaagaaaatttctttggacaagtaaattgagaaagccccttccaaattaaaataagcagcttaggtttccaaatattaataactaaataaaaaataggcggagacaacagaacttccataatcacactcctgtaagtcacacagtcctataagaataaaattgacacttctactcatctttgatatagtatagcctttcttagaagaaggaccaggtgatgattgaaaaaaactttctcaatattttccacctccacctccaaatgctgttattaaaaactctactctgagataccgtttgatatttctgctgcccctgaaaaaacaaagtatctcccacacacaaaatagtctctactactgaaaagatttaaatatcaattctaaaaatggttgaagtatttcaagcccttccaaatacaaactttttacttaaagaaaacaaaagctaacactgaaagggttcaggtacatttactttaataacatagcttatcgattttctagatttagtcatatacacacacacacacacacacacacacacacacacacacacacacacacacatataccctccccccccaagacagtctctgtcacccaggctggagtgcagtggcacaatcttggctcactgcaacctccgcctcctgggttcaagcaattctcatgcctcagcctctcagatagctggaattatgacacttggcccagctaatttttatatgtttaatagacacaggatttcactatgttggccaggctggtctcgaactcatgacctcaagtgacccacctgcctcagcctcccaaagtgctgggattaaaggcatgagccaccgtgtctggccaatatatactgtttttaacaattaaaaagaaaaatagtaacataaatgacaaaataaatataaaatataagtacatgttattctaatcttaaaataagtgcataaaatctggaatacatggttggtctctgtatatgtgggctccacatccatggacagaaaatactagaggaaaaactagataaaataacaatacaacaatgaagaatacaggctgggcatggtgactcacgcttgtaatcccagcactttgggaggctgaggcaggcagatcgcttgagcccaggagttcgagatcagactaggcaacatgatgaaaccctgtctctaccaaaaatacaaaaattagcctagcatggtggcacacaattgtaatcccaggtattcaagaggctgaggtgggaggatcaccggagcccaggaagcagaggttgcagtaagccaacactgcactactgcactccagcctggacgacagagccagacgctgtctccccactgcctccaaaacaaagtatatggtgggggatgtacataggttatatgcgaatactatgccattttatataagagacttgagcgtctccaaattttggagatatggggtatcccaaggataccaagggatgactttacatcaaccataaaacaatgattacaatacagaatgtgattccatgaaattcaactttttaagttatacagttttataatgcttgactttgattgtaaaagtttttataatctgacaatttttgacaattagcatcccacaaaataaaaatcaactcaaatctgtatagcactctgaatgtgataaactgcttttatgcatagaggttatgtttagataacatgttaaaatgtttaggcaaatgtttaagcacatagattaatgttttatacctgtggatgcaaattatataaggcatcatataaaaattacaggaaaacccttttaaattacttaacttcattataaatttgtgttcagtatctctcaatgtccctatcatcctaaacataaatataaaaccttctttcattgcccccaaaccccgttgtcctagcaaatttcagagaaactatatctatatctatccatctatctatctatctatctatctatctatctatctatctatctaaccataaagataagcaaagttctaaaagacaaaaggctggggtgaaggagttagtgagaagtctccttatatatttcagttctaatttaagtattattagtgatcacagtttcataagagcaccaagaccatttcatagcgcttcccatcataacccaaagtcagagttaaaagttggattttgagagtaaagactaacctaccgcttcaaggaaaacgatgatgataatagaagaaaactgtagttgtaacatttctttgaaaataaagcatcactggctaatttaaccagtatcatgattatatgcaaaaaaaaaaaaaaagaaaaggcttttgttaaaatggcatgtatttcacgtagacacacgtaacatccctcttttctccccacatattcttcctgtccccagcaaccactaaatttggaattctcaattttcaaaaagaggatacagacagctcatgaaacaaactagacttagtgagctcccttccaccaccactctagtcattgctctccaacaagctcttcccaagctgcttttatcctgtctgcacaaaatcccaaaaagatttcaacacttcctagtcatatccagatatttgtattaacaataaatgtcttcagaaattaaaatccagccacagcaaagccaaaatcttactatctcattaattcttttcacgctacctcttccagtactctccagctattatttttaaggcccctcccggttctgaaatagcaggaagagggagtctgagagaaaaggggcacgatcttaagtggctggctggactgtaatctgatgtgacagtaatgtgtgatggagtcctgtggaggttggaagtccaaatgcagactctcacctatagttagttcctgatgcaggaacttctcaggcttgtctgcttggatcactgtgacccttcaaccaagtatggcctcttgatcctttcaaggtaagccaacttcaactattatgtcttactaacgtctactttgtccatgggggtaattcttccacctttgacccatcaaactctgacaaagtgctggcccactcccattgtgccctttcttcattctaccgatacaggggcagctccagcctttatctcactttttaggctttttcagatagaagtcaagtaccagtctatttatctctcaaacctcagcagacacatgtcaaactgagaagttctcgtcaagtccttcaaattggattaacaaaagggagaaataccttaacatatactactctcgccaaaaatcttttcactatggggtccttctcttgaactcacgatctttatacagcctacaggtgagtaacaggttttaactgtagcaatgcttgactcagggtgtcttttctgcatgttctgcatgaacactatagcacctcaattttgaatgcaggttactggcaatctactgttctcagatttggggtaaataccagatttggtaaataccagaacatttcctattataacattctgctatagttccaactccaggtaaaatataagcaggtcacagcagtccaatgttcttactagaggggaaaaaagggaaaaaaaaaaaacttgctcaaaagacaatggagagctatcaaactaatgagatccagatgaactaaaactgcagcaaagcagctttctaggtgaactgacaaatgcctatcacttcctcccctggagtcacgtgtagattctaggtgcaggctaaaggcttggtctgagaaaagaagctctgaggaataaaacagtagaacttttgacagtcacatgagtattccccctcaagacgcttatcagatcttaaagctgaggctaaagagctcatactttcaaagtcacctcatacttcgaaaaagtagaagtgaatctcccagtgtttcaggggttaggtgacagtctaacaagctttcaatcaaaatccctggagcgctgtttgcaggaaaggtataatccagtggcagactaaaccaaattaaaatggcagtctagccccacccagctcaatcgctaattagattaaggggagcttctctctatctacctggtaaaggtaggaaaggtcaaatactctggggagagcattatttgcaagatctttatgagtgaattttacataatgtacaaaacatatggcatacaataaaagctgtatgacatgaaaatgcaggaaaatttgagaaagaaaagaatggacaataacagaagcagaccaacagatgatccagacattagaactgccacacagaagactttaaagtaactattataaatatattaaggaaatagacaaaatggagaatttcaacagatttggggtctataatatcaaaggaacatactataactgaaggatatatttgaaattaagaacttacgtaggcttaacagactgaatacagcacaaaaacaggatcagtaaactcaaaagtagatcaacagaaaatatctaaattgaaaaagagaaaaagaaaaaaaaggaaatgaaaacaacagaactgtaagagacgttctgattttagcccaagtacaacagaagatttaaagcaagatatcctaaactgctgttttactattatctcacctctctccatagtccatgtgtgggtattgtctatctcaggcactttggatagtgatacatttacttatattgccagtgaggaccacacaggcctggaaggactctactacaagacaggaaggggaaggagtaaacagtatggtttttcccagaatgtagtcacataagaatgtcctgggtatgacattttgggctggatggtaaatactttaaaaaaaaaaaggcctgggtagcctagaatggttccaggtaagactggaaacagtcgggcgcggtggctcacacctgtaatcccagcactttgggaggccgaggtgggcggatcacgaggtcaggagatcgagaccatcctggctaacacggtgaaactccgtctctactaaaaatacaaaaaattagccaggcatggtggcaggcgcctgtagtcccagctactcaggaggctgaggcaggagaatggcgtgaatccgggaggcagagcttgcagtgagccgacatcacgccactgcactccagcctgggtgacagagcgagactccatctcaaaaaaaaaaaaaaggactggaaacagaccaaggatgttgggaaaacaaaagattactgtaattttttaaatgcctattttagctaggttgactctttcctgaagctaatatgttaaacaggacaagaaaagagggtatattgttcattgcatcaggtgttacatgataaaattacagaaattgattaatttaggtataatttcagtaatttttataaagggacaaaggtcctagggcaggtaggtattttccctgataaggtaagtgataaaaatgccccatgcaagaatataccatatacacaagggactttgaataccaggtcctggagcaggagccccctcaaaatacctaactgtaaatgtaggcaccagataaggtccagggcttagcaaagtgccttccaaagtgtgtttcacgtgatacttgacctcatcacaagtgctttcacatttataaactgtatatgacaaactggatgataaggctgataaaaggtccctattccccataacctcaaagttctaattcatatttataaagttttattgctctgactttatcaacaaattttatacatttaataaactaaattatacatcatgcaatgttgcctggcaaaaactttttctaagcagagacaatacattttaatgtctacaatttaatgtgagttctcctgaaaaacaaaaatagagaacgaagacctagaatatctgaatatttccaataaatcatattcctagctataatgttttatagcttatgaagctcatttacattatttcaatggacccaaaagtcatactgtgaaagtactcagatagcactactgcctttcacagctgtgaacagtaaaaaaagtacagtcatattccctaggatctacattcatcaatactaaagaagctgacacaaaaacaggttatcaaacttgaaattcagagttccctccaccatagtgtttcatacatattacgatacagacagacacacgcacatgcctatgtatgaatgagaagaaagaattatcctattatgaaaaagcagttgcttaagaatggaagaatactacagtttgggttcaaaaagacttctctttagctattcctggttacctagagaagcaaaagggtatgaacatgaggttagaaataaaagatgacagtttttttaatgacaactgctctattccaagacagtctgcataaagttactaattactctgatgtttaaaagtctgtaagaggtggccgggcatggtggctcatgcctgtaatcccagcactttgggaggccgaggcgggcgggtcacctgaggtcaggagttcgaaaccagcctgaccaacatggagaaaccctgtctctactaaaaaatacaaaattagacaggcatggtggcgcatgcctataatcccagctacttgggaggctgaggcaggtgaatcgcttgaacctgggaggcggaagttgcagtgagccgagatcccgccactgcaccgcagcctgggcagtaagagcaaaactctgtctcgtttctaagaggcaaaacaaaatccaaatgttaatggcagcattaaaaagaaacatcctggaaggacacatgaggaactagtaatacaacgttcactacagaggaaaactgggtgatgaaaaaacaggggtgggagggagactgatttttccaccgtataatcatggttgatttttcagttatgtacatgctactttatgtttttaagtaactttttttttttttaaagggacagactctcactatgttgcccggtatggagtgcagtggctgttcacagatgtgatcactgcacactagcctggaatttctgggctcaagtgaccctcctgcctcaacctcccaagcagctgggactacaggtgaatgctgccacgtctggctagaaatacactttttgaaggcaaaaacagtcataaacatacaaatatcagaatgctaaaaaaaatagaattgccttttaacagaaaaaactgacttcaaagaaaaaagacaagaatagtcttgtcataaatagacacgaattaaattgcccaaaagtcctatttaaacatttaattgtgctgactataaaagtgatatacttttatatataaatactagaaaaaaaaatacaggacttttctgggtcacccatactcattactaaaaatttggtcaattaatctctaaaagttcataattaagtgttaacatttttagaagtatgctttatcaagctaagaaaactcttatttctaatttgttaatatgaatagcaaattttatagaaagccctttctggatccatgatgatcataaagtgcttcttaaatatgattatgtggtatcttatactaatagatttcctgtagttgagtcatccttgaatgacaataaacattacctagacattttttttttttttttttttgagacggaattttgctcatcgcccaagctgcagtgcagtggctcaatctgggctcaccgcaacctgtgcctcctgggttcaagcaattctcctgcctcagcctcccgagtagctgggattacaggcacatgccaccacacccagctagtttttgtattttcagtagagaccgggtttcactatgttggccaggctagtctgaaactcctgacctcaggtgatctgcctgcctcggcctcccaaagtgctaggattacaggcgtgagccaccatgcctagttatgtttttgtggttttgtttttaataaaccactgaattctagtttctgatattttatttatgacttttgcatctatgtttataaagagtggcataaacttttctttcgctattcttgtttaattgtggtataaaataagcttaagtgttctttattaaagaaactaaaggttaggactgggttttttctaattcatattaaaaacaatacagattccaatggactggtggaaaaaatgatactgaaacaaacatcaggaatctttgacaatattctgattatttccttgggatgaaagatcaaaaatgtgattacatggtcagagtaccaccttaggaaagtccttttaatttatgcttatgaaaataaattttgcattcctatacatttatgtataatcaatattataaaatagccattttagaccccatagtccttacttttaactttacagacctccatccccactgcaatttcaattttgctttactgtggataataatatattgaaagctttttccttatgtctgattctttatctaaatatcaattgccattctgatttcacgaccaagttgtctcccatccctcggactcaaaaatgtttgagatgaaaaagcttcctgaaattttttattatttagctcactgcagcttttattgaggttaagctctacctataaattactctgtgtcaccacagaaaatggtgggaagggagcgacagtgacgtatctataactacagcttttaaactgccagaggcaacaagagtaatgagatgaggggagtgggagggacacaaagccaggactatgtttctgccctaactttaaccccactctaatattaaggggctgaaagtagagaggaggaactgttcagtaaacatttcaacagaaaacatttgccatttcttaaaattaagcaatttgtttcccgttcttcatcagctgaacttagttgtattttttggcttataaaaccataaaggcactttactaacattttacttgaaattctgagtaaacgtgcttacaaatccattgtgtatcacattttgaataattctgtttaagctaaggtttggatttagccataacaaatcttttccatcccacttcccatcttttacactctacatataaatgagttccctgaattccaactaaatttcttacatttaagaatatttagttgttaagaaatgactaataacctgacacaatttaattgttctactactaaaaacaagctttataaaatatatggcactaagctacagtgtgtaaaaagttaaaatttttttgatagaccatgatcaataataacaaatctccatttttgcaacatctaaaaaaaccaccaaattaggcaaatttctacgcttcaaggaaacttcaatagtgaaaaacaagataatggacaattatcacttcaacttcattaatcaggtgagagggcagaaaaaaatgtttttaatgatgaagcagctccagaatatgagctctcagagatctctatctccaaaagaggctgtaaaaagaatgggaaataaggaaaagagctatgactaaggtgacctcctccacaggttaaataccagcaatggccaattttagtactgctgtacctccctaaaagattagactctctcaggctctgctctggataacctcactgcaatggcaacttgagccttgttgaagttgtgcaaaaacatggctctatctctgctgtatcacacagctcccttcaatcaagtgataccagtctcccggcctccattcttgacagcctcaaggagttttctcgctgcaacccacgttgcacttgaaattaatctgacttctgagccttcagaccctacggcacttaaacggccccaacctcacccgtcaccctcaggttaagtgtgaacactggcacagcatgaagtgactccttactacctatacacactatggccatttgccaccccttactttatactctaaggatacccaacttgtttggaacgcttcaccaatcctcccccacctcccaatctccacaccaccgcactacatgtgatgaaacaggcttctcctaattcctcctttaccccgctcaactcaaaatcaccagtattcctccagaaggaaactttccacaagcctcctctggatatagccccaagcatacttcttttataacatctaccaagcctcatgaaaccatctttttctaagtttatctcccttactaggaagtaagtagtttaaaagcaaacactgtatcttaactccagtgaggaagagcacaccaggcacatagtgggcatatgataaatggttacctaattgaaatcccaagcactacacaatgaagaatgaaatatagcttgacttctcagcccattcaccaggaagtcctcagttccacttctaaaacccatgccaaatctgtttacttcgtgtgctagcacagccaccacgccagtccagcctctatcgtcttgcatttagattcctcacagcctcctaattttcctgcttccatctaccctactacacacataccactctcccgcagccagaaaaatctttgtaaaaatatgtaagatcctctttaaaatccatcagaataaacttacttgcatcctgttatattcagactaacattcaaactctcaccacactctaggatgccctgtataagctttgggcaagtcttgtcctccatctacactgggctccttttaaatattctaatacaagaagctcacctcagtgtcttcactctggctcttccctctgcctagaagactcttccctcagttggctgctgcttctccaagctccacgcaagcatcacaatccgacccaaagcagctttttaattcttcattctatcatatcactgcatttggttgtcttctttgcactcattaccatatcaaattataattaatttgtttacttgtttatcgtgtatttctatcccttaggaaggcaggagttttgtgttttgttaatcactgttatcctcatatgtctagaaacagtgccttctacatagcaaacactcaataagcatttgtaaaacaaatcaacaaaccaaaaaagcaacctttaagatatacataaaacaagtaagggaaagaaatggatggtctaccaaacaaggcaagaaacattctactgttagtatttgcaactagacaggctgcactggtgttattgggatctgttatctataagcatcaaaagtgtacttctcaaagttcaaagtcaagtagaatggtttcacatgctatatgctagcccacggtatgacactgcaaactatcattttagagaattcttacatttaacaatctccccaaaatctgtaatgtacacaagtagtaaaacacactttaaaacacctgtcacttaattaaaaaacaatacttatgacagtggtacttatctgtaaatgattaaatttatcctcagaaaacttcagacttttaaagtaacaggtcctcctaacctaagaggcaggtctttaagacaggttctgactaatgcctacaacaattaagaagccacctaacacactattctttcttggaagcaatgctgcaacgcaaagaaaaaccatataaaattcattaaaaagtgagcagcctcttttcacccctgatgaaagttttgactaaaggaggagaaaactgtaggttgctactatgttagtgatagaaaaagcttcaattctttattcaagtatcattcaatcacggaaatgaggataacatacaaatgtaggcaatgaagataataaatctaagtatcttatttagcttgattaaacctcactattcaagaaaataatttataaaacaagtcagctagcaaaaacaatttatacaaggttaaaaacagtcatatttcaatcatcactttttacaggcaacttgaaaggaacacaaattcagtaactttccttcagattccttgacataatttgatcaaacctgggatctaacaaaacttaccttggtatggtaacacatttagtattacagttttgagtggtgatggctttctcaagctcatctaatcgtcctgttttctttagcttcttcaccagacttttcactgctttctcacaccacttttcttcctgcccattctgctctcctccgcctgctcctccagacccaccagctgacttcttccatcccagcagtctcttcacaactggcggcgtgaatggcaagatggacgacatgttcttaccaaaggcagcaagccacgctaggaaaacagcctcttgtatcgaacctagcagaaatattgaaaggatgatgtagagactaccttgaacatcaagtaataatttcaacttatcatagaaagcaaactgcaaagcaagatagaaattcgaattatgactttcccaatagacttctccacccatgaaaacgttatctttatgaatttaaatgaatgatggaaacaaacccttctaaaaacaagaatgttgtaaggactcctcttgtgggaaaatacagtaattttgcaagtaaaatcagatacttttaacgatttttcaccaccaatactattttaaactcttagtagtgtcaattaaaatattttcacaaaaggttctcttactttttagaacttcactctaatctcaaaagactatacaaaaatacattgaaaatttgtaagcccactctcccccgggttttaaactttcataactaataggaggcaaaatctacagttacaagaagggaaaatgcgtaaagtgtgaagtaatcaagaataaagaaataaacatggcaaacagagtccgtggagaaaagctgtagtccggtttcacctgctcttgagagaaattttttaacacatgtttttttcattttcatctaaataacaatttgcatagtgagtaaagtcagatagtttctcttcccaatttaaggaattgtaccttgtcttttctcttccataggaatcatttttattaagctgttttgtctattcagcgtcattttacaaatataaacatgtatacatacaactaaccacattcccaccttattgctgtacaaaagtagcataatattccttattttgtatatcttgaaattatttttttatttttatttttttgcttaattccctgtaggtcattccttatcagttcacacagaatttagaaagcactgtcccctcaattttctagactccactactgatactggtaagtcccacataacttttattcctgatcctttaattggggtttaaaaattgtttcgctccagaagctcttaatatcttagctcttacgcttttctttcctttgccttcaattttagtgagatataggaaaaaggaaaatgaatgtgttcaatttgccatatttaataaagttcccaaaaggcatcctttttagaaagtaaagaggtctgtagtctttacatcacacaccccaaatactgaaattgtagttttcaaagtgtatctttaagaaaacaatgatgcttacattttcattagtttgttccttaattatcataatgatcagacaatagtttttaaacgtagaggaggaagtacaagttaaaataataataaggcatcatttcatgcccaatctagctggcaaaaattgaattaattaaaatacctactgctggagaagatgtgaagaaattgttatcattccacattgctggtgaaaaggtcaaatgtgacagctttattctaagtaatctggcaatgtgccacgtgttacaactagtaactggattatacgtgtataaacaaaaatctaggatattaatatgggttgcagatataccaatatgcagaaaagggggtgaaaagatgaaaaaggctgaatgatatggccattgtgtatgtttttgtgtatgtgtgtacaaaaaactggataaaacatttttaaaggaaaaaaacagtttttaagcacactttgcacatattcttaacgttaaagaagatcctaacacaagatgcaaatttatttcccatcaaagaacatggctaattttcatagattatatgctaagattcatttccaatgtacacaaactgcattcctgctctaacctctccataattccattattttggtttgcaccacatggaagaataatttttttttttaaatattccctcttctcaggatggtcaatgactagtgaagaagactgccatgattaaaatacacatgacaattaagagaaattgcaagggggattacaggtacacaaagaaacaccatctgattttgctttaggcgtcaggaaagattttcctgaggaaatatttgcacttccttggcagcttgccatttattcattcctttttgcattcaacaattttttttttttgcctgtctattgtgcctgtatttacctgtttattctcaaatccagtctgtgttattcatctgcaaactacactgttgagctgggacgggtaggacaaaagaaatcctttgtagcaaggtattggcagtggggaatggagaaggggtaagtttttaagggcagagagatcaaccagcagagaattgcaatacacaaaaggaagaatagctattagggacatagaaggaacagagttgattaagaaaaagttacaaattacaggttcttgcttgaaaaaccagttgaatgaaaatacaattcgccaaaatacgaagtatttggggaacataagtgttgtgttagtcaaactaaatttgctgtgactatgaaattccagaaggaggtgcccgataagcagctagaaacaaaggtttggagcttagcagagagatcaaactgtcatgtggtaatgaaacgcaatgctggtatatgggagagctcagaaagcgccaagttcagtgaaaaaaaaattctaagaaatacatataaaggagttatcaaatgtggaaaaaaagtggatgattagggagaaaggtgtcatgaatacaaaggacaatttatagcaacacaacatggtaacacaacttttaagtgccaacactaggatttatatcaagcagcatgatgccagagaacaagtacttaattgtgtcaatgcattgtgttgcacataacaatctgaagctaatctggagacctaaaaagagccattaaaggctgagctctttatacaatcaacagagctatctgtgcctgacaaattagtccattagataggattagaatgacacatttagctccaactcctttctcaatctacaaatcatttaactagtctttcagtcaccaccttctaccttctttgatgcaaacagctttctaaaatgcatactgcatgtcaccctactactaaaaatccttcaatatttgcaaaaagtaacagtaaaatgacttaatatcctttaagaacccataaacagtgtaatgcttcagagaacagattctgaagccaattggccaggttcaaatcccaaggatgccacttactagctgcatggcaacctctatacaccccagttttctcagctgtaaaataaggataacagtacctatcttaaagccaatataacaacctctataaaaatgtaatatgagctacatatgtactttaagttctctaatgacattttaaaaagggaaagaaaataggcaacattttaatgatgtatttaacccaatatatccaaaatgccatcatttcaacctgcaatcaatataaaaaaaattttcatactaagtctacaaaatctgttgagtactttacacttacaggacaactcaactaggactagccacatttcaagtactcaatagctacacaaaggtgctgcctacccatattgaatgatccagccctaactactcaaaatttctgcctactctgcctatcccatattctccataaactgttcataaatgcctctatttaacggctgtaggatccgtagtgatgtgacatttttcaattcctattatttaaatttatgttctctctccccctccccatcctccttttatcagttttgctaagtggtcaattacattaatcttttcaaagaaccaactttttcttagctttgtcaattttctctatgtaagattactttctattcactaatttctgctcttgtcttcattatttctttacttctactgtctttaggtttgatttcctattccttttctacctccttaaaaaagctttcttttccaatgcatagacttaaggctataaatttcatcttagcatttcagcagcagcaatctagatcattgtagttcaccttcattttcaatcagtttaaaatattttctaatagccatcataaattcttattttaagtcatatgttattcaaaagcatagtgttttatttctaggcagctaggaattttctagttatttttatttactataatacaaacaacatattcaattattaaaatcaatgatatttgctgaggctttgttcatggccctagcttatggtcaattctagtacaatttccatgtgcaagggaaaagatggttaataccaccattaatagtttcaatgttctacatatgacaattagatcaagcctgctaattgtgatgtatgtatgtcctatatatgtgcatccattgtgatggcatatttgtctgtttcttttagttcaaaataaaatttttggtttatagatgtttgggctattttactgggtacacataaaggattgtggtaactctggtggatcaatccccttacactataaaatgtagttctctttttctactactgtttattgtattaaagtctcctttgcctgattggtatagccacacttatttccttcagttagcatttggatggtataccttttcgcatcattttctctcaatctttctaggtacttatatttaggtaattattatttgtccagtctgatgatttttgccatttacttgaaatatttagcccatttccatgtaacataattactaatttagttgcctgcttgttttatattttctttcttgtcttcttctgaatttatcacatattctatatccaatttttttctgtattcatttgttacattcttttcttttagtggttaccctagatattttcttattcatccttcacttaacacaattttcatacatatacttttactacttcctctataatgccagaatcatagaacactgctgagtagcagttttgctatgaaggagactacctctggtttgtccctgttcctaggatgagactctgcagagccttcatttcaaaagctagcagatcgttatcttctaggtacctagatactataagaattgctttgtttttaagagacttctggtttagctctctagcctaagcagcttcagaatttggcaaatgtctacgggggaagaaactgggtgtgttgaaaatcatcagtgtgtattcaccacttcctcaaacgctttcaactctcacctattgttctcaagtcgcttcccctagagaatctttatctcaacaccataggactagaaaatatcccaatctccttttctgagattttggtttatctcttccgcccagctgaactacagaatttaggaatatactgagggcgttctctgtgtttaaaggcccctcatatttccaatctgccactcaggctgcagcccaaaggcctcctctactctgtacccaggaaaaacaatgatcagctgcagacctctcagctcacttgtgaaaggtattcccccagggtgcaaaattttgctttctttaatcatttttacacccattgttctctatcgctaaatatataaattttgtaaattacctggcttttctagttgttttattaagagtcttggactaccaagaactactgcatcctatcccccaaaacgttctaattccatttgaatagtaagtcttccacaactataaatctatgagttgaaataatttgttgatgactttaatttcaaaataagacacaagatcacttaccacttgaggacagagatggagagttaagatttgagaacaggaaaaaatagagaaacgtagccctgagaaaatcaaccattatgaaacaacagaaaacgtgtcagttatgtattatcagactatatacttaaaaagtattccatagaaggaattccacttctgattaggacgtagaaagttacaacagagcatcactttcattctaataatcaaaactagccagataagctacaaaatcatggtctctctgaaccagagttgaggatacaaagcagcctaagaagaactaaattccaagtgttgagccttgagagaagagaggctgcatggatggtctctttcctggtggagcggctagtgaggaataatcctgccataaatgaaagaaagaagaaaccagcctacatgcacaccgacatgacatattaaattgcaaggatcccacagagcaagtgtgcatccaccccaaccactcatccccataggtttccactaagtacttgcaaaaagtatgtcaaagcttggggaacaggactggaaagctgagggagatcccctaaggagcttaagatctcccataaatgcaaaaaatctaccctcatcaatgggggatggggggagggacaggcaagaaaggtgagaaaaagatgatcccaagagagtctagacattgagctgccaagggctgcggtaggacaggaaagatgagaaaactttcacccagatactcaggacattgatctaccgaggctgaaatgagtagcgaacttgaagacagggtaggattgctaaaagaaacctctggaaggtattaatagcagaaagatgtctcactgggcacaaaagcttggaggcaggactagagaaagagggggtggggggaaagaaaataagaatgaccaaggaattgacagctgagctatagagaaatttctcatggttcagaaagctgacggctcagctataaaccaaaaagagatccaaaatcacacttggacaaaacaagaaatgatggaccattttctaaaagtaaatattatttacttcaatctccattgtttttatacaaatgttcagcattcaatcaaaaattacaagatacagggagtagcaaacagtcaaaacatgaataaaatcagataactataataaaaatgctaaagaaactgatggaagagatagcaacatgaataatgaaaaaacttcatcacagatatcaaagttacaaaagaggatcacaggaaaacgttagaaatgaaaactatagtattagaaattaaggataccattagatgggcttaacagaaatgagcagtgaacttgaagacaggccaaattaaagtatgcaaattgaaacacaaagagggaaaaaacagtgtgggggggggggggactcagaatatccaaaaccaaatgtcagttgggtttaattggggtgccagagaaagatgaaagacaatggggaacaaaaaaatgtatgaagagataatggccataaacttttcaagagatgacagatattaatccacatatggaaagaaaacacattcatggtcaacctgctgaatattaaagataaaagtaaggatgaaaggccgagctaggataacagttaaaatccctgggagtcctcgatagaaagagaatctgcactcattcacaagctcttttccaagggcctcaactgagtgctcttgaaaaaaggcagaaaacggaagagagctccttcctcccatttggtggcatctcgtatgaagcaaatgccttcaactatgacgggagaggcaggaaagtctaccaaacccaagggcaagcaaagatcccctgcctcaaagggaagggtagagcaaaagacatgtgctgctgagttgggggatttgtggagcaaaacttacttgcccatctcccacacacaaacatgcctttcactctgtaacaataaccaccatattctactgccacgggaagggaggaaacattgctaccaccagtcccagacaaaggcacacagatgctgaggaatgagaagcaacagctgtctgatactgaaaaagggacaacaagccggcttgggcccaagatcccgtactaatacacagcaaaggtctgttactactagatgcaaaaatcctaaacaaaatattagcaaatcacatccagcaacataatagaaaaggtcatcatcactaagtaggatttatcccaaggagcaaaattggtttaacattcaaaaatcaagcacctcatttatagtacaaaggagaaaacgcacctatgattctctcaaatgagcgagaaaaaaggtatctgaaaatgttaattcaacactcatctataatttaaaactcccagcaacactagaaaagaatgttcttcaatctgaaaaggacatctatgaaaaacctagagctagcatatgtcataaagaaacattaaatctctcccttacaactgggaataagacaaagatgtccacggttaccctttctattcagtaatgcattggatattgtagacaggacaactatgcaacaaagaaaagatagactggaaagaaataaataaaactgactttatattctacagtgatatgactgtctccatggaaaagtgcatggaatctacaagtaatctacttactggaactagtaagtaaatttagcaaggtttcaagataaagggtcaagatttggaaaatgaaatttcaagaaatacgcttgaaacaacagatattttctacatatctaaagaaagatactcaagatctcaacactaagaattacaaaatattgctaagaaaaatgaaaaacactgaacaaagagagatcatgttcatagacttgaagattcatattgcttaaatgtccattctttccaatttgatatatggattcaatgtaatccctaccaaacttccagcagagttaagcaattcatatgatataaaattcatatggaaacaaaaaaaaaaactagaataaccaaaccattcttgaaaaagaaaactggaggccttacaccaccttatttcaaggcttactaaaaagacttagtaatcaagagtatagagtaggcataagaaaaaaagatcagtggaacagaacaagtctagaaatagacccacacatatacagtcaactcattttccagtaaggcccaaggtcaatctagttttcaacaacttttcaacaacatggaaaataacaagcctcaaccacaagtgcataccatcttcaatgggaaagcagaatcttaagctcttagaggaaaacacagaatacattcatgaccttaaaacataaaaagcattaaccacaagagaaatacagttgagccacgcatggtggctcacacctgtaatcccagcactttgggaggccaaaataggaggactgcttgagctctagtgttcaagaccagcctggacagcatggcaagaccccatctctactaaaaaacaaaaaatacaaaaaaaatagctgggcgtggtgcctcctgtgctcccagttaggaggctgaggtgggaggatcatttgagcacaggggtgcggaggctgcagtgagccaagatcactccattgcactccaggctgagtggcagaacaagaccatgtctcaaaaagaaaaaaaaagaaatagaaaaagaaaaaaaaaatacaggctgagcatcacaaatccgaaaactgaaatctaaaatgctccaaaatctgaaacttcttgagtaccaacatgacacccccaaaaaaacggtcattgtactatacagctataatgcaaatattctaaaaattggaaaaaatctgaaccacttcgggtcccaagcattttggataagggatactcaaatctgtgtatgtaacataaaccaacaaaatttaaaaatcacacaaaaaggtaagctcagcttttttgttaaacaggaaaagaataatagacatgtcataaaagacacaggagcacatgaagaggtatttagtatcaccaatcatcaggaaaacgcaaactaaaaccataatgcaataccatttcacaccatctagaatggtttaaaatttttctgacactactaaatgttgatgaagatgtggagtgtattagtatactactgctgctgtaacaaataatcgcaatcacagcacaaatttagcaaaatcagtttcaatgaactacagtcacagtgttggcaggactgattcctcctggagtgtctgaggggaagttcgtccttgcctttttcagcttctagtggttacctgtagtctttagcttgtgctcccttcccttagcttgtgctctctcccccaccttcagagcacatcattccaatctctgcttccatcgtcacactgccttctcttctgtattcaaatctccctctatggccttctagtaagagctcttggcattacatttaaagcccacccagataatccaggatcatctctccatctcaagatccttaatttaatcacatctgtaaagtctctcttgccatataaaacaacattcacaggttcttgggattagaacctgaatatctttggagaccatgattcagtctaccacatcaagcaactagaacattcataaactgctgaaatgaaagtataaaatggtatatagcacaattggaaaaccggcaagttccaaaaagttaaacatagatctaccctgtatcacacattcaggaaaaataaatacgtatgtccacaaaaagaaacctgtataagaatgttcatagtagccatgttaataatcgccaaaaactaaaaacagccaaaatatcaaaagaaaacaaataattatagtgtgctcataaaaaggaatactgctcaggaacaaatatgaatgagcttatacactccacaacacggatcagtctcaaaaacatgctgggcaaaagacaaagaaatatagactgatttcattcatggcttcccacaacaggcaaaactaatctaatgacaagtcaagatgaccatctcagaggcactaaggaagagaagtggaaatgtttggacagaagcacaaagtacctttctacggtgacaaaagtgttctctatctttgttttattccctcgctcctgtaaatccactgttgaattcctgaatgttttctatcttgagaggtaatcacacatgagtacaagttaccaaaactcacagaactggccgagcccagtggctcacacctataatcccagcactttgggaggctgaggcagacagattgcttgatttctggagttcaagaccagtatgagcaacatggcgaaaccctgtctctacaaaaaatacagaaaaaagttagccatgtgcatgtctatactcctagctacttgaaaggatcactagagcccaggaggcagaggctgcagtgagccgagatcgtgccactgcactccagcaccctgggcgagagagtgagactctatctcaaaaacactcacagaactgaacatttgaagtctgtgcattttagcaatgtaaattacaattcaaaaaaatttaaaaggtgcctggacaaacacattaagaagttcctaaattaagttaaatagacttctttactgaagaacttctcaaaagcttcaacatgccaatgcacattacaaatttcagaagggaggaggttgcaagtgaccaaagatgtaagcttggaagtttccgtccacaacatgcagatagcctctgcaagtacatgtaggcaaatgttcgtggatggagggtggaaggggtattgttttgaggacaaaaattgagagcccaaatgacagccatcacaaacatacatgaggcactgacaaaatggttgttgtaacagagctatataattgacccgtggacaacatgggtttaaactgtataggtccatttatacacagattttattcaagaaacattgcaaaatgtcttggagatttgagacaatctgaaaaaaactcataaaccaggtagcctagaaacactgaaaaaaactaagaaaaaggtatgttataaagcataaaagatatgtagatactactctatcatttaccatcatgaaatacaaaaatctactataaaaagttaaaatttatcaaaacttacacaaacacagaccatacatggagccatttacagttgagaaatgtaaacattcagatgaagtattaaatcattaactacataaaattaacggtagtacatactgtactactgtaataatttcatcgccacctcctgttgctatcacggtgagcggaagtgttgcgagtatccactgtgtgaggctaatcatctctgcatgagcagttcttctctccagtaaattatcacagtaaaaagtgatctctcacatttctcatgtaattttcaccatgtgtagtgcaataccataagccttgactaataccatgagatccatacgatgtgccactagtgatgctgacagtgctcccaagaagcagagaaaaatcatgacattacaagaaaaactccaattgcttggtatgtaccacagactgaggtctgcagctgcagttgcccaccatttcaagataaatgaatccagtgtaagaactacagctaaaaaaaaaaaaaaaagaaaatttgtgaagctgccactgcagctaggccaacaggtgtgaagatcttgcaccttttgtgaaacaacttttgatctcatattgaaaatgcaggttttatgtaggtacaggattgctataaagaaaggcgtacctatagactattacatggtttgagaaaaagcggagtcattatatgacaacttaaagcaaaattaaggtgaaggatctaaagctggaaaatttaatgaaatcaaaagatggttgagaatttagaaacaggctggcttaaaaaatgtcaagataacaggaaaggagcttctgtcaaccaaagtagatgagttagttcctaggcaccattaagaaaatcactgaggagaaagggtatctgcctgaacgggtttttaatgcaggcgcaagtgctgtattctaggggaaaaaactgccacaaaggacatttattagcaaaaagagaaacaagcaccagatctgaggtaggaaaggacaggctaactctactgttttgtgcaaatatgtccaggtttatgatcagcactgcccttctctataaagctgctgacctccaatccttgaagggaaaagataaacaccggctgccacaacaaaaaggccagggcaaccagaacgcttttctctggattcgttccatcaatgctttgtccctgaagtcaagtaccctgccagtaaaagactgccttttaaagttcttttgacattggacaatgtcgctggtaacccacaatcccatgattccaacaccaaatatgtcaaagtgatctacttgtccctgaacacattaataacatctctaaatcagggagtcataaggacctttaaggctcattacacacagtactccatggaaaagaccgtcaatgttacaaaaaagaactctgatagagtgtcatcaaagtatggaaggattacgccatggaagatgccattgctgttatagaaaaaaccatgaaagccatcaagtccaaaatgatacattcctactagagaaaacagtatccagatgtgcccgacttcacagcatttacaccagagcctatcgaggaaatcataagagattgtggatatggaaaaaaaaaaaaaaaagtggggagtgaagggcttcaagagatggatctttttagagaaattcaagggctaacagactccacacatcagaggaattaacagaagacgacgtaacagagatcagtgcttctaaactagctccagatgatgaggaagaagatgcagaagaagcagtgccagaaaacaaattgacataggacaatctagctatatataatatagggttctaattattgaaggctgcttttgacttcttttataacacagatccttccattacatgggcactgaaactaaagcaaaaggtgtaaggaggactggtaccacacagaaacatttttggagaaatgaaaatgcaaaaagtcaggcaaaaattgcttattttcataaagttacactgaatgtgcctgactcccagtctgcctcttctacctgtgagacagcatgaccaaccactcctcagcctactcagagtgaagacaatgaggatgaagaccttcatgatgatccacttccacttagtgaatagtatatgtattttctcttccttatgattttcttagtaggtttcttttctctagcttaaagaatacagtttatcatgcatgtgacatgcaaaatatgggttaatcaactgtttatgtattggtaaggcttccagtcaacagtaggtcgtaagttttaggagagtcaaaagttatacacagattcttcactgtgcaggacagcaccccaaccaccccattgttcaagggtcaactgtatatttactaaaaaagaaacattaaataaaagctcaaaaaaggactttaaattatcaaaagaatgttctcaaaaaaggtcctcaaactgaggatattcagcccttggtataatttgctagaaaataatggccataactgccaggcgtggtggctcacgcctgtaatcccagcactttgagaggcagaggcggttggatcacgaggtcaggcattcgagaactagcctgaccaacatggtgaaaccccatgtctactaaaaatacaaaaattagctgggcgtggtggcgagtgcctgtagtcccaactactcgtgaggctgaggcaggagaatcgcttgaacctgggaggcagaggttgcagtgagccaaaaccacgccactgcactctagtctgggcaacagagcgagactccatctggaaaaaaaaaaaaaaagaaaataatggccataacctaatataatcatactcacgcccctcgaaacagaaaaaaaatcaatgcatcctcaagctcaattcaggagactggccccaaggcctccctccaggaagaggcaacacagcatgccaaatttcataaatttcataaatttggccatgtcaaccctttttagggatgtatggaatgccacataacaatactgcattggcaaccttgggagtccaactagggttcaaacactaaaaatttgaaaggagtcaataataggattatgtaactttctttagcaatatagtagaaatggtgggaaagtgaggtttgcatagaattagggaactgtaatgcaaataaaagagcaacagtgaacttaacagcccggttaaactgtctatagtggtagacctataatacgacacataaataagcactgtagtatgtaacttgataaaataaagcaaatacacaaaactccatcaaacgcatgtaatcatctaccaactaataacctgggactatcaggcagcaaaaagtgtacttggctacctttggcccctgttggattcctactctgtgccacaaagtatgctctagaggagccaactacagacaccgtagtatcatgtgacacagtcttatcctagcacagagaacaggattcaacctttggaagggaaaggtgacactaaagttgacaccagagcacaagtattgagagagatagtacagcaggcagaaagttcagcatgttttctaaagacaggaaacgttttaggagagacgaaaaatttaggttatcactaaaatacggtgcacaggaagcactgtggcagaagatgaggggaaaataaggccagtgcagattaaagagctgaagacagaaattactgctaatgataggagtattacttcatttattccagtgacaatttgcattttgaatgacctactggacgtgcagtttagggaaaaggattgaaacacaactaatgtgaccgactacctaatgtaactgagtggcatgtaatggtacattcatcactattaggaatgaggaaagagaagcaaccctgaaggctaaagggtcagttttatacatgcctttatgtaagtaactatgttcatcacatggccaggaggcagcataaaatatagtagactcaggggagctagcagtcagtgtacaagtaagagtgtgtgccagagctaggcagagacaactggtgtcttgaagaaaagcagagcagccaatctctaggcttggtttctgaggactgtccaggcctgttccagctccacaattatatcctcagaacaaaacctctttttgagttagcatgagtaatctctctgttccttgtgaaaaactgatagaaaaagcaaaataaaagaatctccctacaagtatctgtatctttggttcaattattccattcataagaatttagcctaaaaaaagaataaaaaatgaaacttctgtataaacagcaaaaaaaaaaaaaaaaaaaaaagggatttccagcattaggaggaatgagagtaaacagtttctgtaacactttttttttttgaggagtttcactcttgttgcccaggttggagtgcaatggcgtgacctcagctcactgcaacctccacctcccaggttcaagcagttctcctgcctcagcctccggagtagctgggattacaggcacgcgtcaacacgctcggctaattttttgtgtttttagtagagatggggtttcaccatattggccaggctggtctcaaactcctgacctcagatgatccatccgcctcggcctcccaaagcacagggattacaggcatgagccacagcgcccagcctgttacactttcgttaggagaaatgtttcttatgagttaagctgtattcctggggatctaaaagttttctataaaacctttacaatattgtttcttcactgaaatgaaactaacttaagtttaggcctattctgggtcatctgaatggccacatgacctggtattgccacatgatttcagtgtcccatgtcttacaagaggagttaaaaccattttggaactaagtgaacacttaaagttgccagccttacctttgcatgtctcagtaaccatggttggctgacatctgtctaatatctccggagaatttttaaattatgtaataaaataacatttgttgtaagtaatgctgataatacatcttcaattagttaagcttttattttaaaaactgaagcatttttagccaatatttttgaagtgtaaatagactgaatgtaggctgacaaggaacagataacaatgtgttccaggttaaaaacaaatgaaatacaaaaaagaaaactagatttataatcaagttgctatcaaaacgtgaatgagtcatttacagaatatacagatttccttcaatggtgtggcagcaagttctctactgaaataaattttcaacatctgcaagaattgaaatctaagttcagacactatttctaattccagcaataagtgatacttacataatgcagatttcaaaagaacacaaagactatctttacagctgaataagtcagcttaccaaatgataccttagtaaaattaggattctacgattactcaccggaaagtttcaataaggtaagaggtctaattatcctgaacttgtagtaaagccttcaagttattaactctatattatagtttgacaaatagcattctctgcacatttaattaaacaacagtgcatactctttccagagtcctcaactatgtggtccttttcttactgtttttattctgacataaaccctatcactgagtatgtattacaaaaaaatctccaaatccttagaatgacttttcattttatgttgtcttttggaacacacaaagctgtattttaattaaaaatcttttatgccacaaccttgcttttcaaagaaatcttgctgtgcctctaaatatagtaggaaacatttattgagtgcttaagcctaagagtccagtaagcaagaattccgaatcctaagaaccaactggggttaggtactattatttacaaatgaagaatgtgaggcacaaataaataccctgacgtaatacagagaatcccctctagatattcttatggatgctttagtttacttttcatattaagtttctaaaagaaagatcagaaatttggttttaagaggtgagacagtgatctaaccatctctcataaggacagcctgtgtattaaagcttaccttttgctaagtcataatgccacttctgtcgcataacaaattcctactaaaggtctgatcacacgcattctgttatttgttcacacttaacatcaatgtaagaaaatattaattactactgctttctagttagtcttgatatttgtcagggtgaccccccttccttatttttcagatgtgtagtattgctggttactttaagtttagcatgttctacaaaaatcctataggattttgattggaagtgcaatgaatttatattagtttatggagaacatatttatgatatcaagtactccgactatgcaaatgagtatttccatttatttattatctattgataagttgcatattttctccataaaaaatcttacatcttgtcaaatttacttatttctccaggtatcttggtttttattgtaaatggggactttaattacacaaaaatattacactcaacactcatgtactttccatctagctgtcatatcttagcattttgcagtacttgatcagacataagaaataagatacgaatacagctaaagccccctatgtattcctctttgataacatttccctccctcttgcttctcagagattatcactatcctgatgttcccccatggtcatttaacagttttgctacatattgtatccatacaatacagttctgtacattttataaatttatatgaaagtgtgatactgttcagtccatgctgatacatacataatcctaaatcctagttcattcattttagctgtcacatggcattccattttatgactagcacagttcactgtccattcactctggatgactagttaggtttccaattttcctctctcacaacctgctatgaataggctggtatatatcattttataccatgtaaaagctcttctagggcagaaaatttcaaactttcaaactttttaaccaaaaaaagtcccacagtgaaaagtacattttacatgcaacctagtatatacacacacactttgctaaaaaagacatttcaccatatgctgcactctacaatttctctaaactgagggtcgcgaaccgtgagtgggcatgaaatcaataattctaacaaatgtttacactaatgtaaccacaatccccaaaaaaacaacatttccagcacctcagatgtctcccttacgttccttttcagtcaatccaccttcccccgtcaggcaactactgacttctattactattaattttacctgttccagaaattcatatagatggaattataccgtatgtactcttctgtgttttttaacacccttttgaaagttctcttgtattcatttcctaagaatttttgtcatgaacaagtactaaatgttatcatatgctttcccgttgtccatcaaaattatcatatggcctttctcctttaatgtgttaacatgatgaatttcatttacgagttttctaatgcttaatcatccctacattcctgagacaaaccctaattagtcatggtatttttgttttgagtaaatactaacattttacaaactacaatttttattgccatgttctttggtgagaatgcagcctatatccccttctcacactatctggttggggtatcaagattatagtagccttgcaaaataatttttctgtaacattttgtataagattagagttaatccctcacgtttggttgcacttgcccatacggggtcttcatttgtagtctggtgttttgcttgaggacttaaaattttacattggtacaggtatatttatttatttattttgttttgttttgttttgttttgagacagagtctcactctgtcgcccaggctggagtgcagtggcacgatcttgtctcactgcaacctctgtctcctgggctctgcctcagccacctgattagctgggattacaggcgactgcaaccatgcttggctaatttttgtatttttgatagagatagggcttcaccatgttggccaggctggtctcaaactgctgacttcaagtgatcgcccaccttggcctcccaaagtggtagccaccatgccccgcctggtataggtatatttctaaacatgactaagtttttaaatcataatctagtgaagtttctaattcttattaagccaacttggtaatttgttttgctagaaattgtccactttacctgtttccaaatttaaagaaataaaactgttcacagtattcttgcagttttaaaatctcagtttgtctgcagttataccatcccttcatttccaatacatttgtacattctttttctcctctatcagtcttggcactcttttcaacttagttacatgcactaaatcaaagacactatttttgttgttgtcgttgttgagacagagtctcgctgacactatttttgttgtcgttgttgagacggagtctcgctctgtcgcccagcctggagtgcagtggtatgatctcggctcactgcaacctctgcctcctgggttcaagcgattccccttacagaatgtatcttctgtaattgttgggtgcttgctaattgtactcttccaatccttcataaccttgtagttttttaaatctaccctttcataaattactgagaggtatattaaaattttctactacgattatagatttgatttatacctgtaattcttccaattttaccttataaattacacctagtatatcttttccattcctttgcttttaaactatgtcatcatacttttaggagtatctccacttgtaaaatacagttggttggattttttaaatttttgttctcctttagccagcaagtttaatctgagattacatattgggtttatggagatatttcagcttattttctaccatcttattttgtgttttctaatacctatgcatttttcttttcttttttcttcttccctgccttatactggagtgatcaatttctctttatttccacccctcatccccactgacttggagttatacgttattctatttcaattcttttggagagttattggtaaaaaaatttttaatggaaaactttaactcatcattgcattgtagatgaaaacagcctattgaaaaccataaagaattttttttttaagatatgggttctccctatgttgtctaggcttgaactcctggactcaaccaatcctcctgcctcagcctcccaaagtgctaggattacaggcatgagccaccacgcctaaccaagggaatttttaaaaaccagaaacctcatgaggatagggagaagaggtaaggagaaaacagaagcaaaattttaatggctggaaaatgggtgagcagtaattgaacagatcagaaactactaactctaggctagctgtaggaaaagctgaaaaccattgattaacacagaaacctcaaaaagttaaggaaccaacagcaagtcacggcaggaactgagggccaggcaggggaaggaataataggtagcacttgttaagagctttgtagaaaggaattcagttcttagatttccgcccctactgtctctggataactaatcctctgcctcaacgtttactttctgcaaaggggaaaacaaaatccctggactaggagatggcctgggtataagtaggaagaaaagagggtgtgaatgaacatgagcacgctgtgttaaatgtcgactcccaaaccccttcctccactgggttttggctcccaaatactagcagccagacctccgcccagttattcagatcaaaagacttcactagggtacctgaccgacccaggaggaaaggcatatagatgctaatattgggagtttaccaacaaacagcctgcctgctcagatccctctccagtgaaactgaaaggagacaagtttcacccacatgttgagtttttgatcagctttttagatccccacttcttaagaattactttatctgaggaaaaacgtcaaacaaaaccagaaaaattcagcttcaggaaaagactatacagagaaagaaaacatttttaaaacatcaacatggccagagaaataagactgagcaaccctgaagaaagagcagcatgctctcaaaggcagcattcagagaacttaacagctcttgcatagcttgacagcagaaacgggggaaaaaaatcaatagaagtgctagaagataaagtagaagaaatcttccagaaagtagaaaagaaagatgggaaacagtagagaaaatgaaaaaaattggaagactggttccagaggtccaatgtcccaacaacagttccaaacagagatgcagagtaggggagtcaaatagataaattaagaaaaagcccctgaactgaaagatgggagtttctagatggaaagggcccatcaagaccccagtaaaacagatgaaaacaaacctacatgaaggcccatggtagcaaaaccagaatgccaaagacaaagaaagggcttaaagtttccaaggaggaaaaaaaataggttatatagaaaacaatcaaaatggctttggttttgtcaacagtatactgtaaacaaagtcaagagagcaatggcttcgtaattctgggcttcataatttttcaaaaaaaaatttccaacctagacttatgttagccagaacaaaggcattttcagacatgcaacatctccaagtatttaccgccccacccccaacacactctccaggaaggtcctgaagaatatgtctcatcaaaaggagatactagtaaaacaaaaaggaatacgatctacactcgaacccaggagtgcaaggctgcagtgagccatgatcaccctactacactccaactagacaacagagtgtgaccttgtctcaaaaaaaaaaatacacacacacacacacacacacacacacacacacacacacacacacacacaaagaataggagatctaacaaagaagaaaaaatgaaggcaatccctaatatgctagtgagggggaaatctcagaatgactgcggcgtactaggtgtagaggcaaccagtgcaaatcggagcaagctaaaaaagacgaagccaaaacaacggcagccttctctccaaagtgaacactgtagaagtcaatggaagcataaccttcactgattagagccaaatgataaatggatgggggtgactgatggggccataaagaacagctttgtaccactctttaccaatatctcagcagatttctgattccaaagattacaacgcaaaagaaaaaaattttgcctaagtggaattcttatgttagtacatgtttatatatgtatggatttctttagaccagtgctatccaacagaaacaggatgcaaaccacatattgttaaattttctatcagccacattaaaaaagtaaaaattggtgtgctttagtcagttcaggacggtataacaaagtactacagactaggtggcttataaacaacagaaatttatttctcacagttccggaggctgcaagtccgagatcagggtaccagcatggttaggttccaagtaaggccctcttctgggttgcagactgccgcttttttcaggtatctacacatggaggacagaatgctaacaacggtctcttttataaaggcactaatcccattcatgagggctctaccctcctgacctcaatatctcccaaagatcccatttcctgatgccatcacagcgggaattacaagatgaaatcataatttaataattttattaatctaacccaatatatccaaaatactatttcaattcgcaatccgtattaaaaaccattgaaatatttaacattctgtttttgtactgttagaaaattggtgtgtattttatgcttgtggtccatctcaatttcaagagctcaatagccacatggtggctagtggctatcatactggacagagcaactctagaaggataaacgaaaagctagtaacagtggttacatttctggaaagcacaactgggcagcaggaggtaggagatgtaaaggaggcttacttttttcagtatttgctattttgttctccttgacttttataccatgtgcatgtgttattcgaaaaaatgaataaagtacattctctaaaataaattacaaatgtagatattctttgaactactcctagaaatctatcttacagacatacctgcaaaggagcaaaatgctatataaacgaagttatttgttgtagcattgtttttaataccacaagactggaaacattcaacagaggactgatgatatattcagacacccggccaggcacagtggcttacgcctgtaatcccaaaactttgaggggccgtggcaggcaaatcgcttgagcccaggagttcaagacaaatctaggcaacatggcgaaaccccacctctacaaaaaattttaaaaattagctggatatggtaggcatgcgcctgcagtcccaactactcaggtagctgaggtgggagattaacttgacccctggcagtcaaggttgcagtgagctgtgatcacaccactgcactccagcctgggtgacagagtgagacactgtctcaaaaaaaaatttacagacacccatacaaaagaatattatacaacccactactccaaaaaagaagaaaggcattcattacatactgacacaaaataagatgtactattaagtgacatatgtgaccacttgtactaaaaggtaatatacacacaaaattgttcatagatgcataaaatctctggaacaccacacaaaaacctagtaaagctacttgcctttgaaaaggcaactgtatggcaaagaacagaccagtaaagagactcttcactgggtatccctgaattttggattgcagtcatggattatgtatacaaaaattcactattccacatgcagctgtagatgttttcatgtaccctgccttgccttgctgtgatattaaagtccatctaaagcctactgtttttccagttcctccatagagaggtctgaggcttctttctccaagaagccccagatgtttcaatgataccagaacacttttcattttttaatttttttaagcacacagttcccacagttctgtctcctttcattgaatggcattataacctcagccccaactactgaatcttatctctagtaaatcccccaaggccacacttcccttaaagttgactgatttttctaagtttctagtacctgggcactttctctctcaagatcaactgtatacataagagaaaacttttatattttatccaacattttcatctgtttacagtaagaagaatgggcctaacttgtgtctgtgtcattttaagaaatttagataaagacagtataaacaataacagcaaacactgaagaaagtatgatcactgagaaaagactgctaaacttgacagttcatccggaaggccagtaggaagggaaatgtgaaaaagaatggttaaaaaatatgtttgcaaagttgaagtcaagaacagatagtgattaaatgtagaaagcaaaagtagattgcacttttaaaaggtatggagggaagagaaatttcaaatcttcaaactgcaggaaaatacaaaatattccccaaatacctatgtgaatttttatttagaaagaaaaccaaagttaattatttcaacaaaaatactttaaatatgatggtgctgcctcatctagaacatctaaggtcccactagaaataatataaaatcactgtgcagtcaatcctccttatctgtgggttccaaatacatggattaaaccaaccatggataaaaaatattcaggaaaaaactgtgactgtactgaacatgtacagacttttttctcatcatttctaaaacaatatagaataacaactatttacattgtattagatattaagtaatctagagaggatttaaagaataacaataaaatgtgcataaaacaaattctacaccattttatacaagggacttcagcgttctcatattctggtgcttgcaggagagtcccggaaccaatcctctgtggagaccgagatttttagcaatctatgttcaaacatactacaaggcagagaaaaaaacagcagcatcaatgacctggaattgtataactgttttagtcaaataaataattcattagtaaccaggataatagaaaacctcaaaaaaattaaaatacataaaacccaattttttaaaaacagatttttcaattctcactacaactatgttctctccaaagcgtaagctagtaaggaaagacactgccaactggaaacctaggtcggcccccatggagaatgatgggtcatgtcttttaaacaaaagcaaacagaaaacattcatgtgttcaactttatggactgtcaaacctaatgcaagcttgaatttaattcaagaaaattattattttagcaaaagtccacattaaatagggactgctgtgtaaagagactacttatttttttttttttaactaagagttatattcctatcacctataatgagttttgtggaatccacaactctataatcaacttgtaaacacgtaacttacatattggtttatcattcccagattattaaaaaaaaaaaaaaagcacctatgacaacactacacaggcccagactcaaatcagcacaaatataaagtacaagtactctaattgctcttcaaattcccaaagtctatcctgaccctcttctgaagcagcaactaataccacgtcaattcacgtgagtggggtcctcaggccataaaagctcaattaaagcaaagtctagagtagtgccacccaacacaactttatacaatgatgtaaatgtccttgggtatctgtgctgtctaatacagtagccatcagctgcatatggctatctaaatttagattaagtaaaatttaacattcagtttctcagtcacagcagccacatttcaagtgctaaatagccacatgtggctggcagctacctgttaagatagagcaggtctacagcaaaaatttctccaagacctactgttcttcagctgtgcttcaaaggcttcctggtggtgaggatgagaggaaaactgatcaggcaggacttcaacaactgcctattcttccttccacaaaacagctttactccttttatctgttttacatttcgaaattctgcatatttctctctaaaggctttctagttgctgctgtgtgtgcaggtgtgcacatgttttaagtctgactactactggtttcgagcagaaatggccaatgcacaacctcaggccaaagctggaccctcctgataactaaaacattttttaaaaaaaagtttaattgatcagctaacatgaactacaacctaactacctgtctattaagaattttaggccgggcgcagtggctcacgcatgtaatcccaacactttgggaggccaaggtgggcgaatcacctgaggtcaggagttcgagaccagcctgaccaacatggtgaaaccccgtttctattaaaaatacaaaattagccggacatggtggcgcatgcctgtaatcctagctactcaggaggctgaggcaggagaactgcttgaacctaggaggcggaggttgcagtgagccaagatcgcaccactgcactccagcctgggcaacaggagcaaaactccgtctcaaaaaaaaaaaaaaaaagaattttaaaagtggatctcaataaggaaaatttacatttactaccacagataaagtatctctagtcaacaaaagagtttcaatagttcactcaagtcaaggcagaaggctcacgggcccagcttccactgcatcatttatgaggattttatataggaggctctgcaaaaaagatttgccaccccacattttcttttttttcttttttttttttgagacggagtcttgctctgtctcccaggctggagagcagtcgcgggatctcggctaactgcaacctcggcctccccggttcaagcaagtctcctacctcagcctcttgagcagctgggactacaggtacccgccaccacacccagctaatttttgcatttttagtagagacaaggtttcaccatgttggccaggctggtctcaaactcctgacctcaaagtgatccgcccgcctcagcctcccaaagtgctgggattacaggcgtgagccactgcctccggcctcaccacctcacattctgaaatgaaagacgtgatgaggatggaacgtttccttgatatttacaagaccttaaccattatgtctctacagaatttctggaagtagctgaagcagcatatgaaaatgtagtttacttttaaacataggcaaactataagatcacagattcactatgctacttcctcagatcaagagtcttttttgacttaagagactcaaactaatgaacagatggaataccagtggttcacccaagattattcctactgaatacattaaatgtgaaactacatcccccttccccacaaaatgagggaaggtatgacactgtagattattcaaggaaatgcaaatttttacattaaggtagacacgtgtactaaacagaagcaactaaagtctatcctcgctttccactactctacagccttgaggccaatgtaaaaccagattttgaaaaatgacagggctacctaggataattagtgacaatttcacagtaaattcacaaactttgataagaattaatcacgtcagaatttctattttcttaagactacaaacctaaagatacatcaagcacctgtcctatcaatgtgcctcagttacaaataagaggaacccactgagccaaggagaaccactcacactgtacaatgtgaggcaagcacagaagacacagaattgccctaatatttctggctatctgaccaaactaaaggcagtgtctaaatccacctggcttggaaaaattatattctccctacatgaaattgctgaactgaagctgcgagctatctttgagatgtaaatctagaatcaacattgaattatgtcctaactgaatacatcacaattacaccaacctgaaaaaatgatcaaaattgatcaatgacaagcaataagcctctaactatgcatttttaaaccaaaaaggctagtacttttgtactactgctaaaaaaaaacctgattcttaaaaacagccaaggctacatattacaaggtcaccaataattatctgatggtgtagatggtttaagaagtaaccctgaggtaaggttacaagaaaggggatcaaaaaaattatcagtgctaatactgggcagaagtcacatgacaagagtcaagaaaccctcaacagagagactggccaactatccactcttgctttatcctagaaatctcgagcatactctatctcaaaacacagtgaaaagcatacactactgtcaaagcacaagtgaaaatttatatgatactcctgcagactgacaaaaaaattacttacaccaaagaaaggggtgacatagggtgctaccacactgaaacagcctttctttactgctggctaccctttcagcttggaatctgaatggctgtctgaatggcaaaacaaatgaaaaacatcttggtcataacagctactgtgatctttcatgaaataagccataagctatagcacaatcttcaacccctttaagaacatttcttaatcatcctgagtgacaatctaaagtatattacgtagattattgcactcttaaaaagattttcccaaacatgatttaggctaattgatgaacattcattactatgctttcaggtctggtcctgcactcaatggccccagacatgctagtcaggctttgactatttttgtgtcttgtagattatctctattatcctcaccgagctgttatctgttttttctgacaagagacactaggctaacatcctactccccagcccccaccacaccccctctaagcctcccacagtacccataatctacttgtttctaatctagtgcaggtttagaagccagataactttgcttgttagaaacactttaaataaatgccaacacattcttattaagggtctccaaggctctcctaagctttaagctatggactgggacaatttggctatcccaggcctttgttgttcattgtctgcttctcaaatacattttacaataggtccataataacagtgtaggcaaatcatttggattagaaagagcccaagtaacaaacccacaactacaagagaggaagaaatcatttgggaggacccttatatctcaggcaatgttctaggtacttgaattgtgatcactgaataagaggaaggggttagtacttccattttgtgtcagaaaaccaagggcctggggttggtagtaaattgcccagtattgtaactgagaaacaaaatattaggctagggctctctgattccaaaacccaaggcctttccactacatgagactgctgtccaatcctgggtctcggtttaactaactttttacactattcccgatcctttcactgagttattcaactctgctttctttccttaaccagcttctgtaattaaagggcaataagtgatcaaattaaggtcagatgaagcttagctctacaagtgtacatctgttcagcaataaacatgtttctgaaagactggccgtatcttcagtttgtatagactgtgcaaaactggtgccaaggtccccccaaaatacacagattgttcccagtgacactgagtaacacttcacatcttccctagtgctatctgctacatgttacaggaagcaaggcaagctcactttaggaatggctcagtaatgcatgtgcccttgatttgtacactaacaactgtcttactctaaacactggagaatagggcaagggacatgagtttccacttttctaactccattaaggaacaggggtgtacttgtttgctgttaagagactttattgcctagtccagagcctgacacacagaaaaagctgtttgttgaataaatgaataaatgtatttgttgaaaataaatgcatcggccaggcgcggtgactcacgcctgtaatcccagcactttgggaggccgaggtgggcggatcacctgaggtcgggagttcgagaccagcctgaccaacatggtgaaaccccgtctctactaaaaatacaaaatcagccaggcatggtggcgcatgcctgtaatcccagctactcaggaggctgaggcaggagaagcgcttgaacccaggaggcggaggttgcggtgagccgagatcgtgccattgcactccagcctgggcaacaagagtgaactccgtctcaaaataaaataaaataaaatatataaatgcataatctctcataacctctcttaactggttgtgaattccttacgtttcacattttctgacatacctttggaatacttaggggaaaacatcttacctctcacagaaactaagggcctaaaaatggctcttctacacccatcaaaagactaagaatctaaaagacatgcccccctctaccctctaaaaatgactctttgtcctaagaatatgaataaatctccatctgccagactgcactaaatacagcttttatatgcattacaaaaacacctgtataaaaaagctgctacaaaacgaggtttttggagccctaaagcacaaaaccaacagaatcaaaaccaaacaagaacaaggaaagacttttaaaactgacagtatttgcaaaatgtaaaaattcaataggtctttggccagcggtttacacagctaaaccgagtttttccattgacatatattcccccaaatgtgaagtaaagattatagcaacatgattctaatatttacaatgtgaaaatgaaaaggggacaacaacctctggccatcttgaagtagaatagaaacaacctttgttcctactaaagttctgttgaaataccaaaaccatccccaatattcctacacaagagttaaaacacataccaagcctgataagacacaaacaacaggaaattaccctgcacagtttcttaaaagactattatttcatgaaacttacagactgtgtagagacatgaccacttatgactaagtaaacgtaggttacaaccttgaaaacccaaacttttgttgaacacctacaatgcttgtggccgcactttagaaggtgtggctaagtataaaaaccaagctctaagagcaatttcttactaaaaccccaaaatgaacgtttccaatcacattacattaattaaacctggccagtgaacagccttgaactcaattaaatccagcagagtttaatatttatagtaaaagtgggcacactctttagaaatgccgaaagatgtgaactatttatatttactacgacagctaagtttacggcaacggctaaggaactttaaaaataaaagtattacttttgaatttaatataaacgtttgctaaatgaccttctggcagaggaaattctttaaatatcttgtatgggttttccgaaggcaaattttttaaataccctcaaactatggtacatttatgaagcccattttaaattacttctcccatctctgcttcatctgcttcactaattcatgtattaaaactgttgaaactccatttaactatttgactaacttctctgtaagatggaaactttttaaagggtgttaaagtagaatagcaaattttcagcataataagagcaaatttattactaggctcaaggaaaacatcctatcagcgattcattcatacgaaactatcaggttcaattcatatgaagtcagaagagagaaaaagaattttggaaattaaatcacatttcaaagaccatttctaaaaagatgtaattattccaagttatttatttattaacaattattttacacatgtcgttttaaaagtttcacaaacccaaatttaagatagtccaaattgcaacaaacaagacatgactttgatggaaaatgctgcttgcaaattcgttttacctggaaatttcttttttaaaggtatggttgacaacacactggtggtattttgcttttaaagggtcaagagaaaggaataacaaaaccaacccaggcattctttttctgtttaggatcaaaaggacattttaaggataagtaaaagacaaaagtacctgacccaaagacaatatccccctccaagagaacaaagtaagttgcaattttaaaaaccaagtttgaaatacgagaaatcacttcgagggctttccaaaggcgtgtgataaaaactaataggctccacccgcagaacaactttcacaagtgagtgaaggatgatcacagagttatcagctgtgtgcgtgtttgtgagtacacacaagccatggaaaacccgagactaccactgttaacaaaggttacgagaccaaaaaaaaaaagtggaggcaaagtattacgcgtccctaacaaggcttccccacaactcctgaaacaagagctctggcccttcggctttaaaaatcagaaccacaaactatggagtgtgagagcagcgaggggaagggacgcaggcagcccccgcccccgtcagcctgggcggcagcgcagtgcaaccgagccccgtcccttcccggctctccggccccgaacccgcacgcccgggccggcgcacccacagcccccgaactcaccacaccccagcccccacccgcagcggccatgtgacacggcccatcgccccggccgcggacgcacgcaaacacttccctagctggaggcccgcgggcgcccaggctttacctgcaaggtggcgccaggtcccgccccgtcagatccggggggtccgggaccttttgttccttcctcttccgatgggatggagggggctgggaggggaagaggggaatgggcgattggaggcggaactgaaaacactcccggccgccgtcttcccgccccgcccccaggcccgggcccggccggcggcccgggcgcgcgggagggtaggggaagagaggggaggggaggggaggagagggaaggggaggggagggagcctggccgccgcccgcggggaaggagggggtgaggacgcgcgcgcccgcgctgcccctcctcccctcaggcgcgcgcccgcagccctaccggccgcccgcacggccgcgccctcccccgccagcccacctccgcttccgccctccgccctcggccgccggccgccgcggcgccacgcacccacctcccggcggctggcgggctgctggctggcgagctgcttctccgccgccgcggccgcgcgggtagacccgcctgccaccctgggccgcgggccccgccgattcgccggcgcagccccggggctggcaccctgccgcccgctgattggcgcctccagccgcccgttagggcgcgaggcacgccggccgaaagccgcgcggggcgggtatggaagacggagggagcggaggaggaaaggaacgaggccgagcaccgcgggaagggccggggggcgagcggggcgcggggagtcgccggccaccgcctccccacctccctttgcctacggcccgccccgcctcccggccg

SEQ ID NO: 1987 - DNA, 98052 bp, Homo sapiens; identical to SEQ ID NO: 1986

SEQ ID NO: 1988 - DNA, 97505 bp, Homo sapiens
taacatggtaaacaactcaaatggctttcttttaatgctaggaaaactgtccacctttcaacggtgacagggctgttaacacaggtaagagcaaacaaggtaaaaagtgaaagcacatacagatgatgcacacaaatatatataaaaattgaccagaaatcacaggacatgtaagcaatgttttcttaagcagaactttttttgtactttaaatagactaaaatatttggtgtaggtgggagaaagacatcagtattcaacaattttaacttgaaaaccagctgtaataaagcctcagctcattgtttaataaaaataaaaaaggaaccacatcgtacttttgacaatcatagaacgaaagctcacaaagaacacatttaatatctccatcacagtgcaccaaggatgcagccactaaggacttccagagggaaacaagaacagggtctgcatccatcatattgcattacaaagttaatgccatcagagaaaaaaaatctcacctcacgtgctcaatgttctagctggtaagcaccttatgagtatgaggctacaattgagagaaactgctcagtctgcatcaggacacccaattccttcacttgccattggctgatgcatttaatcattttaacacaacattcacggaaaaatgttaacaacacattctggcttctcgagcagaacagactgggaaatgcagtagacgccagagcatcaaaggccatgtatttcctcacaagaaaagaaatctgcaacaattggtttccttttactatgaaaaatgtaaatttcagattaagtttaaccccataaggacgcatgatttgtacttacatatacacataggttcagaagaacttagctatctagttggcctcttctctgttccattataacatcagttaccttagctggatcactaagtgtgagtctcaccaccatactggtaccttcagctattacctgtgttataaatctcatgttccattcaaagtactaaatgactggatggcacatatcccaataagtatcagaaatgttgacagccatagtgcagctgagtttagaagcaactatgacaacatagggaagtaaggataaatcacaagaacacctaaggtggtcagctccttctggtgtgcctgggacttgttttgagtttagcaaaaactttacaagattaaaaatcagagcaaatgaatttcttaagttcaagatatgtactctcaatggagaatcgcttttgggcagtggttaaggcctctgatgtgctacttatcagaaaaatccacatatatacaaaactctgctaaaagttttgtatccagggaaagtcccgcatccagggaaaccctcaatcccaggcactttagggcagctggtcaccctgagaacactacccactcgttccttaatatcactagagaaaaggtaagaactttcaagggcataacctttaagggcatcagtccccaaaatatttttacatcactagctaatggctagttcctctaagcttgctaaaaggctaggaagtccagaaataccttaaacgtgttaactttaagaagagttggtagtaatcaagcaaattagtgagcagtgtataaaagctcactcttgaaatctgttttcagacaaatcttctaaaggttcttctagctttgtccagttatatggtattttactgtattctctttttgcaattaatccagttttgtatgtcttttctttcttttttaggtgaaaatattctatgccaactgttttccacagtcctgcattatatattaaaacaaaggctgccagctggagacacagccctccgattacaaaggcccagaatgttacttttaactgtgctccaccaggaggtctggccttgggaaaagatggcgaaaggaatattctcagatatgaacattttttattctgcctacaatgctgtgatctagttcaacaactgcagaactgttctcatcttaatcgctgtagtttttctttctttactcttttgtataaaaggttagtgtcacagcttcactatcactaataaaaagatacaaatatgcctttcaagtcagggttggaaaagcaaaactgaggtgtgaggttacactggtctaagaaagtaccaatttgggttctatattttgtcaaacagttgggtttttaaaaaaattcaaaactcatgcatgttacctacttgtcatgtgtgaattatttctcacaattttaattaatctgtgtgtatattagttatataaagcaatggatttccacattcttaaagcaggaacctatattcaccagaaaaggatcctcctgtttctcatcaaattttttttcagctcgaacaatccaagattgggaatagtaagagtggcaaacaaatgttttcttagggacttactgagaaaagaaaaaacttactgggagaacagagacttagtaaaatttctattgctacagacaaatgctaaaaaccagctttataataacagcattataaaggatagaacttaatatagaaccagaaatatggcaagttacctagtgattaacattgtaaaatagtcaaaaactttaaagccacagagaaaggaaaacaattatgaaatggaaaatatataatatttaagtacttttataattctaaaacttcacttttgtccttaaatcaatatattacggatttcattgttcaataaattaccatctttaattaaaaataagtaaatcaaagagcatatttggagaaactaagagctgttaactgtttggagggtaaaagaatacttttctcgaaatttttttgaagaaaaatctaaaagccctctatgttgagttaatacaccttctgacccccatcatcagtggcattattcttccaagggactcttatatctaagcaatggtgaagttctggattcattatggatctcatggcaccaaaccaactggcactgaagttaagttaatatactccagcgagatcacctgtgggtcaaggatggcccagagaatcttggaaaatccatttatattgagcaaagatctgaatcaccttcaatcaggctgtaagatactagaaaatttgaccttgtagtagtatttcccagggtaacttaagcagcaaccttgcaccagaagaagaattaaagagggagcaatctagtattatcaacaacaacaaagttaaccctaagttagtacatcccagaatctgctggatgtataataatttagtaacggggtatatggcagagctttctttgatgttaacaaattttggctgtgattcttagttaccaagttgccaaaaaatggtatattaaatgaactgccaaatggcagattaagaaaattaatgtactccaatggtctgtccatgaaaggaaaatgtacacagacaaattaagaacattttaccaggatctgagatttaaacaatggaacaattgttttaactgttagaatgaccccaactgttaagtttgtctatgagtgtatatgtatatataaattcatacacatatattatttatttccttcttaaaaagactgaggcagttctgctatatatagttagctacaatattcaagataaaacagttcctactcaaaaaattacatgaacacacgagataagttcttatcgtaaatgctatcatgaggctatctagtatagctcatatttcctggttgtaaggctcaaaacacaggaattccactccaagagataatttgcccctcaatccctacaaagtgtagtctaaacaaacaaaatggtaataaaaaattgaaaaggaagatataaaaagaactcaatagcaggattctgactacctctggagaccacacactatcattattctgactgtcttaaatacaacaatccaatatgccccaagatggaaatctggtatcgtagggaaaacattggctgcaactgtcagaaaagttcataatcttaaacataatttatgccatttgccagtcacaaagacatttactgaacagaatttttgagccatttgtaaaattaaaatgattgatcaatttgaatagcaaccttcatgatgaagaaattaggactctaggtatgaaaagcatgttccttttttgttaataagttcaaaggagagaaacattctgatatatgcagataaaaatatggctaggctgggcgcggtggctcatgcctgtaatcccagcactttgggaagccgaggtggacagatcacgaggtcaggagatcgagaccatcctggccaacacggtgaaaccccgtctctactaaaaatacaaaaaattagccgagtgtggtggtgggcgcctgtagtcccagctacttgggaggctgaggcagaagcatggcgtgaacccgggaggcggagcttgcagtgaaccaagatcgcaccactgcactccaggttgggcaacagagcgagactccctctcaaaaaaaaaaaaaaaaaacaaaaaacaaggctaacaagaaagaggataaccagcaagtaccacctggatgtgtgttgtcaggtagaaaggaagaataaaattcaggcaatgaatataatagatttagcaaagtaaagcatatgaaaggaagaaatgtttgatatgtctaagtatcaatgccttcgatcagagtaagaaaaaagtattcattgttcatgtccacagactagatatctaaagagatacttggtgggcaggggcttgggagggaaggcgcaaattggaatgttcagcttttaaagtaaagactgtacatgaagacatattttatgtacagtgaagattgtcttgtgttactttatatcccaacataaacctacgccaccctcagacgaagagggtatctaacactgaataaatgctgaacctatttagtagttaaagaaaaaagagaaggatcttaaaggtatatatgggaagcttttaagaggtagagaaaccaactgggtatatattttcttttatttgatttcaactagcaagagactaagactgatgtttgtttgtttgttttaccttcaaagtcttagtcttaaattgacaagggcacaaaaaaagtgaaattaaaataattttaacaaaagggaaagcatttgacagtgtttaaaagacagacaaatcaagcaaaactcaatgtggcttaaggtaaaaaatacaactaggtattaaacaatttgtaaaaacttacaaagaaaatttagctttcaagaaaaattaggcagatttccttctgccaaagtgacaggtcctgaggaaaaaaaacacaacctctacaagaccaagcacagctcaagggtcagggccccgtcctagtcatctttttattattcaatatccatcacagtggctgggcaaacaacaggcatcaataaatgtttactaactgaatgtgtattataaggtataatcggtataactgatatagctcaaatctaatcatgaaagcttctttaaagtaggataaaaagagcacaatcagcggtattccagaaggtaggcctaaatccagttatatttttctaatcgttgaccagtggttataaagactttctgagcttctttttaaagcaatgaaactctttccaaaagaaaccccatgcagttcttcagtacagaataaatatgccactaagtcagtgagaactccaacagcctcccctaagccagcccccaaggtgtctctgtggaacctactggaaaaaatattactcatcttagaaatgtgatagaaagcatggccattcggttctcaggtcatcattcctagaaaattaacagtattgtgaagaataaatcctaagtaatgttgctaatttaaataaagacaaaaattcaacaaagaggggattctatcacttagaaaaatgaaaaccacacctataaatggggggaggggcagaaaacaaaaaaaaaatcaggccacagtagataaaatacaaaaaacatcatctcgttaaaaagcatcaaacacattcacacaaatgtaattacaaccaggaagtaaactgctcaacaggtataactgctcaataggtgttttcaaagagttgagtcccaatttcatactgtacagaaaaatcgcatcagaactgtagagatgcgctccactactgaaacagcatagtaggcactgcttgacctaacacagtaatgcaagagtaaccaccaagatcaggaccttctaccactttcagagttgttttctgcccctacaactgttccctaacaccattacaagttctcaagtaagaaaaagaagggcagaggctccactgagtatctcctacaggcctgatagtggtattacctaggacatttactctgctcacaagatgggtagtggaagacataattactggacagcacaaagtctggaagcaagcagcagggcactaaaacagtgagagcttacacaacaaaagcttgttaaattaagtagtactgatgtggtgcaaatgaaatttttacagcaaaggttgaggaaggagatatgttagtgagaatcacatgaagcagactatcacaaaataaggccaccttcaaaatgttatgaactgtagaaccattctgatcttcaagtttggatttgtatagaggtttctgtataaagcattaatacctaatcaggagtttcctttagtgtgaacctttttgcatttgatgctattctctttgccaggaatgcttatctcccctggctcctcacttggcttgcttctttaatgtcaggtgttagctcatgcatcctttccttagaggctttccttgatgtcctacctgaagcatcccatctgttattctccagtacagtaccctgtttatctccttcatagacaagtaagataattaagggttagtgtaactgctgtctcagcaaaggcaggaactgtagttgtcttgttcacctttacccaaagactaagaaaagttcctggtacaaacaggtgaacaataaatatttgttgaatgaataaaaaattactataccaaatttacatgaacacatacatatacacacaaatataggaaaatggggagtacccaatagaaaaccaccaaatgttgaaagtattgaaaatgatacctatagagacaggtggatatgatttcaaagaacaagtaccaaagacagcttcaaaaatatgaaaatttatgaaaagacgaccaggagtggttattttccatttctactaagatgcaaacaagaagaaatgtttaaactgcaatgagtcaacatcagacataataattatttgctgcagaatgaactagcaacagagtttcggaaatctcctctcactacagagcatgaaatattgtcaatcacaaaaccaggatcagttaagaacagctcagactgcaggtaacttataagctaaaaaacttgctaaataaatggcttttcccccaatttttaaaattctgaattcataattatgtgtagaataacaatcaatttataaactgaatacaacatactttaaaaacagatggcccatatctgctgatcctacctcagcatcacttttctaggtattttgcagaaacaattacatttacaaaaggcccatttcataatgcaatctggttactaaaccaaatcaaactactcgaagagcagaaggtctgctgttgaaatattgtaaaatacctttggaaaaacggtatttatagattagcttttttaaaaagggataaatatgtggaagtaattctagcatatccctgaaaataattatactgccacctatgcattttttatgaggtggaaggataaatcaacagactgctagattatacaagccaattattcctgttgaaatttgggcataagacaaagggactttctccatatgaattcttactgtatcccagaattaactggtgccagcagtatcaatgcaactattactggtgatgatgtcatgttatgctgttttgattatgaggacaaaaatgggaatggaaaaaagaggcttggaaaggttttcagtatggtttccttataataagatttagcagttaaaaaaaaaaacaaaaaaaaacaaaaaaccacaaaaagaatgactgtttaagccccactgaacacattaaggtcaaggatttcaaaagttaatccacttttcttcccccaagagtttatttttggtaaaaggcagaaaaattagtttttctacaggaaaatctgcttctaaataatttgaaaatcttgatatatattatatattaaaaaagacacacaaaaataacagagaagtgggaataacagattaggtactgcaactttataaaggtttgcctagatcaagaagcagcgcacacacacacctcatctatgcaaactaaaaatgtatataaacagcacaatactgtgatactggatcatgatacattacctgtacacataactactactgttattaataaacctttgggacactcagttttatgcccaataagacatcattaagtctttaaaatcttctcttcctctttaatgggagagtatttctagacactaattttcccatctaatattcaaatataggaaacagattccacaaggtgctttaattgatgagacctcaagtgctgttttctctcttgaacttttggatagtaaacagtccatagggaccacacacaatgctatgacagaagagttgttacattaagtcttttcatgggacttgattggtgaagctttatgacatgcttgagcaacgcactgaaggggatcccatctgagttaatactttgtccaaccactgtagaggtccattcagatgaagttcaatccagcaaggagtacttgttaccgtctgccttctgtttaaaagaatacaggaaaatgattatgaaattcaagtccacaggcagggaaaatggctatgtttaggtacactgcattaaaaatttacagaaattaaaaggttgtgtatataattttggacacgattattccgcaaaatggttgatcctcaaagtcaaagtacttctgatgaccttgttttagaagtgatttacaagaacatctttttctcatcgcactaaaattaataaggtgatcttattattcaccatcatccaaaatggaacacctgagagagaatgtagatactattaatatcaggccagggccaggcgtggtggctcacacctgtaagcccagcactttgggaggccgaggcaggcggatcacaaggtcaagagattgagaccatcctggccaacatggtgaaaccccgtctctactaaaaatataaaaattagctgggcgtggtggcgtgtgcctgtagtcccagctactcgggaggctgagacaggagagtcacttgaacccaagaggcagaggctgcagtgagccgagatcatgccactgcactctagcctggcgacagagtgagactctgtctcggggtggggggcagaaaaaaatcaggccaaaaggagacacgtgaatcaggattgtccaagcaaaccaagacataaagtaactgtacttaccaaatcaaccacagaatagtagatactcaaatatcaaacagaatctaagtaaaagtataccaaagcaaaaacaaaattttggcccaagctaaacccacaccacagagagtgttaaaagctggaattcaactttccctgccaaagccaatgaacatccctcttagcaacaccattcgggcttttaatagtgcttcaacaaaaggggcaactctaagagaattacaaattattcaatgacatcctgtcacttccatgcgctgattttagttccatcttatttgctatacagaataaagtcaataaatccacttgcttctacaaactaacagcccttcaaatatgagaaaagcccattatcaactcttcatctccaagcaacacatgttcaatgtaatttaaaactgtacttccaaggatgtcactttctgaggcagatggtatcagtgccccactgtaccctttggatttttcagtgtgctctagacaacttccaactgcaggtatctgcatttctgtgcccaggaacttctctgatatacccaaaaaggctagaggtgccaggaaagaagcatccccaggagcagccctcaaccaaggaaacagaaattgacatttacatgcccagcacttctgttcccctgggtaggataattctgtagactgtttactgtttcctagagtttccccaagggtgtcagttctagtgacccacccactctggtagatggcttaacaatggtcctggctgccctgttctcccctgtcccacttccctttctagaataatccataatccaggtcacccaaggggagtaggtttaagaaggctgccactcgattaaatacaaattcttcatacatctaaatttcctgtttactacatttcctcatttttgtgctaacaaccaagatgacattaaggaaatttaaaaaaaatagttttagaaacctaaacattaggtctatttcctcagctccagaatgattacagacagtaagttcctggtagctacccacatatccacagatagatggatatttgccattttgatttgtaaatgttacaggaaactacttgattttccaaagtcagatgtacctgactcccaatactcataaaaacatactgcatattactgcttctgtaattacagattttactttatctgtgagttaaagaacagcagagtccacagtgaatgaagaagggcagtatctttaccaagtaaaactgttcttagcagatctatagatacacatggaattctctctgtaattcactcttacttccactaaattcctaccatattttgcattattctaaccttctgaagaacaaaaaaaagtctgacctgaaatcttattagacaatataatttaaatctaattttgctatcaactcaggtcaagtctaattttaaaaaacggcattcagcattcttaacaggtaacaacatctcaaaagggtaataatcaaaacagaactacagcaaaatcacaaaatgaattattctaccaatataactcagaaaaaaatagtgacaagtcttcattctctgatacaaatatataccatatatttttaaatgtattcaacaagtagacctcacattgcacaatctcaaatcagatttctgacaaaacttaagatagacaagcaagtccaaaacaaataaatttggaagggactaaattgctggaagaagcaggaatacaatcactatattacatgaatatttcttaagcaggcatatggagtaagcaatacgaattgaagaaagactaagtattttacttaattcctactcttaaatatggtcaagaagtcttctctctctttgatgtgaaatccaatctattgtttaattcatcaataatctagactatcttatccactgatgacaaattagtttttgtaaaacttaaacataattgttactactatccttataaaagaggtaaagagtccaggagaactatcttccagtcccatctcaaccacttataatgtaaccttgggcaaattatcagctttctatgtctatttccaaatatgtattagtttgaaccatgtgttacctgcaacgatggcaatttcatatatttcaaccttacaaagaatgaattgacaacagaaataataatttttagatactacacttaaaacagcacagtgcctggcacattagcaagtattccttctacttctgaatgaagttcctcctcttaacctacatctagtttgtctcaatttaattgtccagccttatttttctattctccaaactgaattgctatgctattgtcaagattatcacttcccaactctgcccaccccatttatgactattgaaatccaatgcaccttttacaactagatcatgtgccatcaagttttccttgagcaccgtgtgcaaacatctctccttccataaactgacataacccttcatatacaccccttttatgatatttaacactctgaattacgttaaaatgcacgcctgtgcatgttttaatatcttccataatggcagctcagtaatttgcaacagttttgaatttggaggcctccaactttattttacataaagatcagctgactctataacctcattgaaaatagatacaaatgaactccagaatatgcaagaatgcaatgaaacataattacactgtggaaatttaagaaccaaatatgtatttcataccggtattctgctccccaccctttcacaaaactcattcttatggtgcacattctagttagctgatagacggcttcaaaaccctgattaacagactgagccagaagagcagcaaattcctggttgttgaagatcttcagattacagcctatgattaaaaaaggtaaaagaaattgtcaaaagagtatcattattaaaaagtaattttaaaagggttacaagttttagaatatgagcatgcaatcatctactgattcctaaaattagcaacaagaaaaactaagcaagttgacatgataggtttatgtacattattgaatccatacctggtggaattttacacactgttgcagggtgccagccatatctctgattacaattggggctctgcacaaagattgcactatcacttaggcactcagcaaaaacttccccacctatgtagtataagcgcactcctcttcctgaaacaaaatacaaatgagattagttttgtaacatttactatttcagtgtgactttggaagcattttcttggaaaaattctaaaatgatataaggtatttccaggatctttttcacagataatgtctttctgaagtctaactttaaatatactactgtatatttctcccaagtattttctaacaataattttattgattttaaaatacatgtgtactgactgaaagtatttaaacaatgtagaaaaagtacacatagtaaaatagtttcatacaaatgatatatattaagataagtaaaagattgagttaattttgaaggaattcactaatgtttggagaaatatatcttcattacaactgtagtttcttagagatcccacttaatgttaagaaaaaagatgtaaaaacatcaaaaagtcatttgccattttaaaaactatatattatggtggaaacccaacctctagatgtataagcatgattaggtgagaaaaaattctactgggagatttttaatatacttctttcagaatctgagagatcacagatgcaaaataatatgagatataagaattaaaaaaaaaattgtgagaagcagagttctaacatgacacctaagagtctcagccctgaggtgcacatacattctctgttaatcaaacactaggtgctgctgttaaggattttttcagatgtaattaaggcagcaaatcagttaaccttaatcaggcaatcctttaaaagggactagactgtcataggctaagtgattcaaagcatgaaaggtattcaacacaagagacattctccattgctgactttgaagatggatggcaccatgtgacaaggaattcaggaggcatctaggagctgaattctgccacaaccatgtgggtttagaagaggacctcaagctccagataagaacacaagccagctgatacctcaattttggccttgttaaaccctgaaaagaccgcctaacccatgtctggactcctgacccacagaaaccgtgaggtaaaaaactgatgttttaggccactgagtttgtggtaatttgttacacagcaaaagaaaactaatcaaacaactaacactccagatttaatacagaacctggtacggtggttctgttaagactatggaatatctgtaaaacagtcatgcacgtggtcattgggaaaacactaagtccaaaaagtagagatttttcaggctatattccctgatcaatatcacctataaaactagaaataaaaaatttaaaaaaatccaataacgacagcaatctaaaactttggagggagaagagaataaggcagagaaaacccattaaatttttttgcagaaccccaattaagtcacaaaaacaaaaaactattttagttaaagcacctacagcgacactgggtatcttaataagattatccaaatttatacatcaagcaagatttgagaacttccacttggaaccaagtaatagatcttctagtcactatcattttgcagtatcaaaatcacactttgataaccagcattacttctcacaggaggtaatggttaattagaaaaaaaacagaagcaaactactgttaaaagaagttactttaaggtgatgagaatgatgttcaattatgaatggttctcacactttttcacttcatcgttaaggaaatactgaggaccccaaagagcttttgtttatgtgaatattatggaaaatgaccatattagatataaaaactgagatttaaaaaattcatttaaaaatcaaatccattacatattaacaatgtttataaaaaacaactgtatttccaaagcaaaaaaaaaaaaaatagagtggcaacatttcaccatttttgtctatgaaaaacaactatatttccaaagcaaaaaaaaaaaaaaaaaaaaatagagtggcaacatttcaacattcatgtctagtgtaacagaattggagtctcattatcaaatctacatttcatctcttgcaaaatcatatgcatgtaggctctggaatactccactgtacagtcatgagagtatgagagtagaaatggcaaacagcatctcagtactactatgaaaatagctttgacctcacaaactagctgaaagggtttctgggactaccagaagtccccagaccacattttgagatgtccctgaattatattttgaactatattaaatgcagttcttgttttagatatctcatttcagatgaacagcaagcagatttcatttaatatataaactcaccaaagggggaaaaaacctgggagctatataaagaaactgaaaaaaaacaaaaacaaaacaaaacaaaaaaacatgatttataaaaaagtattaacccccaaatctgaacatggcaattttatgactggtagagactcagcaaattaaacttatcttaacacatatttattgaagaactttccagtaccaagggtgccaaataaaagttgaagagtttgcagctgaagcatcaccaggatctattagaagcagtgaagcctgtgcacttaaatgtgtcggcacttaaaccaccagagagaaagctggttttactgcacacaagctcttgatgtggcacaccatgcaatgcctacattatgagtatacagcatttatttttcacaacaaggaaaataaaacatacctatatgccttcttgtcatttctaccgtggcatttcggttaacattggagagtaaacctaagcagaacctctctgaatttgatgggtctgtaaagccatctacagtgagtgagggctgtgatgcatggaaggtttctccaaccctctgatttaattcataatatgctatcgaacaccaaaatgcaggttctgagtaagtaactggctgtaaatctgaaaaagaaaaaaataaaaaaataataaaaggaagaaatgcgtgaacaattcaagccaaaaatagatttaatataatcatctttacatgctctatgccagcctgcactggcaaaagctcaggaagtagacatagtatctgtatcggtttccacagatgataccagattttcagtatttttcacacaaaactccagtttcatagatcataccagattttttcaaatttctcccatgtcattaaatcactttatgttggattctttgttttaccagtagttttagtctagctcctgttcaaatacaaaacaatcataggcaaagtcagtcaacttgccatacttggtgcatttctaaagcacataaaaaagctaaagtggggtaagataaagccagagcaaagattaatgagtcaaaagccacacaaagaaaaacagtaataataaaaggatacaaaatatgacatatttttgacatttgtctattttaacatcaaactcttggtgagataccctagctacaaaaagagaaaacccactcatacataagaaccagaaagcagtaacacacaaagatcatgcaagtagaaacagaccatagagtcaaaagactacttatttcactggaaaactatatatttagcttctgcagtttgactaaaacatatcataaggaatactgcaaaagaaaaaaacctcacaattttgtagaataaattccaaacatgtaacaaccgaagagaaattgtgaaatagggtaaaatgagggcaaaaataataatagtaatacagaaatgtatgtatatatatatatatatatatagtcatcccttggcatttacaggggattggttctaggaccggctccccctaactaaaaacccttagatgttcaagtccctgacataaaagggtgtagtatttccatgtaacttaaattcacgtcatcctgtatactttaaataatctctagattacttataatacctaataatataaatgctatacaaatatttgttatactgtattttaaaatttgggcccagcacgatggctcacgcctgtaatcccagcactttaggaggtcaaggtgggtgattcgtttgaggccaggagtttgagaccagcctgggcaacatagtgaaaccccatctctactaaaaatacaaaaattagctgggtgtggtggcatgcacctgtagtcccagctactcaggaggctgaggcagagaattgcttgaacccaggaggcagaggttgcagtgagccgagattgcgccactgcactctagcctgggcgacagagcaagactctgtctcaaaaaataaataaaaataaatacaatttgtattagtttttactgtcgtattgttattttcattttttcccgattattttcaatctgcagttggttgaatctgcagatgctgaactcatggttatgaagggaccatacacatacacatttgtacatatatgtgcacactctcatatatatattatatatagtatatatatattattatatatatgtataatatatattatatattatatattatatatattatgtataatatatattatatattatatatattatgtataatatatattatgtatgttatatacatattatgtataatatatgttatatatattatacataatatgtataatatatattatatatattatataatatatattatatattatgtataatatatataatatattatatatattatgtataatatatattatatattatacataatatatattatatattatatattatgtataatatatgttatatatataatatatattatgtataatatatgttatatatataatatatattatgtataatatatattatatattatatatatattatatatattatgtataatatatattatatattatatatatattatatatattatgtataatatatattatatactatatatatattatatatataatgtataatatatattatatactatatatatattatatatattatgtataatatatattatatattatatatatattatatacattatgtataatatatattatatattatatatattatgtataatatattatatattatatatattatgtatattatatattatatatattatatatattatgtataatatatataaatccccatactacgtatacatgtatacatatttatgtcaatgtgtatatatgtaatacacataccttttattaattacatcataaaataaacataaccataaaaatctagccataacaggttatataattttctatgaggaatatgatttcaataataaatagattatacctatttcttatatgtgccagcagaaaagacttaataattttgagggatggtgtcaatattctttttaaaaagcactactttaaccacatacataattatttggctattcattaggatccctttctcggatatataaaaaataactcctagagatgatttttattattaagtaggtgatacagtataaaaatgatgaggggaacatatgtgcaacttacccaagctatgattaacaggggaaagagtagtaggagatagttctgctggagagcctaaaacaaaaggatttaaaaataaatgaagtatttccagaacttctgatcaagtaatcataaaactagctttatctggttataattatcaacaataatacaaagataatttaaataccaagaattcagaatatgtaagtgcttaaatttagtttaatttgtggggggtcgggggaagagaagggggggttccagtataaaaggtgcaacagttttggcttctagcccaacagttcatcttcccaaagatatctaatattgacggttccttgggtatctttccaaaatactctatgaaccacataagcaaatacatttttgttctgtgtcctttcttttcatatacaagtggtaaccgtttttcatcttctatattattctatcagattgttcacaatgtgtttccttatttgtctatctacatatcaattagtcacataacatcgcgatcccacattgatggatattcaagctattttcaatcttttgctataagaaccaatgctttgagattgcaataactaatcttgaccgttttgcacgcttccaatcacatctgaaagatacattcttcaagaaactgccaggtcgaaaggtttgtgtatttgcaattttgatagatttgggtaaaattatcattcatcaaggttgtaccagtttacattcccagtcacaacatagtaaagggatgcttgaggtgttattgcttctagatgaaaacatggtcacaagtacagttttaattttgagtagctttacacatgtttatattatatttccttcctgtgatagtctgttcttttcttttgcgatgttgatcattttcttactgattgtttgaaagctctttatgtgtattagggatgtaagtcttcttatggtatgagctacaaatatttaatcattggtcttttgactcttaatcctaattttgatcatgtagcactaaaataaaagcccttctacaagatttatcaatcatctttgggttagcgtcacactttgggataaaacagtgatgacggtggatatcttactcttgacttttagggtaatgtttctaccattttcccattaagcatggcattggctttcaggctaacagtaataaaatatttatttaggatttttgcatcaatagtctcaagcaatacaagcctgaagatttacatgagtgctatgtttgtaaggctctgtggtcaatgttatgacaatctagcagctttatcctctgcaaaggtttaaatagtattataacagcatattctttaaaagtttggtagaattcttctgtgaaattatagttagtaactttctagggtttactacgagacattattctatgaagggtgacttgttcagatagctctattttctggagtcagttctggtaaattacactttcttagaaaatgatctgtttcttcttttgggtaaacaggctaaatctaatcaagaaaataagggggcacaaacatacaaaataagaaccaccacagacaacatatgaaaaatcatggcgcaactagtctgctcagttccatgcaactcaattttaaaacacatttgctataaacattgttaaataatcttattaaaaatataaaatatattttcttttatgatcatcattctctacacgtttaggcacagttacctaaaagagcatgacccaagcttcaaatgtataccaagagcataattgtagaataagataggtcaggctgggcatggtggctcatgcctgtaatcccagcactttgggagactgaggtgggtggatcacgaggtcaggagttagagaccagcctggccaacatagtgaaaccccatctctactgaaaacacaaaacttagtcgggcatggtggcatacacctgtaatcccagctactcggaaggctaaggcagaagaatggccgtagtatacccctggtcgtgtagcagtgaaagtggtttggtttagacgtccgggaattgcatctgtttttaagcctaatgtggggacagctcatgagtgtaagacgtcttgtgatgtaattattatacgaatgggggcttcaaccgggagtactactcgattgtcaaagtcaaggagtcgcaggtcgcctcgcttgaatccaggaggcggaggttgcagtgagctgagggcatcccactgcactccagcctgggcgacagagcaagactctgtctcgagagggaaaaaaaaaaaagagtaagataggtcagaccatcttacacacctcctccctaccacacactattataaccatgacataaaataccaggcaataaaggtgaaatggtagcccctagataaataaatgaatcagagaagggatgcttagtttttagaagacagtacggtcttccacaacataattaagttatgttccttttttctcagtttgaaaaatctgctggcaagtcacaaatctgctggcaagtcacaaatctgctggcaagtcacaacaggtacaactaagataggtcaaaacatatttggaacaatgagctaaaattcactgctgtttcctgaaaccaacataaaataaacaaagccactattagaaatggaggaaactgcccaactattcatatcttttaactgtttactcctctattaaatacttagaaatgaccagtaggatcatttaaattaacaggcgttcagtcagatgtgacaggttagaattacagattacaaaaaagacaaattttaaaaacttaaaataagctaacaattaatagaagcctttaaaaaaaaaaaaaccagaggcaacgaactgatgattagcctatgaattattcatacataaatgctgctattggagtctcacctaccacaggtcttccacttagaatattataaatatcctatttgagatccagtgtgaattagcagtgtctacttacagctaaaccatctacagaaatccctgtgcatgtatcttcgcatacaaattcacatatatttgtaggatacattcgtcaaacctttgacaaattaacaaatgtcaaataaaatgtgttaaacttttataagtgccaaaataccctctcaaaaatgtttcatctcactaagaatttataagctagtgtttcttcacaccgtgtcactacatgttgacatctgccaatatgataggtttaaaaggagcaattttttaatttcttgtttttgttgtaaacagtgtatttctgttcttttagccaattctattaactatctttttcttcttgatttgtaagtttttaaacttaaaaatcagttcttagacttgtcatctatttgcaaatattcacccaggtttttttttaaaaaaaatctgttatatcttttaaggtgacattaaattgttttaatttaaaaaagactttttttttagagtagtttcaagatcacagcaaaactgaacagaaagtacaaaaagctcccatatgacccctgccctgcttccccaaattccctataacatccgcaaaccacaatggtccatttgttataataatgaacctacactgatacatcattatcactgaaagtccataatttacattagggctatgttatacattctctgggttttgacaaatgtataatgacgtgtatccatttacagtttcaaacagagtagtttcactgccctaaaaatgccctgtgctccacctagtcctctttacctcccacaaagcctcagtaaccacttatctttctactgcttccatagttctgccttctccagaatgtcatatatagtaagtcttcatttaacatcttccataggtttttggaaactgacttaagcaaaataattgtacaacaaaaccaacattccccaatcatcaacactgtaacgaaatgacattattacttgaggacctgttgtacattaattggatatatcagtttatttatctagtcacctattaaaacatcttggttgcttccaagttttggaaattataaataaagctgctatgaacatcaatctgcaggtttttgtgtagacctaagttttcaattcatttgggtaaataccaaggagaagcaagactgctaaaccatatggtaagaatatagttagttttgtgagaaatcaccaaactgtcttccaaagtggctataccatttttcattctgaccagtaataaatgagtgtgcctgttgctccccatcctcaccacaccagcactgatgaactccctcagcttttgtctgaaaaattttttatttctccttcatttctgaaggacagctttactggttatagtattcttggttggcaggggtacttttttctttttttcagatggggtctcactctgtcacccaggttggagggcagtgtcacaatcttggctcactacaacctccacctcctaggctcaagcaattttctcaccttggcctcctgagtagctgggaccacaggtgtgtaccaacacacccggctaatttcagttttgttttttaattctttcagcactttaaatacaccacccatctctcctggcctgcaaactttctgctgaaaaagctgattgtctaatgaagactcccttgttatgtggcacgttgcttttactcttgctgcttttattcacaatagcaaagatacagaagacaacccaagtgtcccatcaacagatgaataaataaagaaatggagggttatacacacaattgaatgttatcctgccttaaaaagggagatcctaccacttttggcatggatgaatctggaagacattatgccaaggaaattaggtggacatagaaagacacatggcataatctcatatgtggggttttttttttttaagccaaatacatagaaacataataaaatggtgattacaggttggggggaaaatagggagattataggtcaaagggtataaagttgcagatatgtaagatatgcccagagatctaatgtacaacctgaggactacagttacaatattgtgttgtatactggaaatttagtaagtcaattttaggtgctcttatcacacacataaaaaggtgactatgtgagatgatggatttagttgactacagcaaccatttcactacatacaccaaatatcatgttatataccttaaacatatacaataaaaatgtatgctttaaaaagtctaatttactgaatacagactaaagtgttcacaaaccttccagaaaactgggaatcatcctgggttgcttcttcaaccttaacccaaatatgatcactagtcatattctaagcctcagcaatatgtatcaaaagcacccacttctcccccatgtcacctaaaaccagccagacatatagtgtaataaacaagaacaggaactctagaatctgacatcctactgaatttctctgtcattttctagctattttttaatgaggttcattacagcattgttttttaatttctggtaaaagttgaaccttttaaaattttaattttttgctagatgcaattacatataatgcttaagttttcctattttgcctaactatgctaatttttttttttttttttttttgagacggagtctcgctctgtcgcccaggctggagtgcagtggcgggatctcggctcactgcaagctccgcctcccgggttcacaccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgactatgctaattttttataatgaacatccatttgttgtataatttgaaatgctgtatcataatcttatgtgtagaacactgtttaacttttatctgacacagaataatggtagaaataagagattaagcttccctgccaaagtgatacaacattataatcatcaaattcagcttatgaaatatataatgcatgaatgatcattttttcatttcttgttttaaaaaacttaatccccagtgcgatagcatcttaggttttacatatttccaatttttctatgagagcataattctgttcataatgagaaaaaaggctgcttttgtttttattagaaactcctacagagttccccttatagttagtatgtagaagattggggaaaacctttgcttctgaaatagcagtaagaaaacagtggataaacaaagaaaaattctatttttctttaaagttatcacacagatatagatccaaataagtccataggaactaatttacagagagggatgagctcctccccagttaacagagagtggtaatcactttcactactgacagcatctgccaagtcaggacacagacaaaggactgagcttgccaaaggagaagccaactaaaatttcaatggccatgcacagacgacaggaatcgaagaagctgcaagcacagagctcctcttcaccagtcagttttaatacatgtctttagctgagtacatgttagcataggaagtcctgggcaaggctggaaagaaataagaatatgcagtcttgccatatttgtatctgaaagttctgataaggtagggaactgaccctccctgaaacctgagtgatgtgacattaaagcaccaaattatcacctttccaactcaaatcctaagggcagggaaaggatcagctcctcaacttggcaaatagagaaaagagttggtctttccaaagaaagtgttatctattttaatctctaatattattatatatacaacacccactatccaattaaaaaacaagagatattcaaagatggagggggaaaaaaatgaccccataatcaagagataaaacagtcaacaaaagcaggccatgttacatattaactggacacaaattatcgaagactttaaaatggaaattatatagctaaaaaataaaggatctgaaatgaaaaattcatttaattggattaagagcagactcaaagtcagggtcacatacatattatcacttgattttcaacaaaggagccaatgtaaatcaatggagaaaggaatgtctctgcaaaatggtgctaaaacaactgaaagaaatgtctgtagtaaaggaataaaaagcagcaaaaaggagccaaactggtaaatatgtaggtgaatataaaatacttctttttatcccttctaatttcctttaaaaatcaacttgatatcaaaagcaaaaaataacactgaactttggggtttatatatttttattaagtaaaatacatgtcaataatagtacaaacaacagaagtagatgaatgaaactagagtggtgtaaagttcttaaattttacatgacgttgtaaaatattacaacttaaataaacttctaggtataacataagtacaatgtaatcacgagaatgccaactgagaaaataatactaagtgttactggtaaaaggccaagagagtaaacagaatgaaacaaaaattatttgattagtctaaaaggcaggaaaacaaacagataaaaaccagagagaacaaatagacaaacaattgcaaaatggtagcctaaagccagtatcaataatccctctaaatataagcggactaaattttccaactaaaagacaaaaattgttagattaaataaaaccaaaaatatgctgtccacaagaaacacaccataaatataaagattcggatagactgaaacaattaaaaatatatcatgtaaccagaggtaagaaagaagatatggtgatgttaatatgaaatgcattttataattagggcaaattaatttggaagatgtataattccaaatgtgtatcatctaataacagaggttaaagacacacgaagcaaaaactgacaggactaaaggcacaaacagatgactctaaaatcagagctgaaaattttaacacttatcataactgacaaaataaggagattttaaaaaatcataaagaattaagaagatgtaaacactatcaaccaccctgacctaaatgacatttggaacactatagtatatacattctttccaactatatatggaactcttatcaagataagttacaagttatagcataaaataattttcataaatttccaaggactaaagtcacacacactatatgctggactgttaacagaattaaattagaaattgatgaagtatctagaaaatcctcacactcctaagaaaaacccaaacttctaaataactcatgaatcaagaagaattagaaaataagtgataatttaaaaacaacataaaatttgtaatatagagctaacataaagcttagagggaaatttatagctttaaatgtgtacattataaacaaatcaatgatctaaatgtacaccacaggaggctagaaaagaccagattaaatgaaaagtaagcagacaaaaagatgaatacaaacaaaacagaaaagagacaaagacaacaaagactactgattaatccattacaagacattctaataaaaaattaaaaagtcaaattactaacattataaattttaaaatggatctcacatatatgaaaggaataacaaatatcagaaataactttatatcaatacattctccagccttggcaacctggtgaaatcctatctctaaataaaacacaaaaattagccaggtgcagtagcatgtacctgtggtcccagcttctcgagaggctaaagtggggaagattgcctgagcctgggaggttgaggctgccgtgagccaaccaggccactgcactccagcctgggcaacgaagtgagatcctgtctcaattaatcaatcctatgacttaaatgaaatgaacacatttctaacaaaatccaagtttatcaaacacatacacaaaattaaaaatgtaaataattctcaatttaaaaaaccttttcctacaagagatggtttctctggaaaaatcaaactttgttttgaatacaaggtctcgctgttgcccaggctggagtgcagcggcgcaaacatggctcaatgcaacctccacctcctgggctcaagtgaccctcccaccttagcctcttaagtagctgggaccacaggtgaatgccactacccctggctaatttaaaaaaaaaaaaatttttttttgtagagacggggtcttgctttgttgcctaggttggtcttgacctcctgtgctcaagcaattctccagcattggcctcctaaaatgctaggattacaggcaagaactaccatgcccagccctatcaaaaatttaagaaagaaataatgccaaccttaaagaaactcttcgagaaaacaggagaaagccctttccaacacattttatgatattaaaactaataaacacattacaagggaaaaaaccctacagaccaatctctcataaacatagatggaaaaattctcaaaaataaaacaattcaaatccatgaaactatatgatcctctttataaacgcagaaaaaaaatttgacaaaattcaacagccatttataaaacacaattagaacattaagaacaaaaaggaaaaagaacttcctcaatcagatacaatctccaaaatatccacaattaacatcatacttaaagggggaattgtgaaatgtgttcttcctataatcagaacaatgcaaaaatgtccattcttatagcttcaacagtttattgtaggtcttagttaggacagaaaaagaaaaaagcatgaagactggggaaaaaaagaaaaactgtcagccgggcacagtggctcacggctgtaatcccagcactttgggaggccgaggcgggtggatcacctgaggttgggagttcgagaccagcctgaccaacgtggagaaactccgtctctactaaaatacgaaaaataagctgggcgtggtagtgcatgcctgtaaacccagctactcaggaggttcaggttacagtgagctgagatcatgccattgcactctagcctgggcaacaagagtgaaactccttctcaaaaaacaatcaaacaaaaaaaaactgtccttatcaacagatgacatggctgtgtatgcagaaaacctcaagaatctacagaattctagaaccaaaaagtcaatttaacaagaatgcaggagaaaagaatatacaaaaatcaagtatttcccatatcctaggaacaactggaaaataaaatgtaaaaacaaaaacgtataacagcactaaaagtataaaatactaaaaaatttatctaatgaaagacatgctatacatctacatcaaaaactgtttaacacatggcagagaaaaggcattgttataagactattatcctgaagttgtcaaacctgacccctcatttttgacaaaaatcttactttcctattttatagagctgatcctaaaccacaaaaatcaagtgcttctgtgtctggatctcaattcttcactttccttcacatctttgtgcaatccactatcttcctttttcttaatggttaactcctcttaacattttaactaccttcatacagtgcttattacaggttagaacacatagatgccttataaatatcagtcctattaatactctatgagttaaatgctattattgtccctattttacagatttaaaaactaggttacctagctagcatatgtaagaggaacatttcaaactcagatagtctagctcagagtctcactatgctattttgattatatgcatttagttaagaggagtaagtcttgtaagtggagtgtatgggaaaactgtctaggagtacaaaaaactagtagtttacaagaagaaaaaattaaaatgtattttctatttatttaatctcatccttcaatttctaatttttgtatatatttttaaatgtacttgaagtacctgtatataacttacaaataattaagtgtacatattagtaggatactctcaaaatcttaatactcactgtattagcttcctagggcttgctctaacaaaataccacaaactgggtggcttaaaacaacagaaatttattttttcagagctttgaaggacctaagtcccaagacaaggtgtcagcaaagccatgctctctcaaaggctcaaggggagaatctgttccatgcctttctcttaagcttttgggtttcccaacaatcctaggaattgctcagcttgcaggtgctaactccagttacctgcctccatcttcatatagcacattcctccctatcttataaagacaccagtcatatagaattagggcccatcgtacttcagtatgacttcatcttaaacaactacatttacaaagatgctactcccaaacaaggccacattctgaggtattggaggttagcacctcattttatcttctgggacacaggcagattaaaaaaccctttaagtctctttgtgtatcttggaccaagcacagtgtatgtagaagatacaaaactgaattgtgagttatgaaatccacatcttatgatctattatattctatttctctatatacctgtttgaacaaatatgttcataaaaatcatgacttgaaaagggactgattatacaatactacaaaggttaatcgaacttataaatttcttacgatgtccagcctgatctctaatatccactataaaggaagaataaagtcttgaccagcaaaatctaaatcaaaaaaaaaaagaaaaaagtaacaagtgcttgttcgtacacttacttattatgcctaatttatcctctggttgcccttttaaaaaatttcaattcattatttttaacagcaggttatgaaagatgaatttaattatgtccttccttctggaaggtatgaaccagagttagagaggtggccaactttgttctaaattggagccctgcatcagtcagaattgtttcttgccatggccccaagagagaaactgatattgggtaagaggctggcagccaaactaactgttggcatctcatgaatcacatattcccattgccatacagtaatttttaaacctgtcattcagaaagccagtaacactgctccactgaaacagaaatattaggttgggttcaaagttagccccaacactgcaattattttagctggctgattcagcttattctccacttttgtactttgattcatttatcatacataacgaatacttgtattattgctcctcctgtgtttcagttatattgctgaataggtgtctgtgcactaaattagaatccctgcagccttttttttctggcttatttcacttaacatactgctttcaaggtccatccatgttgccacacgtcatgctatactgtcattcctttacatggttgaataattccattgcagaaacatacctcattttattcatccattcatcatttgatggacatctgagttgtttctaactttgaatattaagaataatgcctgcataaatggtcatgtacaagtttttgagtagacatgttttcagttcacttggatacatagctggccacaatatgttaactctgtatttaactttttgaggaacaggaaacttttccaaagtgttgaaccatttaacattcctactagcgatatatgaggactccaatttctccacatcctcaccaacatttgttattgtccttttttgattatagcatctagtaggtgtgaggtagtatctcactgtggtttatgacgttcagtatcttttcccatcattcacttttaaatgtcacagtaacagctgtccatcacaggcaaaaaagaatattattgcttcaagaagagtgtcatctaattttagtaaaacatatgtggaaagtcaaatattatttgcattaagatgtataacacgttatttccaacgttcattagattatctacctttcttagttatctggtactcctaaacacccaaatgtatgattagctacagcagaaacttctttacctgggagtccaaaaaaacggatttaaacaagagaattattgtaacccctccctcccccaccaatgttaatccacttaaaaataatttagattatcataaccaagaatgcattagtgttaagatgtggagaaagactgatggtataatttgtcaggttgtgatattaaggtgtccaacagttaagatacagacaggtaaaatgaatcaaactggacaattacaatgacatcaaagtgatttcactggtagtttattagttctgctgagttatacattttattacgtaagacgtgatttaaagctttaatttttttcttcatcactttttggagttgatagctaagcataagaaattaatctactataattcaaaactcactattaggttaaaaaagcagtgaaaagctgatccccatccttcacccccaaattcctctgaaaatctgttatttgagtaattatggttttttatcacagagagatacttagtcatagggttactaaaattttcaacagaagcaaatacttaaaaagaaataaaagtatgtgcatgttttcaaattttcatttactctaataaaaaataacaattattctgcagagtagcatacgttataatttttcagtgacaacatggacctctttggtagttcagatatgttaaatcaagatagaagatcatcttttttggtatgcgtctcaacttctctaaatttaagagtaacatcttttgtgaatttcaaacaatacaagaaatgtatatctaataactgaggaattttcaaagacattttttttacctgtgtccatactttgattcaactgttggtcacttgtttctccatcttcactgatatatccaggaggtggcgtttctacaaaagtttaaaacaaatcaagcacagctgcaacataatctcactaccttttctctcagctaccagagataaccaatgaatcactccaaataacaaataataatgttatataatattataaaaagtaatattgcatactgagggtgtataattcaggatcttgtccaaattttgcagtgaatccttaacatccacttttaataaaatcctactctctggacatacacattatgtacgtatcttgctcattcctatatgtacatattctggggcaagagccaaaaacgtaactttaaaaatgcctcagatctgaatcagtaggctgcaaaaccatcagtaactacaattttttgttgttgttgtttaatctaatgaacatcgttattttatgagtacttagaaaattaaaaaacacacaagattttggattataaaagtattaaataatacaggcttacaacttacactaagttctatagggtaaaatatggtagagtatggttccggattggtccaggctgaattctatctaaaaagtgtgtttctccaaggattcctaactggtaaagtctaagtgtttgaagcagaaaattcaattcaaatatagactactgtataaagaggtaaaatgctccctgaaaataaccattaggattctaatatattatttccaacatgttgtctgaataaaacacttatgttcagaaaggtatctgaatagctgaataaactgcatgtaaaataaaaacatgtatacaatttaatcaactgtaattccagggaggaaaaataagttcagaagactttcatcagttttacatttacactgaacagttttgagcgattcaagataacaaagacacatatccaaacaattttaaaattatcaaaagaacgaggccaggcgcggtggcttatgcctgtaatcccagcactttgggaggccgaggcaggcagatcacctgaggtggggagttcgagaccagcctgacaaacatggagaaaccccatctctactaaaaacacaaaattagccgggcatggtggtgcatccctataattccagttactagggaggctgaggcaggagaatcatttgaacccaggaggtggaggctgcggtgagccgagatcacaccattgtactccagcctgggcaacaagagcaaaacaccgtctcaaaaaaaaaaaaaaaaaaaaaaaaagaggaagagaagatacaggttaagggtctccttcaataaccttttacaatatctattcaataaactaaccacaaactttaagtatcaaacttttcatttaagtgtcagtacccccaaatttttaaaacaaaaattctaagaataaattatcttcatatactcaaagaacataaaaataagggtacatattatgcatattttaaaagttaaagctaataaagttaaacggcgctaagctttttgagtttaacctgtatttcaaagatctaatcagaaagaaatgctgaaccttaaaatacgttatcttactgtgtttattttttccattattgtaataaataataaagctattagcatttttgagaaaatgttaaaatttcttttaagtggaataaaatgtgaaccctttggttttgctgttgcttgaaaccggataaagccccactgtccagaaaagcaaatgggtataatccacttctgattttctactttataaaatactcaaatctcaataattaaaggaataaaaaagaaaggaaaaatgagcccaaacatcttcacaagtgaaagccactaaacattctggtgaatagccttccaaataattactggatatgcgtgttgtccctaagactgcatgtttatacctaaggttagtattgctggctgaataacagtaattcccacactaacgacttaaaatgcctccccttccccacaccaacgttcacacaactccactcccttttctacctagcaattgccctgtttcatagtcccgggttttccctcctcctagtgttatcatactacatcccaccctctccctctcttaacttcagtaagtttgtatttcctagcaacccataaagcagctttaaatcctcttctggaataaaacagtaatcaaagaaatatacattaaaacaatcaaaaaccacttcccatttgtaaaaccagctatttaaaaaaaaaacttatctttcttagttatcttttcttttttttcttccttacatttaaaaaattatcttcaatgaataagcattatttccatgatggatacatgaaagaaataattgtttaaatgtactaaaactgtattttaagaattttgtaaatgctcttaagttccttacatatttttagtgtataaaataagagtggaataaaagaatattacaaaaggaagaaagaaatcgagacactacagcttaatcctcatcctaacatcatgctgtttctgctagggagaaaaatcaaccaaacaaaaaggaaaacatacaagaaaagtaacaaagtattagttgttctccaaaaaaaaaaaaaagaaaccataaaaaacgaaaaggccagatatcatatcgtggagtattactggatcacataatacatcagaacaaaatttgagaaccatgtagctgaattcaattttcatcagaaattactgagatgcagacgaaacataattaaaggaggttttctgacgttcgtgttataatatgtaagtgttgctatgtctatagaactaagtattatatttcttatagaaatgttatatttctgttaaatattaccaagttatctaagaaaaagtgatcattgggtggatattcagttacatgtgtttggggggtacttttctcctacaccatttgttttgcttacattctgcatctcgcttagcttcaacaactaagacaaacttactaagatcttttcttttctgcttctcacagtactttgattaaagtcactgcaaaagaaaatgaaatataaagtaaaactcttctccaaacaaaactgtttaatgtactaggcttatacatttcacaaaataatcacccaacgaatccaatttttctattaaaaactcaaaagcatttttaaaaaagtgaaaccacaatttactaaaacttgaatgcttatgaacaaaatttgtatctatccaagttttaggagattcagaaggcaaaaatacctggaatataattactctgtggctcaattcctgctgggaagttagtgttttctggaatggagtgagtatagtcatccagaggcggaagttctgttaggatctcggtgtgtcggggcactaatactggaggcaaaactgaaaaagttcaagaaatccaagttaatggcaaagagcaaaggggagtgggggaaccttttttaaagttttcaacaagaagagaagttgtagcttaatttttaaagctagggtccacctactcgatatatactagttactgagaaaatgacaaatctgattatggctctaacttaggtagtctattatccaaatttccaagttctaatttatctcaaacttttgggaacaatgtgatcctggtaatattatattaccataaaagttcataaatccccattggaaaacttaacattgtctttatctgtaaaatcagatataggaaattttccaaaaacgcagctactgctatattttttaatagtttcaggtagacagctaactaaatgaaaagtcttgttacaagctttactaaacggtgtacatacaaatgatgtcattaaagtacttctaaaagcactccaagtgcaaaatgcttgaaaatgttactgcagcagggacatgtagaagcacatcagcatagcgctgagcagactgccaatctacaggatttcctggatatgcactttcatgccaaatcatatgctattccaagaaacagatatgttttctcattaaaaatttttaaaaataaaaaaattttaattaccaccaaataatatgcacaatttaaggtaatttattagaatttacactaaaattttcctgggtcacaagagtacttaaatatactgaagttcaggcatttaattcaaaaccaagaaaaaaacttgcaatattcctacctggtgtctcaactctctgatagtggtaagggtttacacatacttcatcctttttaagattaaaagcatattcgcagttttcaattgccttgagttcatgatgactgtgaagatcaggccagcgccataatcggcaatatataacatgtggcaatccttttcgatgggatacctggagacgaccatcaagagacctgttgggaagcaaggggaaaagaaaggagggaactttaaaaaaaaaaaaaaaaaagtgcagtcaaatgggctaaattagtacaataaaagcataaagaaaagaatgacagccatttagttagttttagtgagaatcaagaacaaaaatgtactatttaatggatctgataaaagtatgcagcagcactagcagatgtttcttataaatatgtcacataaatgactcaaatgccaatgaaaggctaacaacttgggaaaaactgattttttaaaaaagagagtttatgcagttatacttgaaaaactttgtcaacttctatgtttagtaaatcaaactcattttagagatgcttctaaggatattaattctggaggtgactgaagagtcagaaaaggaactagtgtgaagaatgataaataccaacaatgatgtgatagtaacttcctcagactactgcaactctttacccagttgtgactgttttgagaactgaggtatatttatgtagttcacaaataaatgtggatggtgatgaatatgatgagatgaaatgaacaaataccatatacgcaaaaaagaaaatgaagtgattaaaaaaagtaacataaaaatgagttaacctactgttaattgtgatataaggggttcattaagtatgtatttattagtataaagatgagattctgataacaagaaatttagcaaaactcatcatgtatctacttaaaaattaggccaacaacagattataatctgatctcaagctaaaataaatatatagttatcaaaattattattctttaggggatacagtaatttaaagaagattcaaactagaattgcattgattaaaacatcagctgaaacatttaatatattttttatactggcaagcagatattttaaatgctatgccttattttacattaaggaaacatcctaggcaaaattatactaagcaaccccatataggtctttcaaaatatacccccctcccacaagatctctaagattcgacagagggcagaatattcacctggtttgttcagagaagctgtaaaggcctgttgtatcccactgatctatcgtatttggtgtactcagtccccaaatttcagagcaagtgctgtgcataaattgaaaaacaaaaaattgatgtgaacatggaagcatggttattcaaaataccatgatgtaaaacatggagaatgtacagaatacttccttcacccagaaaatatacaattgcttcactttttcacaggcatgtagtgctggttactatattttctatatgaaggaagccaataaaatggaacatgtgactccagataagtcatgattatgtttttaaaatgtgaacaccaacgccctctagctcaatgaatcatacctataatgcccttaccactttcctgtattcaaaagatctaaaacctctgccatcagctttactaagtgcttcattttataatccagttttttaaaaaattatctaaaaacagatgtcaactgatttttaatatagaaaaaaatcccaataaaaatagacatgcatccacagttaagattttcaggttatctggtcatgatatttttaagttttactgaaaattattttgttctcatctctagaataaataaagaaatagactttgaagtcattctaatttagtataccaccttaaaaattttctcccacatttctctccagaatatgggcagctcagagataattctccctttttccctacctttatttcatttcatagtaacttctggtcagtgagagaagggaaagagagcttaaaaggaagttttggaatggaactttgacagccaatgtctcaagtactaagttgtacttttctgaaaagtccatttcttacatattacaaaatcatcaaaacttcaatgcggataaaggagtatttcaaaacatcttttgaaaatgaatcaagcaattgattaaatttcatatttacacattgttagtgagcttaactggatcaacagttcaaagggcaatggtgagaagcgctggcttcctgtggccaggcaacagaaccacctggcatccttggctttagtactacaggtgctgtcacatagctatcaggctgcaggaacacatcatgccctgctttgggggctacagtgacccgacagttcaaaacaaaacctgttctgaaattttccagcatctcattcaagtattttatagattctcttgctttttcaggctgcaaaatttaccagactataaaagccagaaaaagccaggtaaattaaggcttagacctttcccttttttccaaagatatactgatttaaaaaccatgacattaatggtttatttaaaagatattttcaaatatctattggaaacatatagcatgatgtagtttaaatcacaacagaatcacctcaattctacagacttctgagtctattaaagaaatggtatacaggagactattctttgaaaataattaacaaaagtgtagcacaagaggctattctgctctgtatcagaacatttcactcaagttattctgggactcacatgagaaccagaatctaaaatagagcatgaagtttacattgtactttatttaatccttgaaaggaatcagagaagaataaacagtaattgttaagaacttgcaatcaatctagaggcagacagatctagaccccaaccctaattcggccactttccaactgctgccatagggtatatttaagcctcagttccatcattatcatgcctaacaaaattggaaggtttattttaaaacattaaatttgcttctagctagtaaaatcattgcctgtttacataataaaaaatattttttaaaataagccaatttataataaaacatagagccctctgtatccaagggttccacatccttggattcaaccaaccgtggatcaaaaagtagaaaaaataagtaaatttttaaaactaaaaaatacaacaattgaaaaatacaaaatttaaaaacaatatggtataacaactatttacacagcatttacaatgtattacatattatgcataatatagagatgacttaaagcaggagtctcagaggccacagactgataccggtccacggcctgttaggaaccaggacacacagcagaaggtgagcagcaggggagagaccattaccacctgagctctgcctcctggaagatcagcagtggcattagattctcataggagcaagaaccctattgtgaactgcacatgcgagggctttaggctgggcactccttaagagaatctaactaatgcctgatgactgaggtggaacgtctttatcccaaaaccattgccgcaccaccacggtcagtggaaaacttgcctttcatgactctgtctcctggtgccaaaacggttgggaacagccgatttaaagtatgagaaaatgtgcataggttatatgcaaatacaatgccattttatttttaaaataaggcttactgcggccttgacctcccagcctcaagtagttctccagcctcagcctcctgagtagctgggactataggcgtgtgtcaccacgattggctaattttaacactttttgtagagacaaagtctcttgagtcctggactcaagtgatcctctcacctcagcctcccaaaatgctgggattacagaagtaagtcaacgtgcccaggcttacaatgccattttttatcagaacttgagcatccactaattctggtatgagtgggaaatcctagaaccaatcccccttagatagtgagagttgtataagcagcatctagataaatgtaattaaaactgtgtcaaactatacaaagaaacattttaaacataactaaagaacacaaaagtgcactgagcaaaaaagaaaaacatacgtccctacacaggaagataccatcatagaggtattaactctaccaaatttatatatttgatgcaatctcaataaaaataaatgttttaaaaatccaggtattagtccaaatactgtaataagccaaaacaaataagtatgaccagaaaattctaacaaatagtaaagacctgtcctaccagattctgaagcacataataaattctcaataattaaaacagtatgcaattagtaaaagaatacacaaaacagaatggaggttctaattccagtaatggcagagcagcctcaattaggctaactttccttcatataacaatgataaactctgaacaaaataatcaactatttgaaaatagcagacacagatcaaaaacagacaaaagctgaagggaggtccaactgtcaaagctgcaaactgtactggatgagagctgcatttctgtggctgtgtacccaagggcactccccagccacagctaggcagggcaactagaattcaaacagaacactgcaggggggttgtttttagaaaactgcagttttactgacctagaatcagaggacacatttggggctgccagagagtttgaaaaaagaaggaagataccctgtaaagaaagaggcacaagggaaaaacatcaacaatgtgactgtgaactctgcccaaactcaactttgctcaaagatattttttaaaagctaagtatatagagatacagcatattcacagatgagtcaatattaagatgtccatctgacctaattccctaatgattgttgcctatttgttttatatctattacagtgaccatttcagcaaaaatatttttgtagcaactgacaagctgatataaaatgtatatggaaatactaaggatcttgaatagcaaaacaatcttgaaaaagaattactgacccatggatgaatcttgggaatattctgatcaagagaagctgaacactaaagtatctacactgaatgactccacttatacgaagctctagaagtggcagaacaaattcaaagtgaaaaacaacagtaattgtttccagaagaaccgctaggaaagagtatgaaagaactttctggatgattgaaatttctttatcttaaaacactggtatatgcatttgttgaatctaactaaactgaatatatgatttgtgcacttcacctataaaaaatttacctgaaaaaaggaaaaacacaaaagaatgcaaagaaaagtaaaaaccaaaacagaaaaagtcccaacaaaaaattcatagaacaatttagcatatgatgaaggcaccctatgaactgatatggaaaggtctaaaatatgctactccctgtattaaaaaaggacaggtaaaaagatctgtaattactcactaatatatgcataaagacacacatacatcatggacagtagttacttgaggtgcagagtgggaagggagaggttccaatgtatgtgtatatgcatgcttgtatgtgtatacatacataaacatacgtatttttgagccatgtgaatgtatattgcctttcaccaaaattgtaaaaataaaacagaagaaaatattgccagagaataaaatgcaagtcaatgtcatcttgacacttctataaaaagatatggttctaaaacattagaggcacattacttcctatactgcatcatttaaagcgcagtttgggcattactataagagacaaataataacatgccagcctgagccctgatcattcttttctcacacaatgtcctttctgtctcacatgaacctttggtaccaattttcttccatgtgcaatttatgttaactgccccttcctagccaccttttaactttactactaattctttaataagtctaacaaacgaggtcaatttttaagatgcctttggtaggttttaatgaggcagttttaatcacccactcttccttaaagattctgtctaaccacaatgtatttcccaacaacaccctgagctcccaaagccctttgtgtaccacccagcaaacaacatatttggtgacccaactggtattttcatagtacaaaagtggattataatattccttatcacattaaatcataacatcctaaataacactggggaaaaactgtatctcccaggttttcattttgttaataaaaagtgtaagttataacttctaggtatggccagtttctaaaaaatattaaaagaaacaaatgcaggaaaaattttagagaagtagcactgattataacaactatataaaaagctttttacacattcaataaatttcactaatctaagattatctactttaaaatgcaacattatttgtgtaacacttgaaaatcctctttcaattttatttataaggggcatctcaaagtgaaaaaaatgtgcatcttacaaacaaatatttaatgacaattgtcttcataagctagctactttatatcaagcactgtgtaagactaaatggattagggacctcaaagtaacctgcaagttatgtaaaaatagtatccatcacctattaaattgatgttaattggaattttgtgggttatataactgagtataaatttgtcttttggttagcgttaagtttgcacttaagtatgtttctatacatttaaataatattaaaggaagtccacaagaaatgtctgtacattactcaaatgtgaaaaacagaaacctgtacaacatcaagctgtttacaaagtactaaggatagaaaataggtctgaaaatgttaaactaagactacttgctatgtaaaatcaacatatcctaaagagattattaagttattataacaatgatagcaatatcccaaacacattggctcaacatttcctaaatttatttgaccatctaacttcaggatattcttaaaactctcatgtattgaaaaatatcagcaaaaattggtctcataaattctgcctgaacaaatttgatactgtttactaacaaattaatgtgaaatattacaatatgttgaaataagatgtagcagaccattaactaactacaatgatgtccctgcatcaatatacagatgaacaagcatacgtatgttatctcacgcaaagtcccaaagttctttgcatggaacagtttcttaaagacagattatcccccatcaactgtgtaatgttcttgcttatatatctagcttaaattaaaaagaggtggggaggagaggcaaaacagctattaaagtcataaacatactaatatagcaactacctttgttggcatacagtatattaatcactaaactaacaggatgacttggtaataaacctaatagaaatccttatcaaatttccctagtaataacttttacaataagtatttcagtaaaacacatcaaagattttcttcatctaagaataagctgacttttgaaaactgaaattaaaatttaatatctagtgtacaatttacaaagtatacactcgcctacatatatacacatctaaattaacattttgcactttgttccaattatccagatattatgtttggtcaatttactactttttttgcgttaaggatatagatatttattcacatctttgttatggagaaagaaaagagaagcagtgaaaattaagttgaagaaaacactaccaactttgggcaaaaggtggctcgcatcacagaatctggtaaccctttaaaccagttttactgttcctaccatatctgcaagatttactgctgcagttagacaaccaataacaaaagtaataaaccccattgttttactaatttattatttttcatgatcttcttgcctaaacagtgtatttttttttttttttaacaaatcaaaagggataacaacctaagttgccaccttggtaagattaaaagcatgctgaacactcagtaaaattagtcaattagcagaatattatcaacaaaaggaactttcctaaggctccagctcttgattactgatctactcatttaatacagacttctaggggagtaatctgtaactatgcatccataattatttctacttaaaataatcctttcatttttatatgtgacttaagactaaaagtttagatttaaacagctcaggaatgaagagttaatcactgtaataatttttttaagtctccataattacaagtactatgtgtggctgtatattttatcttgactacaaatataattgaaagacacaaaatagattgtagtattcaattacaaatgtttaaatgtcatttatcacatcactgaaaacaatgtgactactttgattaaacttaaatttttaatcaatgattaagaatgatagccttttatttgcctcagaatccagtctcttccccatattttatttgcaaaatgtagacaatcctgattgagaaataagtaggtgcaaatgattttttaagttgctgcattacagatgcaaaaaactgtatctcttgaaaatttgagatattcctgaataaaaattgaaaatataaaagaaatatattaagaaatttatttcaaaaaggttgaatcatcaacaatagctaataagtgctcacattccttcataattaaggcataattgggcagtaattaaatctggagacagtttaacagggtccttaactggcttaaaccttcactctgtgtagaaaatgtttttcgattttatcttgtagcaatgaaatagtaaccattcaaaaacaaacagtcaccaaatgtgcattccggtatgtcagggtttcattctaagtttcaaatcagaacagagcatgtctacattccagatacccaagctgtacagagctctaagtagagctcaccacacaatggtgtggtactgttatttgtataattttataagaacacacatgaaacagaattttaaaaaataaactaataccaagtcttcctaatcggtaacatagtaagtccaaataatgtccagatatgtgaggaatagctttattccaaggtctttgatgctcatgtaataagtacaattttaacaactaattctattacaaaagactgcagaaagctctgtacagctggatccctatacgttcttaagaatcaagcaaacagcctgtgcaacaaagtgagaccccatctctacaaaataattaaaaaattagccaggcatggtggcatgtgcctgcagtcccagctatttgggaggctgaggcaggaggatagtttgagttcaggagtttcaggccacagtgagctatgacgcactactgcactccagcctgggtaaccgtgagatcccatcttaaaaaacaaaacaaaacgaaagaatcaagcaaacttttggagaggaatatctcagaaaagaaaaactcaacagtttctaagtatttattccaacttctcagatacttccatgaacaagctttccatcttctcctgagttctgtatgataaaaaatttcaaacatccattaaagttacgagtaagcaccctacacattgatcagctaaattctgtaatttggatttgttttcttttgctctctcatgtatctacttaacctctctatccatcccttactttttggaacattaaaaataagggtgtatgtgggcagcctgggcaacatggtgaaaccccgtctctatcaaaaatacaaaatattagctgggtgtgctggtgcacacctatgctcctagtattcaggaggccgagacttgagcccagtaggtggaggctgcagtgagactgcaccactgcactcactccatcttgaatgacagagctagaccctgtctcagagagaaaaataaaagctgcagataacacaaatctagacacttaagaatgcacataactagagttcgctgttctttttttctttaggttaaatttacacagcatgaaacacacatcttaatggtaccatttgagttttctcagatgcatacattgtacacttctcaaccctgtcaagatcatcacccatgtccatttctcaatgtctggcatccatgcgctcatccccagaggcaaccactaatctgatcttttcaccataggtgtcgtgtcttctggaaagtctatgtatgaatggaatatggtacatattcttttgggtcttttttgactcagcatgattttgagattcatccatgttaatgtatatgacgtgtgtgtgtgtgtgtgtgtgtgtgtgtgtgtggagtcgttttccattacttgaacaagcatgatttatttagtcattcttatactgatagacacctgacctgttgccaggttttaattattgtgaataaagttgtcatgaacattcaagaaagtacatatcattatatagaaatatgatttctttttttctcgggtaaacacctagaagtgaaaatcttgagtcagtggatagatgcatgtttagcttttcaataaattgccagatcattttccagagtacgattttacagtcctccctctttcaatgtatgagagagagctcctggttattccaaagcctcatcaacatttggtgtggtcagtctttaaattataggtagtctgatgattgtgcagtggtatttcattgtggtttcaattgtcattttcctgaagcctaccgatattacacatttttccatttctttactggacctttatcttcagtgaagtagccaactactgtccattttaaaattaggctatctttacattactgagttatagaaatctttataaattctagattcaatcctttcagaaatgttttgcaaatattttctcccactctgacttattttttaacaatgtattttaataatatgttttgtataccaatggagtctaacttagcagctttcatggtcactgctttctatatactttgaacaattctctgtttacccccaagtcataaatattctcctatattttcttataaaagctttatagttttagctttaattagactacaatttatccagaaatattttgttttcactggtgtaaggtggagtcatgttcattcttccacatggatattcagctgttccagcaccatttgttgaaagactttcctttccctactgggttgctttggcaactttgttgaaaatcatataggcacacagtgtttatctatgtggggctatcttatctgtttttatgtcagtatcacactatacagattactatggcttcaaggtgagtcttgaagtcagggtaatttaagtactctaacttattactgagttttccaattcacaagtgtatccatcagtttactgcatggtaattccaacatgtaggtcttctagggttggtctcctcattataaagggtcacattttctttgttctttgtatgttaggtaatttaggattgtatgctagacattgtgaattttatctgatggtagttagaggttctgttacaatcttccaaaagtcttcatttttgtttcaccagacaactaacctggttgcattcaaaccacaaactctgtcctggagcaattcaaatcaggctgattatctggctgtactgtctaccgtacacatgtgggatcagcaggtgattttggcaaagtttgtaggcagaatccagggctctctttctgaaactctccttgctgatattcactcctcactctccaatagttgtgattctcccaagtcttacctatggtgcttcaaggccagaaagacttggttttgtgttggaattttacctaccctgcacactttgcatggacaaaagctgtaaaacagaaaattcgcctacgccatttccttcttccgagtgtcaatcccctctaaaacatgcctatttttgtttattctccagtacttcatgttatttttagaattttgtgcagtttgttattgagggagtgtcagtctggtaagagcatacctggccatatgagaatcacaactccctcttcatttgtttaacttctctcagcaaggtttcagcattttaagcagaggtcattgtgtgtgtgtgtttaatgtattcctaagtatttagtactgatgctactattcatgaattttcttaacacccctatttgtctgctgctagtatttacaaaaatacaattgatttttagacactgaatctataaagtgcagccttgctaaatttactcatttgttttagtggctatatttatagattctttaggatttcctacataaataagcatgtcatctacaaacagaattttgaaacattccttcagatctttaaaccttttatattttgttttcctgactcattgcgcttgctaggtcttctattaaaataataaggacacaagagtagacatccctgtcttgttcttgagggaaaacacagtatttcatgattaagtaaatccttagctgttagtgtttcttaaataccttttatcagactgagaaagtctctttgtttctcatttgctgggaatgcttatcatgaatggatgatgaattttgtcaaatgcttttgaccaagtgaggtgatcttatagtttccctccttggttaatgcagtaaattacatagtttttttgtttgtttgtttgttttgcccgacagggtcttgctctgtcacccaaactggagtgtggtggcgtgatcactgctcactgcaggttcaacttcctgggtccaagtaaccctcccacctcagccttccaaataactgaaaccacaggaatgtactaccacgcttggcttttttttttttttttttttttttttgtggagacagagtcttatgttgcctaggctggtttcaaactccttaactctcaagcaatcctactgcgttggcctcccaaagtgctgggattagaggcataagccatcgcatctgacctgattaatttttcttttttcgggggtgggggacaaggtcccaatgtctcatgcaggctggagtgcactggtgcaatcatagctcacttcagccttgaacccctgggctcgagtgatcctcctgcctcagcctctgagtagctgaaaccacaggggcatgccaccatgcctgggtgggtaattttatctgtctatagaaatggggtcttgctttgttgaccaggctggtcttgaactcctaggcttaagcaatcctcctgccttggcctcccaaagtgctgggattacaggtatgagccgctgcggctggcttacactgattactttttgaaagttataaactaaccttgttggaatagaactcaattatgatgtattcttttctcatgtatgttagtgatatattaatctttaacttttcttttagttgcatctttgtcaggttttggtttcagggttatgtgagcctcataaaacaacatttttctgagtttattgtctataagattggtgatatttgttgcacaaatgcttaaatttaccagtaaaaccatgtgggcctgaagtttcctttgcaggaaagcttttgattatgaagtcaaattctttcattgttatagggctacccagatcttgtatttcttcatgcatcagctgggggtaacctaaatttcatcattacagttagtcatcaaatttaatggcataaaattgtttataatatttgcttataatctttttactgtctgtaggacctaccatgacaatccctctttcagtaccaatataggtcatttgtgattgtgggctctctgtctttttcttgatcagtctaacaagcgtttatctctccaaagaactcgcttttggctttctgatttctactcttaattttattatttcttctttctacttactttctattttatctttttaggtaactttctttcctagcagattatttaaaactataaaattttccattaggcactctttcagctacatcccacatatgtgatatgctgtattttcattataatttggtttgaaatatattttacctcatttttcccctgaataacccataagtcagaattttaaggtttaatttccaattcttaacagatgtcttattggtattaatttcttattctattggtggcagagaacatactttggatttcaatcttttaaaattgattgagacttgtgccctgtaaacagtctttcctggtgaagttaccatgaacacttgaaacgcttgtatttctactcatgttgggtttagtattctataaatatcacgtaggtagttaataatgtaacttaataatgtaacttaaaacttctatgtctttactgatttttttgttctaattgaactctccaattgtggatttgtgattctgtcccattaattctacccagttttgctgcatgtatttttaagttcctttattaagcagatacaatttattgttatgactccctgatgttggtgatttagatatatcactttacaatcttctctgttgctgatcacctgtcatttgtatgctgcgtgccatttttcaccagctgctttaagattccctctttcatgagtttgaccatgatatatctaagtgtggttttctttttatttatcctgtttgtgttgaataagaaatccaactccatttctgatacttgactgctgataggtttcaagccccaccatttcctcttccccttctgcctcgaatctgggcaagctggtaagaaagcccaggtgctccacctgttgatattagagaaatttcaaaccaggcaagtctcagcatatgtacagtgtaaaaaccagcccacagccccattccctaatcaccataaaaccccaagccagtctcctatcactgctctctcaagtcatttttggaccaacttggaagcctgccatgctctactcagacagcatcattatgtgagtaataaaccttttcatgccctcttggtgcatgtaatataggtgacatcatcagtttcacttcaaaatcaaattttatatataaaatcccatcccacatatagttcacacttattaagcaccaactatgtaccaagctcttacacatattaaaccgcttaatccttcaacagtgccatgaatcaggcactgttgtccccatttgacaaatgaggtaatggaaacacaaagtaacacgtctaaggtcctacagccagcaagtggaagagacagaggccacatttttaattattaacattattccgccccatatatagttactaaaaagaaacaagtaatataaacatagcaaatcaaagctaaaacaataaaactggtataatatcccaggtatgtaaaacatttacacaacatgtttaattataaaaactgaagatttcactgtaagagacattttctcaggaaagaaaatttctttggacaagtaaattgagaaagccccttccaaattaaaataagcagcttaggtttccaaatattaataactaaataaaaaataggcggagacaacagaacttccataatcacactcctgtaagtcacacagtcctataagaataaaattgacacttctactcatctttgatatagtatagcctttcttagaagaaggaccaggtgatgattgaaaaaaactttctcaatattttccacctccacctccaaatgctgttattaaaaactctactctgagataccgtttgatatttctgctgcccctgaaaaaacaaagtatctcccacacacaaaatagtctctactactgaaaagatttaaatatcaattctaaaaatggttgaagtatttcaagcccttccaaatacaaactttttacttaaagaaaacaaaagctaacactgaaagggttcaggtacatttactttaataacatagcttatcgattttctagatttagtcatatacacacacacacacacacacacacacacacacacacacacacacacacacatataccctccccccccaagacagtctctgtcacccaggctggagtgcagtggcacaatcttggctcactgcaacctccgcctcctgggttcaagcaattctcatgcctcagcctctcagatagctggaattatgacacttggcccagctaatttttatatgtttaatagacacaggatttcactatgttggccaggctggtctcgaactcatgacctcaagtgacccacctgcctcagcctcccaaagtgctgggattaaaggcatgagccaccgtgtctggccaatatatactgtttttaacaattaaaaagaaaaatagtaacataaatgacaaaataaatataaaatataagtacatgttattctaatcttaaaataagtgcataaaatctggaatacatggttggtctctgtatatgtgggctccacatccatggacagaaaatactagaggaaaaactagataaaataacaatacaacaatgaagaatacaggctgggcatggtgactcacgcttgtaatcccagcactttgggaggctgaggcaggcagatcgcttgagcccaggagttcgagatcagactaggcaacatgatgaaaccctgtctctaccaaaaatacaaaaattagcctagcatggtggcacacaattgtaatcccaggtattcaagaggctgaggtgggaggatcaccggagcccaggaagcagaggttgcagtaagccaacactgcactactgcactccagcctggacgacagagccagacgctgtctccccactgcctccaaaacaaagtatatggtgggggatgtacataggttatatgcgaatactatgccattttatataagagacttgagcgtctccaaattttggagatatggggtatcccaaggataccaagggatgactttacatcaaccataaaacaatgattacaatacagaatgtgattccatgaaattcaactttttaagttatacagttttataatgcttgactttgattgtaaaagtttttataatctgacaatttttgacaattagcatcccacaaaataaaaatcaactcaaatctgtatagcactctgaatgtgataaactgcttttatgcatagaggttatgtttagataacatgttaaaatgtttaggcaaatgtttaagcacatagattaatgttttatacctgtggatgcaaattatataaggcatcatataaaaattacaggaaaacccttttaaattacttaacttcattataaatttgtgttcagtatctctcaatgtccctatcatcctaaacataaatataaaaccttctttcattgcccccaaaccccgttgtcctagcaaatttcagagaaactatatctatatctatccatctatctatctatctatctatctatctatctatctatctatctaaccataaagataagcaaagttctaaaagacaaaaggctggggtgaaggagttagtgagaagtctccttatatatttcagttctaatttaagtattattagtgatcacagtttcataagagcaccaagaccatttcatagcgcttcccatcataacccaaagtcagagttaaaagttggattttgagagtaaagactaacctaccgcttcaaggaaaacgatgatgataatagaagaaaactgtagttgtaacatttctttgaaaataaagcatcactggctaatttaaccagtatcatgattatatgcaaaaaaaaaaaaaaagaaaaggcttttgttaaaatggcatgtatttcacgtagacacacgtaacatccctcttttctccccacatattcttcctgtccccagcaaccactaaatttggaattctcaattttcaaaaagaggatacagacagctcatgaaacaaactagacttagtgagctcccttccaccaccactctagtcattgctctccaacaagctcttcccaagctgcttttatcctgtctgcacaaaatcccaaaaagatttcaacacttcctagtcatatccagatatttgtattaacaataaatgtcttcagaaattaaaatccagccacagcaaagccaaaatcttactatctcattaattcttttcacgctacctcttccagtactctccagctattatttttaaggcccctcccggttctgaaatagcaggaagagggagtctgagagaaaaggggcacgatcttaagtggctggctggactgtaatctgatgtgacagtaatgtgtgatggagtcctgtggaggttggaagtccaaatgcagactctcacctatagttagttcctgatgcaggaacttctcaggcttgtctgcttggatcactgtgacccttcaaccaagtatggcctcttgatcctttcaaggtaagccaacttcaactattatgtcttactaacgtctactttgtccatgggggtaattcttccacctttgacccatcaaactctgacaaagtgctggcccactcccattgtgccctttcttcattctaccgatacaggggcagctccagcctttatctcactttttaggctttttcagatagaagtcaagtaccagtctatttatctctcaaacctcagcagacacatgtcaaactgagaagttctcgtcaagtccttcaaattggattaacaaaagggagaaataccttaacatatactactctcgccaaaaatcttttcactatggggtccttctcttgaactcacgatctttatacagcctacaggtgagtaacaggttttaactgtagcaatgcttgactcagggtgtcttttctgcatgttctgcatgaacactatagcacctcaattttgaatgcaggttactggcaatctactgttctcagatttggggtaaataccagatttggtaaataccagaacatttcctattataacattctgctatagttccaactccaggtaaaatataagcaggtcacagcagtccaatgttcttactagaggggaaaaaagggaaaaaaaaaaaacttgctcaaaagacaatggagagctatcaaactaatgagatccagatgaactaaaactgcagcaaagcagctttctaggtgaactgacaaatgcctatcacttcctcccctggagtcacgtgtagattctaggtgcaggctaaaggcttggtctgagaaaagaagctctgaggaataaaacagtagaacttttgacagtcacatgagtattccccctcaagacgcttatcagatcttaaagctgaggctaaagagctcatactttcaaagtcacctcatacttcgaaaaagtagaagtgaatctcccagtgtttcaggggttaggtgacagtctaacaagctttcaatcaaaatccctggagcgctgtttgcaggaaaggtataatccagtggcagactaaaccaaattaaaatggcagtctagccccacccagctcaatcgctaattagattaaggggagcttctctctatctacctggtaaaggtaggaaaggtcaaatactctggggagagcattatttgcaagatctttatgagtgaattttacataatgtacaaaacatatggcatacaataaaagctgtatgacatgaaaatgcaggaaaatttgagaaagaaaagaatggacaataacagaagcagaccaacagatgatccagacattagaactgccacacagaagactttaaagtaactattataaatatattaaggaaatagacaaaatggagaatttcaacagatttggggtctataatatcaaaggaacatactataactgaaggatatatttgaaattaagaacttacgtaggcttaacagactgaatacagcacaaaaacaggatcagtaaactcaaaagtagatcaacagaaaatatctaaattgaaaaagagaaaaagaaaaaaaaggaaatgaaaacaacagaactgtaagagacgttctgattttagcccaagtacaacagaagatttaaagcaagatatcctaaactgctgttttactattatctcacctctctccatagtccatgtgtgggtattgtctatctcaggcactttggatagtgatacatttacttatattgccagtgaggaccacacaggcctggaaggactctactacaagacaggaaggggaaggagtaaacagtatggtttttcccagaatgtagtcacataagaatgtcctgggtatgacattttgggctggatggtaaatactttaaaaaaaaaaaggcctgggtagcctagaatggttccaggtaagactggaaacagtcgggcgcggtggctcacacctgtaatcccagcactttgggaggccgaggtgggcggatcacgaggtcaggagatcgagaccatcctggctaacacggtgaaactccgtctctactaaaaatacaaaaaattagccaggcatggtggcaggcgcctgtagtcccagctactcaggaggctgaggcaggagaatggcgtgaatccgggaggcagagcttgcagtgagccgacatcacgccactgcactccagcctgggtgacagagcgagactccatctcaaaaaaaaaaaaaaggactggaaacagaccaaggatgttgggaaaacaaaagattactgtaattttttaaatgcctattttagctaggttgactctttcctgaagctaatatgttaaacaggacaagaaaagagggtatattgttcattgcatcaggtgttacatgataaaattacagaaattgattaatttaggtataatttcagtaatttttataaagggacaaaggtcctagggcaggtaggtattttccctgataaggtaagtgataaaaatgccccatgcaagaatataccatatacacaagggactttgaataccaggtcctggagcaggagccccctcaaaatacctaactgtaaatgtaggcaccagataaggtccagggcttagcaaagtgccttccaaagtgtgtttcacgtgatacttgacctcatcacaagtgctttcacatttataaactgtatatgacaaactggatgataaggctgataaaaggtccctattccccataacctcaaagttctaattcatatttataaagttttattgctctgactttatcaacaaattttatacatttaataaactaaattatacatcatgcaatgttgcctggcaaaaactttttctaagcagagacaatacattttaatgtctacaatttaatgtgagttctcctgaaaaacaaaaatagagaacgaagacctagaatatctgaatatttccaataaatcatattcctagctataatgttttatagcttatgaagctcatttacattatttcaatggacccaaaagtcatactgtgaaagtactcagatagcactactgcctttcacagctgtgaacagtaaaaaaagtacagtcatattccctaggatctacattcatcaatactaaagaagctgacacaaaaacaggttatcaaacttgaaattcagagttccctccaccatagtgtttcatacatattacgatacagacagacacacgcacatgcctatgtatgaatgagaagaaagaattatcctattatgaaaaagcagttgcttaagaatggaagaatactacagtttgggttcaaaaagacttctctttagctattcctggttacctagagaagcaaaagggtatgaacatgaggttagaaataaaagatgacagtttttttaatgacaactgctctattccaagacagtctgcataaagttactaattactctgatgtttaaaagtctgtaagaggtggccgggcatggtggctcatgcctgtaatcccagcactttgggaggccgaggcgggcgggtcacctgaggtcaggagttcgaaaccagcctgaccaacatggagaaaccctgtctctactaaaaaatacaaaattagacaggcatggtggcgcatgcctataatcccagctacttgggaggctgaggcaggtgaatcgcttgaacctgggaggcggaagttgcagtgagccgagatcccgccactgcaccgcagcctgggcagtaagagcaaaactctgtctcgtttctaagaggcaaaacaaaatccaaatgttaatggcagcattaaaaagaaacatcctggaaggacacatgaggaactagtaatacaacgttcactacagaggaaaactgggtgatgaaaaaacaggggtgggagggagactgatttttccaccgtataatcatggttgatttttcagttatgtacatgctactttatgtttttaagtaactttttttttttttaaagggacagactctcactatgttgcccggtatggagtgcagtggctgttcacagatgtgatcactgcacactagcctggaatttctgggctcaagtgaccctcctgcctcaacctcccaagcagctgggactacaggtgaatgctgccacgtctggctagaaatacactttttgaaggcaaaaacagtcataaacatacaaatatcagaatgctaaaaaaaatagaattgccttttaacagaaaaaactgacttcaaagaaaaaagacaagaatagtcttgtcataaatagacacgaattaaattgcccaaaagtcctatttaaacatttaattgtgctgactataaaagtgatatacttttatatataaatactagaaaaaaaaatacaggacttttctgggtcacccatactcattactaaaaatttggtcaattaatctctaaaagttcataattaagtgttaacatttttagaagtatgctttatcaagctaagaaaactcttatttctaatttgttaatatgaatagcaaattttatagaaagccctttctggatccatgatgatcataaagtgcttcttaaatatgattatgtggtatcttatactaatagatttcctgtagttgagtcatccttgaatgacaataaacattacctagacattttttttttttttttttttgagacggaattttgctcatcgcccaagctgcagtgcagtggctcaatctgggctcaccgcaacctgtgcctcctgggttcaagcaattctcctgcctcagcctcccgagtagctgggattacaggcacatgccaccacacccagctagtttttgtattttcagtagagaccgggtttcactatgttggccaggctagtctgaaactcctgacctcaggtgatctgcctgcctcggcctcccaaagtgctaggattacaggcgtgagccaccatgcctagttatgtttttgtggttttgtttttaataaaccactgaattctagtttctgatattttatttatgacttttgcatctatgtttataaagagtggcataaacttttctttcgctattcttgtttaattgtggtataaaataagcttaagtgttctttattaaagaaactaaaggttaggactgggttttttctaattcatattaaaaacaatacagattccaatggactggtggaaaaaatgatactgaaacaaacatcaggaatctttgacaatattctgattatttccttgggatgaaagatcaaaaatgtgattacatggtcagagtaccaccttaggaaagtccttttaatttatgcttatgaaaataaattttgcattcctatacatttatgtataatcaatattataaaatagccattttagaccccatagtccttacttttaactttacagacctccatccccactgcaatttcaattttgctttactgtggataataatatattgaaagctttttccttatgtctgattctttatctaaatatcaattgccattctgatttcacgaccaagttgtctcccatccctcggactcaaaaatgtttgagatgaaaaagcttcctgaaattttttattatttagctcactgcagcttttattgaggttaagctctacctataaattactctgtgtcaccacagaaaatggtgggaagggagcgacagtgacgtatctataactacagcttttaaactgccagaggcaacaagagtaatgagatgaggggagtgggagggacacaaagccaggactatgtttctgccctaactttaaccccactctaatattaaggggctgaaagtagagaggaggaactgttcagtaaacatttcaacagaaaacatttgccatttcttaaaattaagcaatttgtttcccgttcttcatcagctgaacttagttgtattttttggcttataaaaccataaaggcactttactaacattttacttgaaattctgagtaaacgtgcttacaaatccattgtgtatcacattttgaataattctgtttaagctaaggtttggatttagccataacaaatcttttccatcccacttcccatcttttacactctacatataaatgagttccctgaattccaactaaatttcttacatttaagaatatttagttgttaagaaatgactaataacctgacacaatttaattgttctactactaaaaacaagctttataaaatatatggcactaagctacagtgtgtaaaaagttaaaatttttttgatagaccatgatcaataataacaaatctccatttttgcaacatctaaaaaaaccaccaaattaggcaaatttctacgcttcaaggaaacttcaatagtgaaaaacaagataatggacaattatcacttcaacttcattaatcaggtgagagggcagaaaaaaatgtttttaatgatgaagcagctccagaatatgagctctcagagatctctatctccaaaagaggctgtaaaaagaatgggaaataaggaaaagagctatgactaaggtgacctcctccacaggttaaataccagcaatggccaattttagtactgctgtacctccctaaaagattagactctctcaggctctgctctggataacctcactgcaatggcaacttgagccttgttgaagttgtgcaaaaacatggctctatctctgctgtatcacacagctcccttcaatcaagtgataccagtctcccggcctccattcttgacagcctcaaggagttttctcgctgcaacccacgttgcacttgaaattaatctgacttctgagccttcagaccctacggcacttaaacggccccaacctcacccgtcaccctcaggttaagtgtgaacactggcacagcatgaagtgactccttactacctatacacactatggccatttgccaccccttactttatactctaaggatacccaacttgtttggaacgcttcaccaatcctcccccacctcccaatctccacaccaccgcactacatgtgatgaaacaggcttctcctaattcctcctttaccccgctcaactcaaaatcaccagtattcctccagaaggaaactttccacaagcctcctctggatatagccccaagcatacttcttttataacatctaccaagcctcatgaaaccatctttttctaagtttatctcccttactaggaagtaagtagtttaaaagcaaacactgtatcttaactccagtgaggaagagcacaccaggcacatagtgggcatatgataaatggttacctaattgaaatcccaagcactacacaatgaagaatgaaatatagcttgacttctcagcccattcaccaggaagtcctcagttccacttctaaaacccatgccaaatctgtttacttcgtgtgctagcacagccaccacgccagtccagcctctatcgtcttgcatttagattcctcacagcctcctaattttcctgcttccatctaccctactacacacataccactctcccgcagccagaaaaatctttgtaaaaatatgtaagatcctctttaaaatccatcagaataaacttacttgcatcctgttatattcagactaacattcaaactctcaccacactctaggatgccctgtataagctttgggcaagtcttgtcctccatctacactgggctccttttaaatattctaatacaagaagctcacctcagtgtcttcactctggctcttccctctgcctagaagactcttccctcagttggctgctgcttctccaagctccacgcaagcatcacaatccgacccaaagcagctttttaattcttcattctatcatatcactgcatttggttgtcttctttgcactcattaccatatcaaattataattaatttgtttacttgtttatcgtgtatttctatcccttaggaaggcaggagttttgtgttttgttaatcactgttatcctcatatgtctagaaacagtgccttctacatagcaaacactcaataagcatttgtaaaacaaatcaacaaaccaaaaaagcaacctttaagatatacataaaacaagtaagggaaagaaatggatggtctaccaaacaaggcaagaaacattctactgttagtatttgcaactagacaggctgcactggtgttattgggatctgttatctataagcatcaaaagtgtacttctcaaagttcaaagtcaagtagaatggtttcacatgctatatgctagcccacggtatgacactgcaaactatcattttagagaattcttacatttaacaatctccccaaaatctgtaatgtacacaagtagtaaaacacactttaaaacacctgtcacttaattaaaaaacaatacttatgacagtggtacttatctgtaaatgattaaatttatcctcagaaaacttcagacttttaaagtaacaggtcctcctaacctaagaggcaggtctttaagacaggttctgactaatgcctacaacaattaagaagccacctaacacactattctttcttggaagcaatgctgcaacgcaaagaaaaaccatataaaattcattaaaaagtgagcagcctcttttcacccctgatgaaagttttgactaaaggaggagaaaactgtaggttgctactatgttagtgatagaaaaagcttcaattctttattcaagtatcattcaatcacggaaatgaggataacatacaaatgtaggcaatgaagataataaatctaagtatcttatttagcttgattaaacctcactattcaagaaaataatttataaaacaagtcagctagcaaaaacaatttatacaaggttaaaaacagtcatatttcaatcatcactttttacaggcaacttgaaaggaacacaaattcagtaactttccttcagattccttgacataatttgatcaaacctgggatctaacaaaacttaccttggtatggtaacacatttagtattacagttttgagtggtgatggctttctcaagctcatctaatcgtcctgttttctttagcttcttcaccagacttttcactgctttctcacaccacttttcttcctgcccattctgctctcctccgcctgctcctccagacccaccagctgacttcttccatcccagcagtctcttcacaactggcggcgtgaatggcaagatggacgacatgttcttaccaaaggcagcaagccacgctaggaaaacagcctcttgtatcgaacctagcagaaatattgaaaggatgatgtagagactaccttgaacatcaagtaataatttcaacttatcatagaaagcaaactgcaaagcaagatagaaattcgaattatgactttcccaatagacttctccacccatgaaaacgttatctttatgaatttaaatgaatgatggaaacaaacccttctaaaaacaagaatgttgtaaggactcctcttgtgggaaaatacagtaattttgcaagtaaaatcagatacttttaacgatttttcaccaccaatactattttaaactcttagtagtgtcaattaaaatattttcacaaaaggttctcttactttttagaacttcactctaatctcaaaagactatacaaaaatacattgaaaatttgtaagcccactctcccccgggttttaaactttcataactaataggaggcaaaatctacagttacaagaagggaaaatgcgtaaagtgtgaagtaatcaagaataaagaaataaacatggcaaacagagtccgtggagaaaagctgtagtccggtttcacctgctcttgagagaaattttttaacacatgtttttttcattttcatctaaataacaatttgcatagtgagtaaagtcagatagtttctcttcccaatttaaggaattgtaccttgtcttttctcttccataggaatcatttttattaagctgttttgtctattcagcgtcattttacaaatataaacatgtatacatacaactaaccacattcccaccttattgctgtacaaaagtagcataatattccttattttgtatatcttgaaattatttttttatttttatttttttgcttaattccctgtaggtcattccttatcagttcacacagaatttagaaagcactgtcccctcaattttctagactccactactgatactggtaagtcccacataacttttattcctgatcctttaattggggtttaaaaattgtttcgctccagaagctcttaatatcttagctcttacgcttttctttcctttgccttcaattttagtgagatataggaaaaaggaaaatgaatgtgttcaatttgccatatttaataaagttcccaaaaggcatcctttttagaaagtaaagaggtctgtagtctttacatcacacaccccaaatactgaaattgtagttttcaaagtgtatctttaagaaaacaatgatgcttacattttcattagtttgttccttaattatcataatgatcagacaatagtttttaaacgtagaggaggaagtacaagttaaaataataataaggcatcatttcatgcccaatctagctggcaaaaattgaattaattaaaatacctactgctggagaagatgtgaagaaattgttatcattccacattgctggtgaaaaggtcaaatgtgacagctttattctaagtaatctggcaatgtgccacgtgttacaactagtaactggattatacgtgtataaacaaaaatctaggatattaatatgggttgcagatataccaatatgcagaaaagggggtgaaaagatgaaaaaggctgaatgatatggccattgtgtatgtttttgtgtatgtgtgtacaaaaaactggataaaacatttttaaaggaaaaaaacagtttttaagcacactttgcacatattcttaacgttaaagaagatcctaacacaagatgcaaatttatttcccatcaaagaacatggctaattttcatagattatatgctaagattcatttccaatgtacacaaactgcattcctgctctaacctctccataattccattattttggtttgcaccacatggaagaataatttttttttttaaatattccctcttctcaggatggtcaatgactagtgaagaagactgccatgattaaaatacacatgacaattaagagaaattgcaagggggattacaggtacacaaagaaacaccatctgattttgctttaggcgtcaggaaagattttcctgaggaaatatttgcacttccttggcagcttgccatttattcattcctttttgcattcaacaattttttttttttgcctgtctattgtgcctgtatttacctgtttattctcaaatccagtctgtgttattcatctgcaaactacactgttgagctgggacgggtaggacaaaagaaatcctttgtagcaaggtattggcagtggggaatggagaaggggtaagtttttaagggcagagagatcaaccagcagagaattgcaatacacaaaaggaagaatagctattagggacatagaaggaacagagttgattaagaaaaagttacaaattacaggttcttgcttgaaaaaccagttgaatgaaaatacaattcgccaaaatacgaagtatttggggaacataagtgttgtgttagtcaaactaaatttgctgtgactatgaaattccagaaggaggtgcccgataagcagctagaaacaaaggtttggagcttagcagagagatcaaactgtcatgtggtaatgaaacgcaatgctggtatatgggagagctcagaaagcgccaagttcagtgaaaaaaaaattctaagaaatacatataaaggagttatcaaatgtggaaaaaaagtggatgattagggagaaaggtgtcatgaatacaaaggacaatttatagcaacacaacatggtaacacaacttttaagtgccaacactaggatttatatcaagcagcatgatgccagagaacaagtacttaattgtgtcaatgcattgtgttgcacataacaatctgaagctaatctggagacctaaaaagagccattaaaggctgagctctttatacaatcaacagagctatctgtgcctgacaaattagtccattagataggattagaatgacacatttagctccaactcctttctcaatctacaaatcatttaactagtctttcagtcaccaccttctaccttctttgatgcaaacagctttctaaaatgcatactgcatgtcaccctactactaaaaatccttcaatatttgcaaaaagtaacagtaaaatgacttaatatcctttaagaacccataaacagtgtaatgcttcagagaacagattctgaagccaattggccaggttcaaatcccaaggatgccacttactagctgcatggcaacctctatacaccccagttttctcagctgtaaaataaggataacagtacctatcttaaagccaatataacaacctctataaaaatgtaatatgagctacatatgtactttaagttctctaatgacattttaaaaagggaaagaaaataggcaacattttaatgatgtatttaacccaatatatccaaaatgccatcatttcaacctgcaatcaatataaaaaaaattttcatactaagtctacaaaatctgttgagtactttacacttacaggacaactcaactaggactagccacatttcaagtactcaatagctacacaaaggtgctgcctacccatattgaatgatccagccctaactactcaaaatttctgcctactctgcctatcccatattctccataaactgttcataaatgcctctatttaacggctgtaggatccgtagtgatgtgacatttttcaattcctattatttaaatttatgttctctctccccctccccatcctccttttatcagttttgctaagtggtcaattacattaatcttttcaaagaaccaactttttcttagctttgtcaattttctctatgtaagattactttctattcactaatttctgctcttgtcttcattatttctttacttctactgtctttaggtttgatttcctattccttttctacctccttaaaaaagctttcttttccaatgcatagacttaaggctataaatttcatcttagcatttcagcagcagcaatctagatcattgtagttcaccttcattttcaatcagtttaaaatattttctaatagccatcataaattcttattttaagtcatatgttattcaaaagcatagtgttttatttctaggcagctaggaattttctagttatttttatttactataatacaaacaacatattcaattattaaaatcaatgatatttgctgaggctttgttcatggccctagcttatggtcaattctagtacaatttccatgtgcaagggaaaagatggttaataccaccattaatagtttcaatgttctacatatgacaattagatcaagcctgctaattgtgatgtatgtatgtcctatatatgtgcatccattgtgatggcatatttgtctgtttcttttagttcaaaataaaatttttggtttatagatgtttgggctattttactgggtacacataaaggattgtggtaactctggtggatcaatccccttacactataaaatgtagttctctttttctactactgtttattgtattaaagtctcctttgcctgattggtatagccacacttatttccttcagttagcatttggatggtataccttttcgcatcattttctctcaatctttctaggtacttatatttaggtaattattatttgtccagtctgatgatttttgccatttacttgaaatatttagcccatttccatgtaacataattactaatttagttgcctgcttgttttatattttctttcttgtcttcttctgaatttatcacatattctatatccaatttttttctgtattcatttgttacattcttttcttttagtggttaccctagatattttcttattcatccttcacttaacacaattttcatacatatacttttactacttcctctataatgccagaatcatagaacactgctgagtagcagttttgctatgaaggagactacctctggtttgtccctgttcctaggatgagactctgcagagccttcatttcaaaagctagcagatcgttatcttctaggtacctagatactataagaattgctttgtttttaagagacttctggtttagctctctagcctaagcagcttcagaatttggcaaatgtctacgggggaagaaactgggtgtgttgaaaatcatcagtgtgtattcaccacttcctcaaacgctttcaactctcacctattgttctcaagtcgcttcccctagagaatctttatctcaacaccataggactagaaaatatcccaatctccttttctgagattttggtttatctcttccgcccagctgaactacagaatttaggaatatactgagggcgttctctgtgtttaaaggcccctcatatttccaatctgccactcaggctgcagcccaaaggcctcctctactctgtacccaggaaaaacaatgatcagctgcagacctctcagctcacttgtgaaaggtattcccccagggtgcaaaattttgctttctttaatcatttttacacccattgttctctatcgctaaatatataaattttgtaaattacctggcttttctagttgttttattaagagtcttggactaccaagaactactgcatcctatcccccaaaacgttctaattccatttgaatagtaagtcttccacaactataaatctatgagttgaaataatttgttgatgactttaatttcaaaataagacacaagatcacttaccacttgaggacagagatggagagttaagatttgagaacaggaaaaaatagagaaacgtagccctgagaaaatcaaccattatgaaacaacagaaaacgtgtcagttatgtattatcagactatatacttaaaaagtattccatagaaggaattccacttctgattaggacgtagaaagttacaacagagcatcactttcattctaataatcaaaactagccagataagctacaaaatcatggtctctctgaaccagagttgaggatacaaagcagcctaagaagaactaaattccaagtgttgagccttgagagaagagaggctgcatggatggtctctttcctggtggagcggctagtgaggaataatcctgccataaatgaaagaaagaagaaaccagcctacatgcacaccgacatgacatattaaattgcaaggatcccacagagcaagtgtgcatccaccccaaccactcatccccataggtttccactaagtacttgcaaaaagtatgtcaaagcttggggaacaggactggaaagctgagggagatcccctaaggagcttaagatctcccataaatgcaaaaaatctaccctcatcaatgggggatggggggagggacaggcaagaaaggtgagaaaaagatgatcccaagagagtctagacattgagctgccaagggctgcggtaggacaggaaagatgagaaaactttcacccagatactcaggacattgatctaccgaggctgaaatgagtagcgaacttgaagacagggtaggattgctaaaagaaacctctggaaggtattaatagcagaaagatgtctcactgggcacaaaagcttggaggcaggactagagaaagagggggtggggggaaagaaaataagaatgaccaaggaattgacagctgagctatagagaaatttctcatggttcagaaagctgacggctcagctataaaccaaaaagagatccaaaatcacacttggacaaaacaagaaatgatggaccattttctaaaagtaaatattatttacttcaatctccattgtttttatacaaatgttcagcattcaatcaaaaattacaagatacagggagtagcaaacagtcaaaacatgaataaaatcagataactataataaaaatgctaaagaaactgatggaagagatagcaacatgaataatgaaaaaacttcatcacagatatcaaagttacaaaagaggatcacaggaaaacgttagaaatgaaaactatagtattagaaattaaggataccattagatgggcttaacagaaatgagcagtgaacttgaagacaggccaaattaaagtatgcaaattgaaacacaaagagggaaaaaacagtgtgggggggggggggactcagaatatccaaaaccaaatgtcagttgggtttaattggggtgccagagaaagatgaaagacaatggggaacaaaaaaatgtatgaagagataatggccataaacttttcaagagatgacagatattaatccacatatggaaagaaaacacattcatggtcaacctgctgaatattaaagataaaagtaaggatgaaaggccgagctaggataacagttaaaatccctgggagtcctcgatagaaagagaatctgcactcattcacaagctcttttccaagggcctcaactgagtgctcttgaaaaaaggcagaaaacggaagagagctccttcctcccatttggtggcatctcgtatgaagcaaatgccttcaactatgacgggagaggcaggaaagtctaccaaacccaagggcaagcaaagatcccctgcctcaaagggaagggtagagcaaaagacatgtgctgctgagttgggggatttgtggagcaaaacttacttgcccatctcccacacacaaacatgcctttcactctgtaacaataaccaccatattctactgccacgggaagggaggaaacattgctaccaccagtcccagacaaaggcacacagatgctgaggaatgagaagcaacagctgtctgatactgaaaaagggacaacaagccggcttgggcccaagatcccgtactaatacacagcaaaggtctgttactactagatgcaaaaatcctaaacaaaatattagcaaatcacatccagcaacataatagaaaaggtcatcatcactaagtaggatttatcccaaggagcaaaattggtttaacattcaaaaatcaagcacctcatttatagtacaaaggagaaaacgcacctatgattctctcaaatgagcgagaaaaaaggtatctgaaaatgttaattcaacactcatctataatttaaaactcccagcaacactagaaaagaatgttcttcaatctgaaaaggacatctatgaaaaacctagagctagcatatgtcataaagaaacattaaatctctcccttacaactgggaataagacaaagatgtccacggttaccctttctattcagtaatgcattggatattgtagacaggacaactatgcaacaaagaaaagatagactggaaagaaataaataaaactgactttatattctacagtgatatgactgtctccatggaaaagtgcatggaatctacaagtaatctacttactggaactagtaagtaaatttagcaaggtttcaagataaagggtcaagatttggaaaatgaaatttcaagaaatacgcttgaaacaacagatattttctacatatctaaagaaagatactcaagatctcaacactaagaattacaaaatattgctaagaaaaatgaaaaacactgaacaaagagagatcatgttcatagacttgaagattcatattgcttaaatgtccattctttccaatttgatatatggattcaatgtaatccctaccaaacttccagcagagttaagcaattcatatgatataaaattcatatggaaacaaaaaaaaaaactagaataaccaaaccattcttgaaaaagaaaactggaggccttacaccaccttatttcaaggcttactaaaaagacttagtaatcaagagtatagagtaggcataagaaaaaaagatcagtggaacagaacaagtctagaaatagacccacacatatacagtcaactcattttccagtaaggcccaaggtcaatctagttttcaacaacttttcaacaacatggaaaataacaagcctcaaccacaagtgcataccatcttcaatgggaaagcagaatcttaagctcttagaggaaaacacagaatacattcatgaccttaaaacataaaaagcattaaccacaagagaaatacagttgagccacgcatggtggctcacacctgtaatcccagcactttgggaggccaaaataggaggactgcttgagctctagtgttcaagaccagcctggacagcatggcaagaccccatctctactaaaaaacaaaaaatacaaaaaaaatagctgggcgtggtgcctcctgtgctcccagttaggaggctgaggtgggaggatcatttgagcacaggggtgcggaggctgcagtgagccaagatcactccattgcactccaggctgagtggcagaacaagaccatgtctcaaaaagaaaaaaaaagaaatagaaaaagaaaaaaaaaatacaggctgagcatcacaaatccgaaaactgaaatctaaaatgctccaaaatctgaaacttcttgagtaccaacatgacacccccaaaaaaacggtcattgtactatacagctataatgcaaatattctaaaaattggaaaaaatctgaaccacttcgggtcccaagcattttggataagggatactcaaatctgtgtatgtaacataaaccaacaaaatttaaaaatcacacaaaaaggtaagctcagcttttttgttaaacaggaaaagaataatagacatgtcataaaagacacaggagcacatgaagaggtatttagtatcaccaatcatcaggaaaacgcaaactaaaaccataatgcaataccatttcacaccatctagaatggtttaaaatttttctgacactactaaatgttgatgaagatgtggagtgtattagtatactactgctgctgtaacaaataatcgcaatcacagcacaaatttagcaaaatcagtttcaatgaactacagtcacagtgttggcaggactgattcctcctggagtgtctgaggggaagttcgtccttgcctttttcagcttctagtggttacctgtagtctttagcttgtgctcccttcccttagcttgtgctctctcccccaccttcagagcacatcattccaatctctgcttccatcgtcacactgccttctcttctgtattcaaatctccctctatggccttctagtaagagctcttggcattacatttaaagcccacccagataatccaggatcatctctccatctcaagatccttaatttaatcacatctgtaaagtctctcttgccatataaaacaacattcacaggttcttgggattagaacctgaatatctttggagaccatgattcagtctaccacatcaagcaactagaacattcataaactgctgaaatgaaagtataaaatggtatatagcacaattggaaaaccggcaagttccaaaaagttaaacatagatctaccctgtatcacacattcaggaaaaataaatacgtatgtccacaaaaagaaacctgtataagaatgttcatagtagccatgttaataatcgccaaaaactaaaaacagccaaaatatcaaaagaaaacaaataattatagtgtgctcataaaaaggaatactgctcaggaacaaatatgaatgagcttatacactccacaacacggatcagtctcaaaaacatgctgggcaaaagacaaagaaatatagactgatttcattcatggcttcccacaacaggcaaaactaatctaatgacaagtcaagatgaccatctcagaggcactaaggaagagaagtggaaatgtttggacagaagcacaaagtacctttctacggtgacaaaagtgttctctatctttgttttattccctcgctcctgtaaatccactgttgaattcctgaatgttttctatcttgagaggtaatcacacatgagtacaagttaccaaaactcacagaactggccgagcccagtggctcacacctataatcccagcactttgggaggctgaggcagacagattgcttgatttctggagttcaagaccagtatgagcaacatggcgaaaccctgtctctacaaaaaatacagaaaaaagttagccatgtgcatgtctatactcctagctacttgaaaggatcactagagcccaggaggcagaggctgcagtgagccgagatcgtgccactgcactccagcaccctgggcgagagagtgagactctatctcaaaaacactcacagaactgaacatttgaagtctgtgcattttagcaatgtaaattacaattcaaaaaaatttaaaaggtgcctggacaaacacattaagaagttcctaaattaagttaaatagacttctttactgaagaacttctcaaaagcttcaacatgccaatgcacattacaaatttcagaagggaggaggttgcaagtgaccaaagatgtaagcttggaagtttccgtccacaacatgcagatagcctctgcaagtacatgtaggcaaatgttcgtggatggagggtggaaggggtattgttttgaggacaaaaattgagagcccaaatgacagccatcacaaacatacatgaggcactgacaaaatggttgttgtaacagagctatataattgacccgtggacaacatgggtttaaactgtataggtccatttatacacagattttattcaagaaacattgcaaaatgtcttggagatttgagacaatctgaaaaaaactcataaaccaggtagcctagaaacactgaaaaaaactaagaaaaaggtatgttataaagcataaaagatatgtagatactactctatcatttaccatcatgaaatacaaaaatctactataaaaagttaaaatttatcaaaacttacacaaacacagaccatacatggagccatttacagttgagaaatgtaaacattcagatgaagtattaaatcattaactacataaaattaacggtagtacatactgtactactgtaataatttcatcgccacctcctgttgctatcacggtgagcggaagtgttgcgagtatccactgtgtgaggctaatcatctctgcatgagcagttcttctctccagtaaattatcacagtaaaaagtgatctctcacatttctcatgtaattttcaccatgtgtagtgcaataccataagccttgactaataccatgagatccatacgatgtgccactagtgatgctgacagtgctcccaagaagcagagaaaaatcatgacattacaagaaaaactccaattgcttggtatgtaccacagactgaggtctgcagctgcagttgcccaccatttcaagataaatgaatccagtgtaagaactacagctaaaaaaaaaaaaaaaagaaaatttgtgaagctgccactgcagctaggccaacaggtgtgaagatcttgcaccttttgtgaaacaacttttgatctcatattgaaaatgcaggttttatgtaggtacaggattgctataaagaaaggcgtacctatagactattacatggtttgagaaaaagcggagtcattatatgacaacttaaagcaaaattaaggtgaaggatctaaagctggaaaatttaatgaaatcaaaagatggttgagaatttagaaacaggctggcttaaaaaatgtcaagataacaggaaaggagcttctgtcaaccaaagtagatgagttagttcctaggcaccattaagaaaatcactgaggagaaagggtatctgcctgaacgggtttttaatgcaggcgcaagtgctgtattctaggggaaaaaactgccacaaaggacatttattagcaaaaagagaaacaagcaccagatctgaggtaggaaaggacaggctaactctactgttttgtgcaaatatgtccaggtttatgatcagcactgcccttctctataaagctgctgacctccaatccttgaagggaaaagataaacaccggctgccacaacaaaaaggccagggcaaccagaacgcttttctctggattcgttccatcaatgctttgtccctgaagtcaagtaccctgccagtaaaagactgccttttaaagttcttttgacattggacaatgtcgctggtaacccacaatcccatgattccaacaccaaatatgtcaaagtgatctacttgtccctgaacacattaataacatctctaaatcagggagtcataaggacctttaaggctcattacacacagtactccatggaaaagaccgtcaatgttacaaaaaagaactctgatagagtgtcatcaaagtatggaaggattacgccatggaagatgccattgctgttatagaaaaaaccatgaaagccatcaagtccaaaatgatacattcctactagagaaaacagtatccagatgtgcccgacttcacagcatttacaccagagcctatcgaggaaatcataagagattgtggatatggaaaaaaaaaaaaaaaagtggggagtgaagggcttcaagagatggatctttttagagaaattcaagggctaacagactccacacatcagaggaattaacagaagacgacgtaacagagatcagtgcttctaaactagctccagatgatgaggaagaagatgcagaagaagcagtgccagaaaacaaattgacataggacaatctagctatatataatatagggttctaattattgaaggctgcttttgacttcttttataacacagatccttccattacatgggcactgaaactaaagcaaaaggtgtaaggaggactggtaccacacagaaacatttttggagaaatgaaaatgcaaaaagtcaggcaaaaattgcttattttcataaagttacactgaatgtgcctgactcccagtctgcctcttctacctgtgagacagcatgaccaaccactcctcagcctactcagagtgaagacaatgaggatgaagaccttcatgatgatccacttccacttagtgaatagtatatgtattttctcttccttatgattttcttagtaggtttcttttctctagcttaaagaatacagtttatcatgcatgtgacatgcaaaatatgggttaatcaactgtttatgtattggtaaggcttccagtcaacagtaggtcgtaagttttaggagagtcaaaagttatacacagattcttcactgtgcaggacagcaccccaaccaccccattgttcaagggtcaactgtatatttactaaaaaagaaacattaaataaaagctcaaaaaaggactttaaattatcaaaagaatgttctcaaaaaaggtcctcaaactgaggatattcagcccttggtataatttgctagaaaataatggccataactgccaggcgtggtggctcacgcctgtaatcccagcactttgagaggcagaggcggttggatcacgaggtcaggcattcgagaactagcctgaccaacatggtgaaaccccatgtctactaaaaatacaaaaattagctgggcgtggtggcgagtgcctgtagtcccaactactcgtgaggctgaggcaggagaatcgcttgaacctgggaggcagaggttgcagtgagccaaaaccacgccactgcactctagtctgggcaacagagcgagactccatctggaaaaaaaaaaaaaaagaaaataatggccataacctaatataatcatactcacgcccctcgaaacagaaaaaaaatcaatgcatcctcaagctcaattcaggagactggccccaaggcctccctccaggaagaggcaacacagcatgccaaatttcataaatttcataaatttggccatgtcaaccctttttagggatgtatggaatgccacataacaatactgcattggcaaccttgggagtccaactagggttcaaacactaaaaatttgaaaggagtcaataataggattatgtaactttctttagcaatatagtagaaatggtgggaaagtgaggtttgcatagaattagggaactgtaatgcaaataaaagagcaacagtgaacttaacagcccggttaaactgtctatagtggtagacctataatacgacacataaataagcactgtagtatgtaacttgataaaataaagcaaatacacaaaactccatcaaacgcatgtaatcatctaccaactaataacctgggactatcaggcagcaaaaagtgtacttggctacctttggcccctgttggattcctactctgtgccacaaagtatgctctagaggagccaactacagacaccgtagtatcatgtgacacagtcttatcctagcacagagaacaggattcaacctttggaagggaaaggtgacactaaagttgacaccagagcacaagtattgagagagatagtacagcaggcagaaagttcagcatgttttctaaagacaggaaacgttttaggagagacgaaaaatttaggttatcactaaaatacggtgcacaggaagcactgtggcagaagatgaggggaaaataaggccagtgcagattaaagagctgaagacagaaattactgctaatgataggagtattacttcatttattccagtgacaatttgcattttgaatgacctactggacgtgcagtttagggaaaaggattgaaacacaactaatgtgaccgactacctaatgtaactgagtggcatgtaatggtacattcatcactattaggaatgaggaaagagaagcaaccctgaaggctaaagggtcagttttatacatgcctttatgtaagtaactatgttcatcacatggccaggaggcagcataaaatatagtagactcaggggagctagcagtcagtgtacaagtaagagtgtgtgccagagctaggcagagacaactggtgtcttgaagaaaagcagagcagccaatctctaggcttggtttctgaggactgtccaggcctgttccagctccacaattatatcctcagaacaaaacctctttttgagttagcatgagtaatctctctgttccttgtgaaaaactgatagaaaaagcaaaataaaagaatctccctacaagtatctgtatctttggttcaattattccattcataagaatttagcctaaaaaaagaataaaaaatgaaacttctgtataaacagcaaaaaaaaaaaaaaaaaaaaaagggatttccagcattaggaggaatgagagtaaacagtttctgtaacactttttttttttgaggagtttcactcttgttgcccaggttggagtgcaatggcgtgacctcagctcactgcaacctccacctcccaggttcaagcagttctcctgcctcagcctccggagtagctgggattacaggcacgcgtcaacacgctcggctaattttttgtgtttttagtagagatggggtttcaccatattggccaggctggtctcaaactcctgacctcagatgatccatccgcctcggcctcccaaagcacagggattacaggcatgagccacagcgcccagcctgttacactttcgttaggagaaatgtttcttatgagttaagctgtattcctggggatctaaaagttttctataaaacctttacaatattgtttcttcactgaaatgaaactaacttaagtttaggcctattctgggtcatctgaatggccacatgacctggtattgccacatgatttcagtgtcccatgtcttacaagaggagttaaaaccattttggaactaagtgaacacttaaagttgccagccttacctttgcatgtctcagtaaccatggttggctgacatctgtctaatatctccggagaatttttaaattatgtaataaaataacatttgttgtaagtaatgctgataatacatcttcaattagttaagcttttattttaaaaactgaagcatttttagccaatatttttgaagtgtaaatagactgaatgtaggctgacaaggaacagataacaatgtgttccaggttaaaaacaaatgaaatacaaaaaagaaaactagatttataatcaagttgctatcaaaacgtgaatgagtcatttacagaatatacagatttccttcaatggtgtggcagcaagttctctactgaaataaattttcaacatctgcaagaattgaaatctaagttcagacactatttctaattccagcaataagtgatacttacataatgcagatttcaaaagaacacaaagactatctttacagctgaataagtcagcttaccaaatgataccttagtaaaattaggattctacgattactcaccggaaagtttcaataaggtaagaggtctaattatcctgaacttgtagtaaagccttcaagttattaactctatattatagtttgacaaatagcattctctgcacatttaattaaacaacagtgcatactctttccagagtcctcaactatgtggtccttttcttactgtttttattctgacataaaccctatcactgagtatgtattacaaaaaaatctccaaatccttagaatgacttttcattttatgttgtcttttggaacacacaaagctgtattttaattaaaaatcttttatgccacaaccttgcttttcaaagaaatcttgctgtgcctctaaatatagtaggaaacatttattgagtgcttaagcctaagagtccagtaagcaagaattccgaatcctaagaaccaactggggttaggtactattatttacaaatgaagaatgtgaggcacaaataaataccctgacgtaatacagagaatcccctctagatattcttatggatgctttagtttacttttcatattaagtttctaaaagaaagatcagaaatttggttttaagaggtgagacagtgatctaaccatctctcataaggacagcctgtgtattaaagcttaccttttgctaagtcataatgccacttctgtcgcataacaaattcctactaaaggtctgatcacacgcattctgttatttgttcacacttaacatcaatgtaagaaaatattaattactactgctttctagttagtcttgatatttgtcagggtgaccccccttccttatttttcagatgtgtagtattgctggttactttaagtttagcatgttctacaaaaatcctataggattttgattggaagtgcaatgaatttatattagtttatggagaacatatttatgatatcaagtactccgactatgcaaatgagtatttccatttatttattatctattgataagttgcatattttctccataaaaaatcttacatcttgtcaaatttacttatttctccaggtatcttggtttttattgtaaatggggactttaattacacaaaaatattacactcaacactcatgtactttccatctagctgtcatatcttagcattttgcagtacttgatcagacataagaaataagatacgaatacagctaaagccccctatgtattcctctttgataacatttccctccctcttgcttctcagagattatcactatcctgatgttcccccatggtcatttaacagttttgctacatattgtatccatacaatacagttctgtacattttataaatttatatgaaagtgtgatactgttcagtccatgctgatacatacataatcctaaatcctagttcattcattttagctgtcacatggcattccattttatgactagcacagttcactgtccattcactctggatgactagttaggtttccaattttcctctctcacaacctgctatgaataggctggtatatatcattttataccatgtaaaagctcttctagggcagaaaatttcaaactttcaaactttttaaccaaaaaaagtcccacagtgaaaagtacattttacatgcaacctagtatatacacacacactttgctaaaaaagacatttcaccatatgctgcactctacaatttctctaaactgagggtcgcgaaccgtgagtgggcatgaaatcaataattctaacaaatgtttacactaatgtaaccacaatccccaaaaaaacaacatttccagcacctcagatgtctcccttacgttccttttcagtcaatccaccttcccccgtcaggcaactactgacttctattactattaattttacctgttccagaaattcatatagatggaattataccgtatgtactcttctgtgttttttaacacccttttgaaagttctcttgtattcatttcctaagaatttttgtcatgaacaagtactaaatgttatcatatgctttcccgttgtccatcaaaattatcatatggcctttctcctttaatgtgttaacatgatgaatttcatttacgagttttctaatgcttaatcatccctacattcctgagacaaaccctaattagtcatggtatttttgttttgagtaaatactaacattttacaaactacaatttttattgccatgttctttggtgagaatgcagcctatatccccttctcacactatctggttggggtatcaagattatagtagccttgcaaaataatttttctgtaacattttgtataagattagagttaatccctcacgtttggttgcacttgcccatacggggtcttcatttgtagtctggtgttttgcttgaggacttaaaattttacattggtacaggtatatttatttatttattttgttttgttttgttttgttttgagacagagtctcactctgtcgcccaggctggagtgcagtggcacgatcttgtctcactgcaacctctgtctcctgggctctgcctcagccacctgattagctgggattacaggcgactgcaaccatgcttggctaatttttgtatttttgatagagatagggcttcaccatgttggccaggctggtctcaaactgctgacttcaagtgatcgcccaccttggcctcccaaagtggtagccaccatgccccgcctggtataggtatatttctaaacatgactaagtttttaaatcataatctagtgaagtttctaattcttattaagccaacttggtaatttgttttgctagaaattgtccactttacctgtttccaaatttaaagaaataaaactgttcacagtattcttgcagttttaaaatctcagtttgtctgcagttataccatcccttcatttccaatacatttgtacattctttttctcctctatcagtcttggcactcttttcaacttagttacatgcactaaatcaaagacactatttttgttgttgtcgttgttgagacagagtctcgctgacactatttttgttgtcgttgttgagacggagtctcgctctgtcgcccagcctggagtgcagtggtatgatctcggctcactgcaacctctgcctcctgggttcaagcgattccccttacagaatgtatcttctgtaattgttgggtgcttgctaattgtactcttccaatccttcataaccttgtagttttttaaatctaccctttcataaattactgagaggtatattaaaattttctactacgattatagatttgatttatacctgtaattcttccaattttaccttataaattacacctagtatatcttttccattcctttgcttttaaactatgtcatcatacttttaggagtatctccacttgtaaaatacagttggttggattttttaaatttttgttctcctttagccagcaagtttaatctgagattacatattgggtttatggagatatttcagcttattttctaccatcttattttgtgttttctaatacctatgcatttttcttttcttttttcttcttccctgccttatactggagtgatcaatttctctttatttccacccctcatccccactgacttggagttatacgttattctatttcaattcttttggagagttattggtaaaaaaatttttaatggaaaactttaactcatcattgcattgtagatgaaaacagcctattgaaaaccataaagaattttttttttaagatatgggttctccctatgttgtctaggcttgaactcctggactcaaccaatcctcctgcctcagcctcccaaagtgctaggattacaggcatgagccaccacgcctaaccaagggaatttttaaaaaccagaaacctcatgaggatagggagaagaggtaaggagaaaacagaagcaaaattttaatggctggaaaatgggtgagcagtaattgaacagatcagaaactactaactctaggctagctgtaggaaaagctgaaaaccattgattaacacagaaacctcaaaaagttaaggaaccaacagcaagtcacggcaggaactgagggccaggcaggggaaggaataataggtagcacttgttaagagctttgtagaaaggaattcagttcttagatttccgcccctactgtctctggataactaatcctctgcctcaacgtttactttctgcaaaggggaaaacaaaatccctggactaggagatggcctgggtataagtaggaagaaaagagggtgtgaatgaacatgagcacgctgtgttaaatgtcgactcccaaaccccttcctccactgggttttggctcccaaatactagcagccagacctccgcccagttattcagatcaaaagacttcactagggtacctgaccgacccaggaggaaaggcatatagatgctaatattgggagtttaccaacaaacagcctgcctgctcagatccctctccagtgaaactgaaaggagacaagtttcacccacatgttgagtttttgatcagctttttagatccccacttcttaagaattactttatctgaggaaaaacgtcaaacaaaaccagaaaaattcagcttcaggaaaagactatacagagaaagaaaacatttttaaaacatcaacatggccagagaaataagactgagcaaccctgaagaaagagcagcatgctctcaaaggcagcattcagagaacttaacagctcttgcatagcttgacagcagaaacgggggaaaaaaatcaatagaagtgctagaagataaagtagaagaaatcttccagaaagtagaaaagaaagatgggaaacagtagagaaaatgaaaaaaattggaagactggttccagaggtccaatgtcccaacaacagttccaaacagagatgcagagtaggggagtcaaatagataaattaagaaaaagcccctgaactgaaagatgggagtttctagatggaaagggcccatcaagaccccagtaaaacagatgaaaacaaacctacatgaaggcccatggtagcaaaaccagaatgccaaagacaaagaaagggcttaaagtttccaaggaggaaaaaaaataggttatatagaaaacaatcaaaatggctttggttttgtcaacagtatactgtaaacaaagtcaagagagcaatggcttcgtaattctgggcttcataatttttcaaaaaaaaatttccaacctagacttatgttagccagaacaaaggcattttcagacatgcaacatctccaagtatttaccgccccacccccaacacactctccaggaaggtcctgaagaatatgtctcatcaaaaggagatactagtaaaacaaaaaggaatacgatctacactcgaacccaggagtgcaaggctgcagtgagccatgatcaccctactacactccaactagacaacagagtgtgaccttgtctcaaaaaaaaaaatacacacacacacacacacacacacacacacacacacacacacacacacacaaagaataggagatctaacaaagaagaaaaaatgaaggcaatccctaatatgctagtgagggggaaatctcagaatgactgcggcgtactaggtgtagaggcaaccagtgcaaatcggagcaagctaaaaaagacgaagccaaaacaacggcagccttctctccaaagtgaacactgtagaagtcaatggaagcataaccttcactgattagagccaaatgataaatggatgggggtgactgatggggccataaagaacagctttgtaccactctttaccaatatctcagcagatttctgattccaaagattacaacgcaaaagaaaaaaattttgcctaagtggaattcttatgttagtacatgtttatatatgtatggatttctttagaccagtgctatccaacagaaacaggatgcaaaccacatattgttaaattttctatcagccacattaaaaaagtaaaaattggtgtgctttagtcagttcaggacggtataacaaagtactacagactaggtggcttataaacaacagaaatttatttctcacagttccggaggctgcaagtccgagatcagggtaccagcatggttaggttccaagtaaggccctcttctgggttgcagactgccgcttttttcaggtatctacacatggaggacagaatgctaacaacggtctcttttataaaggcactaatcccattcatgagggctctaccctcctgacctcaatatctcccaaagatcccatttcctgatgccatcacagcgggaattacaagatgaaatcataatttaataattttattaatctaacccaatatatccaaaatactatttcaattcgcaatccgtattaaaaaccattgaaatatttaacattctgtttttgtactgttagaaaattggtgtgtattttatgcttgtggtccatctcaatttcaagagctcaatagccacatggtggctagtggctatcatactggacagagcaactctagaaggataaacgaaaagctagtaacagtggttacatttctggaaagcacaactgggcagcaggaggtaggagatgtaaaggaggcttacttttttcagtatttgctattttgttctccttgacttttataccatgtgcatgtgttattcgaaaaaatgaataaagtacattctctaaaataaattacaaatgtagatattctttgaactactcctagaaatctatcttacagacatacctgcaaaggagcaaaatgctatataaacgaagttatttgttgtagcattgtttttaataccacaagactggaaacattcaacagaggactgatgatatattcagacacccggccaggcacagtggcttacgcctgtaatcccaaaactttgaggggccgtggcaggcaaatcgcttgagcccaggagttcaagacaaatctaggcaacatggcgaaaccccacctctacaaaaaattttaaaaattagctggatatggtaggcatgcgcctgcagtcccaactactcaggtagctgaggtgggagattaacttgacccctggcagtcaaggttgcagtgagctgtgatcacaccactgcactccagcctgggtgacagagtgagacactgtctcaaaaaaaaatttacagacacccatacaaaagaatattatacaacccactactccaaaaaagaagaaaggcattcattacatactgacacaaaataagatgtactattaagtgacatatgtgaccacttgtactaaaaggtaatatacacacaaaattgttcatagatgcataaaatctctggaacaccacacaaaaacctagtaaagctacttgcctttgaaaaggcaactgtatggcaaagaacagaccagtaaagagactcttcactgggtatccctgaattttggattgcagtcatggattatgtatacaaaaattcactattccacatgcagctgtagatgttttcatgtaccctgccttgccttgctgtgatattaaagtccatctaaagcctactgtttttccagttcctccatagagaggtctgaggcttctttctccaagaagccccagatgtttcaatgataccagaacacttttcattttttaatttttttaagcacacagttcccacagttctgtctcctttcattgaatggcattataacctcagccccaactactgaatcttatctctagtaaatcccccaaggccacacttcccttaaagttgactgatttttctaagtttctagtacctgggcactttctctctcaagatcaactgtatacataagagaaaacttttatattttatccaacattttcatctgtttacagtaagaagaatgggcctaacttgtgtctgtgtcattttaagaaatttagataaagacagtataaacaataacagcaaacactgaagaaagtatgatcactgagaaaagactgctaaacttgacagttcatccggaaggccagtaggaagggaaatgtgaaaaagaatggttaaaaaatatgtttgcaaagttgaagtcaagaacagatagtgattaaatgtagaaagcaaaagtagattgcacttttaaaaggtatggagggaagagaaatttcaaatcttcaaactgcaggaaaatacaaaatattccccaaatacctatgtgaatttttatttagaaagaaaaccaaagttaattatttcaacaaaaatactttaaatatgatggtgctgcctcatctagaacatctaaggtcccactagaaataatataaaatcactgtgcagtcaatcctccttatctgtgggttccaaatacatggattaaaccaaccatggataaaaaatattcaggaaaaaactgtgactgtactgaacatgtacagacttttttctcatcatttctaaaacaatatagaataacaactatttacattgtattagatattaagtaatctagagaggatttaaagaataacaataaaatgtgcataaaacaaattctacaccattttatacaagggacttcagcgttctcatattctggtgcttgcaggagagtcccggaaccaatcctctgtggagaccgagatttttagcaatctatgttcaaacatactacaaggcagagaaaaaaacagcagcatcaatgacctggaattgtataactgttttagtcaaataaataattcattagtaaccaggataatagaaaacctcaaaaaaattaaaatacataaaacccaattttttaaaaacagatttttcaattctcactacaactatgttctctccaaagcgtaagctagtaaggaaagacactgccaactggaaacctaggtcggcccccatggagaatgatgggtcatgtcttttaaacaaaagcaaacagaaaacattcatgtgttcaactttatggactgtcaaacctaatgcaagcttgaatttaattcaagaaaattattattttagcaaaagtccacattaaatagggactgctgtgtaaagagactacttatttttttttttttaactaagagttatattcctatcacctataatgagttttgtggaatccacaactctataatcaacttgtaaacacgtaacttacatattggtttatcattcccagattattaaaaaaaaaaaaaaagcacctatgacaacactacacaggcccagactcaaatcagcacaaatataaagtacaagtactctaattgctcttcaaattcccaaagtctatcctgaccctcttctgaagcagcaactaataccacgtcaattcacgtgagtggggtcctcaggccataaaagctcaattaaagcaaagtctagagtagtgccacccaacacaactttatacaatgatgtaaatgtccttgggtatctgtgctgtctaatacagtagccatcagctgcatatggctatctaaatttagattaagtaaaatttaacattcagtttctcagtcacagcagccacatttcaagtgctaaatagccacatgtggctggcagctacctgttaagatagagcaggtctacagcaaaaatttctccaagacctactgttcttcagctgtgcttcaaaggcttcctggtggtgaggatgagaggaaaactgatcaggcaggacttcaacaactgcctattcttccttccacaaaacagctttactccttttatctgttttacatttcgaaattctgcatatttctctctaaaggctttctagttgctgctgtgtgtgcaggtgtgcacatgttttaagtctgactactactggtttcgagcagaaatggccaatgcacaacctcaggccaaagctggaccctcctgataactaaaacattttttaaaaaaaagtttaattgatcagctaacatgaactacaacctaactacctgtctattaagaattttaggccgggcgcagtggctcacgcatgtaatcccaacactttgggaggccaaggtgggcgaatcacctgaggtcaggagttcgagaccagcctgaccaacatggtgaaaccccgtttctattaaaaatacaaaattagccggacatggtggcgcatgcctgtaatcctagctactcaggaggctgaggcaggagaactgcttgaacctaggaggcggaggttgcagtgagccaagatcgcaccactgcactccagcctgggcaacaggagcaaaactccgtctcaaaaaaaaaaaaaaaaagaattttaaaagtggatctcaataaggaaaatttacatttactaccacagataaagtatctctagtcaacaaaagagtttcaatagttcactcaagtcaaggcagaaggctcacgggcccagcttccactgcatcatttatgaggattttatataggaggctctgcaaaaaagatttgccaccccacattttcttttttttcttttttttttttgagacggagtcttgctctgtctcccaggctggagagcagtcgcgggatctcggctaactgcaacctcggcctccccggttcaagcaagtctcctacctcagcctcttgagcagctgggactacaggtacccgccaccacacccagctaatttttgcatttttagtagagacaaggtttcaccatgttggccaggctggtctcaaactcctgacctcaaagtgatccgcccgcctcagcctcccaaagtgctgggattacaggcgtgagccactgcctccggcctcaccacctcacattctgaaatgaaagacgtgatgaggatggaacgtttccttgatatttacaagaccttaaccattatgtctctacagaatttctggaagtagctgaagcagcatatgaaaatgtagtttacttttaaacataggcaaactataagatcacagattcactatgctacttcctcagatcaagagtcttttttgacttaagagactcaaactaatgaacagatggaataccagtggttcacccaagattattcctactgaatacattaaatgtgaaactacatcccccttccccacaaaatgagggaaggtatgacactgtagattattcaaggaaatgcaaatttttacattaaggtagacacgtgtactaaacagaagcaactaaagtctatcctcgctttccactactctacagccttgaggccaatgtaaaaccagattttgaaaaatgacagggctacctaggataattagtgacaatttcacagtaaattcacaaactttgataagaattaatcacgtcagaatttctattttcttaagactacaaacctaaagatacatcaagcacctgtcctatcaatgtgcctcagttacaaataagaggaacccactgagccaaggagaaccactcacactgtacaatgtgaggcaagcacagaagacacagaattgccctaatatttctggctatctgaccaaactaaaggcagtgtctaaatccacctggcttggaaaaattatattctccctacatgaaattgctgaactgaagctgcgagctatctttgagatgtaaatctagaatcaacattgaattatgtcctaactgaatacatcacaattacaccaacctgaaaaaatgatcaaaattgatcaatgacaagcaataagcctctaactatgcatttttaaaccaaaaaggctagtacttttgtactactgctaaaaaaaaacctgattcttaaaaacagccaaggctacatattacaaggtcaccaataattatctgatggtgtagatggtttaagaagtaaccctgaggtaaggttacaagaaaggggatcaaaaaaattatcagtgctaatactgggcagaagtcacatgacaagagtcaagaaaccctcaacagagagactggccaactatccactcttgctttatcctagaaatctcgagcatactctatctcaaaacacagtgaaaagcatacactactgtcaaagcacaagtgaaaatttatatgatactcctgcagactgacaaaaaaattacttacaccaaagaaaggggtgacatagggtgctaccacactgaaacagcctttctttactgctggctaccctttcagcttggaatctgaatggctgtctgaatggcaaaacaaatgaaaaacatcttggtcataacagctactgtgatctttcatgaaataagccataagctatagcacaatcttcaacccctttaagaacatttcttaatcatcctgagtgacaatctaaagtatattacgtagattattgcactcttaaaaagattttcccaaacatgatttaggctaattgatgaacattcattactatgctttcaggtctggtcctgcactcaatggccccagacatgctagtcaggctttgactatttttgtgtcttgtagattatctctattatcctcaccgagctgttatctgttttttctgacaagagacactaggctaacatcctactccccagcccccaccacaccccctctaagcctcccacagtacccataatctacttgtttctaatctagtgcaggtttagaagccagataactttgcttgttagaaacactttaaataaatgccaacacattcttattaagggtctccaaggctctcctaagctttaagctatggactgggacaatttggctatcccaggcctttgttgttcattgtctgcttctcaaatacattttacaataggtccataataacagtgtaggcaaatcatttggattagaaagagcccaagtaacaaacccacaactacaagagaggaagaaatcatttgggaggacccttatatctcaggcaatgttctaggtacttgaattgtgatcactgaataagaggaaggggttagtacttccattttgtgtcagaaaaccaagggcctggggttggtagtaaattgcccagtattgtaactgagaaacaaaatattaggctagggctctctgattccaaaacccaaggcctttccactacatgagactgctgtccaatcctgggtctcggtttaactaactttttacactattcccgatcctttcactgagttattcaactctgctttctttccttaaccagcttctgtaattaaagggcaataagtgatcaaattaaggtcagatgaagcttagctctacaagtgtacatctgttcagcaataaacatgtttctgaaagactggccgtatcttcagtttgtatagactgtgcaaaactggtgccaaggtccccccaaaatacacagattgttcccagtgacactgagtaacacttcacatcttccctagtgctatctgctacatgttacaggaagcaaggcaagctcactttaggaatggctcagtaatgcatgtgcccttgatttgtacactaacaactgtcttactctaaacactggagaatagggcaagggacatgagtttccacttttctaactccattaaggaacaggggtgtacttgtttgctgttaagagactttattgcctagtccagagcctgacacacagaaaaagctgtttgttgaataaatgaataaatgtatttgttgaaaataaatgcatcggccaggcgcggtgactcacgcctgtaatcccagcactttgggaggccgaggtgggcggatcacctgaggtcgggagttcgagaccagcctgaccaacatggtgaaaccccgtctctactaaaaatacaaaatcagccaggcatggtggcgcatgcctgtaatcccagctactcaggaggctgaggcaggagaagcgcttgaacccaggaggcggaggttgcggtgagccgagatcgtgccattgcactccagcctgggcaacaagagtgaactccgtctcaaaataaaataaaataaaatatataaatgcataatctctcataacctctcttaactggttgtgaattccttacgtttcacattttctgacatacctttggaatacttaggggaaaacatcttacctctcacagaaactaagggcctaaaaatggctcttctacacccatcaaaagactaagaatctaaaagacatgcccccctctaccctctaaaaatgactctttgtcctaagaatatgaataaatctccatctgccagactgcactaaatacagcttttatatgcattacaaaaacacctgtataaaaaagctgctacaaaacgaggtttttggagccctaaagcacaaaaccaacagaatcaaaaccaaacaagaacaaggaaagacttttaaaactgacagtatttgcaaaatgtaaaaattcaataggtctttggccagcggtttacacagctaaaccgagtttttccattgacatatattcccccaaatgtgaagtaaagattatagcaacatgattctaatatttacaatgtgaaaatgaaaaggggacaacaacctctggccatcttgaagtagaatagaaacaacctttgttcctactaaagttctgttgaaataccaaaaccatccccaatattcctacacaagagttaaaacacataccaagcctgataagacacaaacaacaggaaattaccctgcacagtttcttaaaagactattatttcatgaaacttacagactgtgtagagacatgaccacttatgactaagtaaacgtaggttacaaccttgaaaacccaaacttttgttgaacacctacaatgcttgtggccgcactttagaaggtgtggctaagtataaaaaccaagctctaagagcaatttcttactaaaaccccaaaatgaacgtttccaatcacattacattaattaaacctggccagtgaacagccttgaactcaattaaatccagcagagtttaatatttatagtaaaagtgggcacactctttagaaatgccgaaagatgtgaactatttatatttactacgacagctaagtttacggcaacggctaaggaactttaaaaataaaagtattacttttgaatttaatataaacgtttgctaaatgaccttctggcagaggaaattctttaaatatcttgtatgggttttccgaaggcaaattttttaaataccctcaaactatggtacatttatgaagcccattttaaattacttctcccatctctgcttcatctgcttcactaattcatgtattaaaactgttgaaactccatttaactatttgactaacttctctgtaagatggaaactttttaaagggtgttaaagtagaatagcaaattttcagcataataagagcaaatttattactaggctcaaggaaaacatcctatcagcgattcattcatacgaaactatcaggttcaattcatatgaagtcagaagagagaaaaagaattttggaaattaaatcacatttcaaagaccatttctaaaaagatgtaattattccaagttatttatttattaacaattattttacacatgtcgttttaaaagtttcacaaacccaaatttaagatagtccaaattgcaacaaacaagacatgactttgatggaaaatgctgcttgcaaattcgttttacctggaaatttcttttttaaaggtatggttgacaacacactggtggtattttgcttttaaagggtcaagagaaaggaataacaaaaccaacccaggcattctttttctgtttaggatcaaaaggacattttaaggataagtaaaagacaaaagtacctgacccaaagacaatatccccctccaagagaacaaagtaagttgcaattttaaaaaccaagtttgaaatacgagaaatcacttcgagggctttccaaaggcgtgtgataaaaactaataggctccacccgcagaacaactttcacaagtgagtgaaggatgatcacagagttatcagctgtgtgcgtgtttgtgagtacacacaagccatggaaaacccgagactaccactgttaacaaaggttacgagaccaaaaaaaaaaagtggaggcaaagtattacgcgtccctaacaaggcttccccacaactcctgaaacaagagctctggcccttcggctttaaaaatcagaaccacaaactatggagtgtgagagcagcgaggggaagggacgcaggcagcccccgcccccgtcagcctgggcggcagcgcagtgcaaccgagccccgtcccttcccggctctccggccccgaacccgcacgcccgggccggcgcacccacagcccccgaactcaccacaccccagcccccacccgcagcggccatgtgacacggcccatcgccccggccgcggacgcacgcaaacacttccctagctggaggcccgcgggcgcccaggctttacctgcaaggtggcgccaggtcccgccccgtcagatccggggggtccgggaccttttgttccttcctcttccgatgggatggagggggctgggaggggaagaggggaatgggcgattggaggcggaactgaaaacactcccggccgccgtcttcccgccccgcccccaggcccgggcccggccggcggcccgggcgcgcgggagggtaggggaagagaggggaggggaggggaggagaggg

SEQ ID NO: 1989 - DNA, 129339 bp, Homo sapiens
gcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtgggggcccgcccgggggggacccggggtcacgccggcccagccccctggcactgcggggccgacccagtggggctggagatgggaagagggagagagagggagggagtgagactgtgtgggtgcgtgtgtgtgagagtgggagagcgcgggcaggaagggggtggggggaccccaaacaaaaccatctctgatttgcaaagatcagagcccgaggcttccacgcggcactctggcttccacacctcacattccctttccacctccgggaggggagagcgggttgctgcgggactcggccgcccccactccggggagctggggctggaagttgaggcccgctttgttcggctccgcgggccggagcccctcctccgccgccgcctcccgcccccgcggcccgcgctcgtggaggtggtggtgtctttgcgtttcttttcttcagtcgggtctccccactttcctctacaggaatgcggtccgtacagctggggctgtgggtgaggagcgggagcctagtgattgacagattccttcttcgttctttctttgccttcgggattagcatttttatcgagtatttttagactcggttgtgccagtctcccgccccctgagcatgcacgcactttggttgcagtgcaatgctctgacttccaaatgggagagacaagtggcggaaaatagggtcttctcccacctcccacccccccatcccgactcttttgcccttcttttggtccaagagattttgaaaccgtgcagaacgagggagaggggcaggctgcagccgggcagataacaaaacacaccccaaagtgggcctcgcatcggccctcgcattcctgtagagccttccttcccaaagcgcgctgccatctgtctggatctcctttatccttcccgttgcgcgctagctaggtcgggcgggagcccacagatggctgatagaaggggtcagtgacttcactcccccagggccttccttagcttagatgtgcctggctgggaactgggggtgcgggtaccttggcttcctgtctctacctctcagcctcctttgatgctgaaccaagggagagagcgtgtgtgttgggggctggctcttttgggggtcccaggctgccgaggaatgagtagaaagcaccagggactgtcagccgcaaagggattgtcatccctgctcctgggccagggtggactccatccttggccacctgcttggggcagttgtacaggggctgccaggcgagtcaggcaggcacaaagcaacatctgtccacgggaaccgagggcaggcctcccctggaaataaatgccacatatggtgggagtgcggacttaaattttttttaactgggtggatccagtcaataaagggggagggaaggcggtgtgctgtctggggaagtctctgggcgtgtgatcgggagccagaattgacttcagaggaggtggtgtgatgtgatggtcagagagacctgggatttggttccagctctggttgttaattcttctgtattccttccgtgggggtggctagggtagagtgggtgagtatgctacttctctttctggggaggggtctgccaaacctaccttctccttatctgcctgggtgcattgaagacaagtgctttatgtattgaaacagaagaaaaaaagtggtatcaattgtaaaacaggcagctgtgaaaagtgtttcacagtttacaaagcactttcacatggttttctgaggtcctcaaaaaaagacagaaagcaagcaagcaaccagccatggaaagtagataaggttgttaggcttaagattatcacatttttaaagcagaggaaaccttaaaagagagaggtgaaaaggcttgagtcatagacatggggttctgcctgaatgtgctctttctgctgccccatgctgctttatactttgaagatcctgaatacattctttgctgaatgctaaagctgtgttagcttggggagggccctgtggatctttgtatgtgcggttgcttctttaatctttgggctggtgatagcttggcagagaggccttgctttcccttgccttggtaggagtttgtcctctgtggggccatacctttggcctgccttttcctcttccaaagtcctgctgagactttggaagcctaagacgtgtgaacgctttggatgattctgagagttcaagccaacctgccctgtggccttctcgtgactttgttaggactgaggcatcttctgcctgcctggataggactgaatacaaaagtagattttttttttcatcttttttttcagttagggaaacccagttgcttgggtggatccagacaaaatggattttcatccttggattttgtgcccacgcctctgggtcaccttgtgtcccttggcaacagctgctgctgttttggtcgtgggcagaaaactaaaggccacgtcttggggaggtggctggtttggccctgtgctggtgatatcaatgtgtctgctaagccccatagattgcagtgttgcttgtcaaattgtctgctttcaccacaactgccttttagtttggaaagtagagaaaggaaaatgtttaacttagtcattccccctgtgtgtggggggttggtcactgggtgcttaaaaacactctgcaagatctggactccggggtttaaggagccctcagtctaaggagattaagccaagtgtgttttggctaatatataatcatgagcagcaacagcaacatttggcaattagagctgtatactagggacttccagaccacaggcttgcttctctgtgacaccagctctgacttgtttcaattatcaggggagctggcgtgatacacacttatcgacataaagaaggtgaaagagattggtgccaaggaagtggtaagagcttcatttagatacaccaacaaaggggctgtcaggatactctgaggtctggcaggattggcagaatttacacaagttttataacagcctctcatgcctcacctgcttgagtacctgagtaaagctgcaggtatcttccttgccagtttataagaatggaatcaaagcatttgccgctgaatgagagttggtgtgtgagcgttatatgaggaataaggagctcggcacacttaaaacttagttttctggtagacactggtagcttgtacttccaccagggaatccatgccttggcctcgttgttgggagctagaccaagcttaaagcattgcttgtttggaagggaatttgggctttcttgtgtcagagcacccagtccagtggaaaattggagaattgaagcaaacactaggtctgacacacagcatctactccctccctgtgaatctgatgttttttttttggagacagagtcttgccttgttgcccaggctggagcgcagtggcatgatcttagctcactgcaacctctgcctcccggttcaagcgattcttgtgcctcagcctcccgagtagctgggattacaggcgcccgccaccacgcccagctaatttttgtatttttagtagagacggggtttcaccatgttggtcaggctggtgttgaactcctgaccttgtgatctgcccgccttggcctgccaaagtgctgggattacaggcgtgagccaccgcgcctcaccgaatctgatcttttactgtagcctcctcttattatctccttgacttttgccagggtactctcactttgagaaaggaaaaagatcctagtctttaacatgccttttccagatttctggggatagacctattactaaggctgtagaggcctcccttttctcttggctgcacttcagagcaccatgcccgtgtggcccattggaagcaagcccccttccagctgctagggaggtggtccattatctctttgctcttgttaagtttgattaggggagttccacgtagggcctgagaagaggaggtgcctgcaggacaataggtagctgatgagggatctgactcagctgcagctgaacctaggcgccacttgacgttccctgggaacatttagaaccttggaacatgctgcttgcacctgggagtggaatgtttgcagacagcccctctgttgttacagggctggattttgttgatttattgatatttattggaccctcccatgtctgagtcaattttttaggtaccagaggaggatgcagagacacgtttgagaagctcccagcctgtgagaagcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaatatgttaccttgtaactggcactgaacagctagtgacttgggtgctatattttactccactgtaaagcattttctctttgaagtaaaaagtaagttagtactgcaaactgaaattcaggtttccttggtgggaacagggactttagatgtatcagctcagaatatgacagggagtgttaataaaaagtggacaacttggctgggcacggtggctcacacctgtaatcccaagcactttgggaggccgaggcaggcggatcacgaggtcaggagatcacaaccattctggctaacacggtgaaaccctgtctctactaaaaatacaaaaaaattagccgagcttggtggcaggcgcctgtagtcccagctactcgggaggctgaggcaagagaatggcgtgaacccaggaggcggagcttgcagtgagccgagatcgcgccactgcactccagcctgggcgacagagcgagactctgtctcaaaataaataaataaataaatgaaaagtggacaacttgcagatggttgttttgaaattcaaagcttcggtgtgacctagcttctcatttctctagttaacacttgctgagaataaatcctagacgcctgagtttctgaatgaacataggtgcttttagtggtatattttttaaaaagtctttgcaagggtgaagttttaaatgacaattttaataacagaaaaatatgaatacagtcgcatttaattctgatgagaaatgcaagaagttgatgaaattgaaagaatttgtttcaagcttatcacatcaggaatccaactaaatgagttaaaaaataaatattggtttaataatgtaaacatgtgattgctgtattattataatggaataaaattaacacgatttaatgaactgagcgaccattaatttttacttgttaatttattaggagattttaatgccatttgatgcacagtacagccattattctgcgtgagctccttaatgaaataaataagaccaagcagggcttgcttcaaattggaatcagctttcattcctgttaaccttattctcccacctttattcacctctccttcagcttcctgtaattgcaattaagttctctaagattggaatgcagttttcttaatcagcaagtctcatcaatagtcctaattgacttttgcccttttctcctttgccatattgactgattaaaacaaaagcaaaacttaaagactccattccctcccccaaatccccatctcatagtgttggttggctggcaagagaactgcccaagaaggctgctcatgatggcagcctgctgaatgtgcagggggtggaagttcaccagccatgtgcagacgtgaatggctggtgcagtgttggatgggactaactcctccctaaggaggggtatgaccttctgttggcctctgacaagtccctgagccatggagccttcagtcttcccatcttcaagcacaatggttcctggaaacagtgggaagttgccatcctaagcccaccctacagaagtttggtttctaattttactgtgttctaagctttagaaccgagacaattccaagagaacttgtccagttcatttttatgccttcctttaatgccgtaccaggtgctaatttctgtgccagataatgcggacaaaatagtgaataaggcagatactgtccctggtgccttctgtagcttctagtccactggctgtgaaacacaggttctttggagttgtaagaatgctgtatgtgttcactctttagctaatttgtaaatactgtttttttggtgccaaaccacatcccccaagctctgcagtttattgacttgacaaggatctctctctctctttctctttctctctgtataacataatcctttgtttcgacttaacagtttgagaaataaacaaatctatagcatactatccactgttggttatctaagacccttcctataaacagcagcctgccacagtggcaactgctgtagaatgttttggcagagactcagtttaaaatgaaaacacagtagaagcctattaattaagaagtttggctaattctggactaggcaaaagtttgtttagcaggcctttttgccccataaatgctgtcaaagaaaaattaataaacaagagtttggggattattttggaggtaggagtcagcagaccttggtaggttctagacgtggctctgtttctgattagctgtgtgacctgggacaagtcaccttctttgggcctcgaatgttctcaactggaaaataggctagataaactctattggagggcctttctaacttggaattggtattcatacaagcattttattttattttattttattttttgagatggagtttcgctcttgttgcccaggctaaagtgcaatggcgcggtcttgcctcactgcaacctccgcttcccaggttcaagtgattgtcctgcctcagccttctgagtagctgggattacaggcatgtgccaccacacccggctaattttgtatttttatcagagaccagtttcgccatgttggccaggctggtctccaactcctggcctcaagtgatctgcccgcctcggcctcccaaagtgctgggattccaggcctgagccaccgcgcccggccacatacaaacattttaaaagctcccagttgcacgcatctagttgatcagtgaatgacagatctttcttaattattgatgttccaagactctatcagcctggtgtcaattaatttacataagtaaaaataataaaattgtaattcagcctttaattttggtgatttccctccctcttccttgcctcttccttactctgtgagtctaaatcagtgaaatttaactacaaaggaatatgaaaataatgctaggatgaagatgtggaggctgtgcctcttgagatgcagtgaacagtttttcttcttttgttgctatttttgactattctaagaacaggaagtttacttaaactaatgaccacagatgcctaaaaatggttaaatgtaagaggtaggcattatagaggatacctgtggaaaatgtttgctcatatgtcaaagtttacccaggaagcttcctttatttatttccaagcatctatataaagaaaggctgcacttgattgcgtaagcatgagccttttgttaggcagcgtggatgttgcaagtttaaaccccaactaggaaatgaaaagtgagtttcctcctaaatagttctttttcagtatcacatggctctcccagcttacatctggcaagtttttctcttgagtgctttgccggtagtttaggactccagtattgtattgtattgtttgtttgtttctttatctctgtctctctctttttttgttttttgagacggagtcttgctgtgtcgcccaggctggagtgcagtggcgtgatctcagctcactgcaacctccgcctcccaggttcaagcagttctcctgcctcagcctcccatgtagctgggactacaggcgcccgccaccatgcccagctaatttttgtatttttagtagagatggggtaggactccagtattaagaaacactgtgtatggctttgcctttgaaacctacagagttatgaatctggtcccttttgctgctaagtgttgcatcacaaactgccaagccaagttgtaactctgaggtgtcaccattttttttttcttttcaactggacatttgaaaatagtaatgctttttgggtgtgtgttttttaaaggtctgtttttacgctgtcactgctcaaaaatgccaaaaggcattttttccttaaaaaatcacctctgggctaagcccaaatgtggagtaatgaatccagaaaggactttttgagtagttacaagtggctgaaagcaggcactggtgatggaaattgggtttttccttttgcttcaaatcttcctggttgtaaactttttcttacccttattgaagtcagactcaaggtgggtctaatttctcccagcccatgggaaggcagagtgaattactgcttgttgtgccaaccctttacattttgtgtgtggctgtttgtctctacccagacaggttcttcacatattacctggggagcaggagagggggaggacaggaagagcacagttgggcagaaagagcaaagcctctcaagtctgatgggtttgggtttgagtctgacagttattagctatgtggtgaccttgggtactttgcttcaacttattgagccccagtttctgcatctgtaaaatgaggatgaaactacctacttcatagaaatcaacccaagtggccgggcacggtggctcatgcctataatcccagcactttgggaggccaaggtggatggatcacctgaggtcaagagtttgagaccagcctgaccaatatggtgaaacctcggctctactaaaaatataaaaattagccgggcatggtagcgggcgcctgtaatttcagctactcaggaggctgagacaggagaattgcttgaacctgggagccagagcttgccgtgagccaagatcgcaccattgtactccagcctgggcaacagagtgagactctgtctcaaaaaaaaaaaaaatcaacgcaagtgagataagatgtatcaagtactttgccagtatcgatcataatacatagtagatgcttagtaaacgctcatttttcctttccaaggggaaatttggcagatgatgtccgtcgactccaataggtgatccccttcccatcccgacacacttgctcacagagcattctcctttggagagtctcagttgatataggaaaaggatctacttcaacacacacagagaacatacagacatgccacttgttgatgtaaggcttggcaggctattgaaagagaaacaattcatattcttaggcggttctgccctcccccatcaccttctctatcattattcttaaaaatttgtttggtcgactaaaaataatagtactaaaaacaaacttcgatgaatcaggtctcctggggcgggggatgggtaagatcctgaagcagaaacgcagtgactcacgcgcctgtcactgatagctgcccgtaagtgcatggaagtgcatgatgtttattgttgctggtgtttttttgaggcccaagttggaatgcacttccggctccccctcaagtactagcttactggttaggtgggctgttgagtgagaatggtcaggtccagaaactcatggctctgaaatgacccagacgtggtggctatacccttgactgccctcagatacgtgcaagagggagctcacgcttcaagagtcatgctttggccctccacctggctgtgctcctcttactggggcaaggagactgtagggccaagggacaggcccatctagagcaagcacttcctttttccagatcatgctcagaggcctgacccttccagttccctgcatcagtgtcttgagcctgtttccaagtcctgcgtgggcctcttccccaggtctgttttacttgagggcagactgtgttggccatggacagcatgtgtacctgtgggaccaatggctgggcaaggggtgcaggggcatgaaggaattggctagagcttggacttgtggcctggggactctacttgggtgtgcacaaggcctctgaaagttatgggtggtgctaggggtgggctgagatcttgggctgggtctctctgagcttccacattccattgtgaaaccaagaggtcagggaatcctaaactcaaacctggacttattaaagtattggtcaaggcaggatgatagaacgcattctgtgtaaccgtttgttaccttgatttgtctttaaatactacatatggtgtgtaggccttcctctgtatttttgctcttagggcaggcatttctgtatgtatgtatgtatgtacgtatgtatgtatgtatgtatttatttttgtagcatccgctcagttgcgtggccacaactgaatcccagtccaggtggcaccattatatgggtagcattttggagatgttcacaggaattgatttccctcaccctcaacccaggccagagtgaatttaatgcagatgagggagaaggtgctacatattatagctgctcattcaaaaagtggagcagagagctggaccactgaatgtgcctttgtttgctggaaatctttattaagtaccagagatatagagatgaagttgtgtctctgaactgctcagaggcaaaaaagggacaccagtaaccacagttatggtgggcctgtggaagagacactatagtgaaggtcaaacaaaatatttgggagcctagaggaagaacaggtctatttctggaggtatcagaaggcttcacagaggaggcaatactcaattggggccttgaaggatggataggagtgtaggagtggagtgggaggcagcacagagcacagaccagactgcggaagggcctgacatctagggaaggcaagacagtttagggtggccagagtgtggatgagggagtggccagagaggagttggagaaggatgttgtcaagggctttggcttgccaaacttcgtactttgtgtttggaccttgctctgtaagtgtccaggagattttaaagcaggggagtggcacggtgaaagccaccactctatcgtttcttgtttcatttcctcctcttacccagtggctgttaacagcaggttttctgcccgagttatccaggtcagagtcataatcccttacagtaccatgtggacagctttaggctatgtctggagcaggttgaagatagtgttttgttcactgtcaggagagaagacatgttgttcagccaggagggctcagggaccccaggcgttcaggtaattagccagtgagtcatgtcaggcttttgatatggataccttgggaaactaagtggggtgttgctggcctccatgcagatgcctggtctacccaagcacaggcccccaaattagatctcggcctctgctgggtcttccctgtgcctgacacagtgccttcatatggaccgtctctggtcagtgttttcaatttctttgttgatgatcatcaatcaaggccaggctttccaattccagaccacactgcaatcagtggaaactacctaaattcagtactgcagacccatagcaggatgtatgtttattgaaaacagattatattccttaatgagagactaaaacagcatgtttaaatcagtattcttcattccttttatcattgagagattggttattatttacctcgcctttagagggtcagcttggtggtggtggtggtggtttaagttgctgggtttttaaaagattgagtttcatgtccaaggactgattctacttcatgggctgtttttgaaaacattgctagaaacctcttaactgaaggcaagaccaggggcagcctattgctgcggagtgccctgggttcaaatccctgctccccaacttactgcggtggtgactgtggacatgttgtttaacttatttgagcttccttttcctcatcagtaaaatgggaaaaacaatgacctccctcaaggagggatgttattgaagttatttacttaaatcagattagatttattttagattaaaagcttcttgcaagctgtgaaatgttttgcaatgtcacatattattattttttttttttgagacggagtttcgctcttgttgcccaggctggagtgcaaaggcgtgatcttggctcacggcaacctctgcttcccggattcaggctattctcctgcctcagcctcccgagtagctgggattacaggcatgcaccaccatgcctggctaattttgtatttttagtaaagacggggtttttctatgttggtcaggctggtctcgaactcccgacctcaggtgatctgcccgcgtcagcctcccaaattgctgggattgcaggtgtaagccaccgcacctcgccccccgcatattatttctttatggtgtagaactcactaatactgctaaaaaccctttctgacagagatgggagttaaggcttctaagttcacacccagatttccacagagaccttagagacaatcataaatattgcacaaaattatattggaatatgagctcggggcacataggctctggtgccttgtactagaagcttaggtgagctgttactcttggccatgtccaagcatttgactcagaagatggtcgagtcagcagtgttgactgttagcaaatcacctaagcccactcacatggggtgatcctggtacgtgttgcatggactgagtgtcaactgcatgctgagtgtatgccagagggggtgatctccttgatcttatttacttacctacagtactctgggtacttatgtatttatgtttacagaggaggaggctgaagcattgaggggtcagtggcagaacaggaatcttaactctggtctctggttcctagttctctgagctctaccccatagcccctcaagaaaggatggccattgttgtcctcatacaaaaagctatgacactgctatcattattctcatttggtaaatgacagaaacaaggttcagattacttaggtaagttgctttaagtctcaggctaagggctggagctggatttgccactgaagctctacaccttctagaatctagggtgactacataatttatcaaacaaaccaggatgtttccaagagtgaaaaggggcagcattattaattatggccactattaattacggtccttggccataaatcaggaccgtccaggcaaacctgggtaatagtcaccctgcctctggtcttgatacctgaccaaggtaatggagaattggatccgccagctcatgtgctgttgcttaagtggaagggaatgtgcaaattatgtcctgctattctaagtgaaaggacttgcccaaggtcatgcaacaagttggcaatgtaatattttaaaactggacgagatgttgaaaacatggtaaagttagcactagagcttaattaactggagtatgagttagggaacatttggctatgctgatgtctactactgaagggaaaggaggtggaggtcaaggtcaggtgtgtatggagcaggtgggggtggcagtggcagggcattcacgtggctctactatgtcggcaccatcatcaggccctgtccctttgaagtccgggagatgccactaggcccagtgcaacttggatgatatttaatggccaagagcagagacttctgggacctgacttttcctgctctccactttactttagctctgggcttcaaagggactattggctgggagtggtgaaagtttagtggataatcctgctgaagaattttggaaggccttgaggaaggaattaaaaataacagtaagcatgccttttctttctctttgattgtggtcagtgcatggaatgtgccagggccgctgcggagcaagcacgtggccccgaataacccctccctgccaacggaattctgcagagaacatgtaagggctgtgctgtttcactcctgctttgggctctcagggtttgtttccgcgatcatccaaacctcatcctccttctcttgccccagataatttattggaagtctggagagggacttgagttctctcaactctccaaccagactgttgctgtgggcgaggccatgtcgggtgagctccaaggagagcagttggaatgacagagaggaacggtttcagcctgagaaatgtgaaatataaattcaaaccaaacttggcacctgtttggagagcttcagctgatactacagtgcccctgtcgttagcctttgtggctcagctgggtcttataaatagaacacgatgcatttccccttttgctaccccacagacacgcggaggcatgtgtgggggtggcatggacagagagtattcattacttatgctccagtgcatcagatagtcatcgtgggaactgagccctggtgtcatggggatgactaggccatcttgtgggtaaggctggaagcggcttttgagtctcctgagttacagctcttcttacccttgccagcctcccttccccagctgaggccctcagtccttcatgcctgtgtgccgcagtaagccagttggccccttccgtcgtgagtccatcccacattctgtatcggagcccagcattgctgtatcaggatgcttttggccaaaagtgacttgaaacccaacaaatagcttcaatcataagagggcttattacttccactaagaaggctagaagcaggaaagtcaggcatcagaaggtctcaggagccttacatctttcctcctggccatattctcttcaagcttgtctcctgttggtccaagggtggccacaactgttgcagatattaccgtctataaacgttgcatccaagggcagaaaagggctcctattccttgggggtctctttaggaagaaaaccttccccgggagcctcctggtatcttgttggtcagtattgtatcacatgcagtcaatgacagaaataatggaccctcagaagcctctcgaggtcaagggcccaggctattcctttgactcatcagggtgattagtatggaggtaggtgcttagtaaattttatttgggttagtgcaaaagtaatggcagtttttgccattgaaaataatggcaaaaactgccattacttaggcaccaacttactgattaatgtttgttggttgctggtttccttcgctaagtgagactcctgaacacttactgatgatgtcttgctgacttctgaggacatgatggtaagtctgccctcatggagcttgcagtcaggtggagagatagtgctataattgtgtttggagtatctcctgagtagattgtggcagtctggtagctttggaagaggtgttaaattgaggcccaaggagacaaaaggacctgagaaacagagcagggggactgtctgggcctctgaatgccatgcccagggccacacattttgtgatgcaagccaggttgtttcaggtttcaagcagttgcgatttctgtctccacccctccaccagtcttattttcctgttgacaaaatgataacaacttgccctagggtttgaagtgggggcagggcacagcgctgagagcctcctccctcaggggaaattttctaaagtttctcactgtgttctagcttcaaaaccatatgcagtttaattgcatgtttagtatctttgtgcatctctcttgttttgaatctgctggaaactttctctgaaagcatatatataggaagacataaaaattctataaatgtttagtggttaaaaacaaagtcctgtccaaattatataaagttttgccgtcgtcggacggaactttctgcagatagggaatacccttgagtcttcagtcgcaaagagctaatcactaacttcaagtgtgcaagtgccctttcattccaattcagagaaaacagagcctgtcccaaggcctcgtgttttgttttcctattgatctaggagctgggataacttggaaccccagggaacatctcagagttaattagttttttgaggtcttcttgtttttcttgcttgattaaaagagttacagtttttgctctgattgtttaaaaaaagaatctatcactgctactgatccaagaggtgagggttggcatggggtgggcactccagtaaatacgtaagttgtcttcctgccgtcttgtcctggtggagcagagagaggtgcctttgagcatgggcctggaaccaacagctactttcctggaaaattcttcagtttccagaagcagtggccaggtgagccggggcatgaaaccagacgaagttgccgcagtgcgaggctggttctgtttgcctcagttctgaagttaatggtccaagttcaccactcatagagcgtcagcctgttggggagacggaggccctgacggccatgccagggtgcccccaaccctttgtttaaccacggctgtggaccagtggtctcagatgtttaccatcgcctgtttataagagggaagtgtggtcatatttctatctctcttgtgggctgcacggttgccttactggggttcatgtgggaagtggttaccgttaggaggaggatgaaataacagtactcacaaaaaggctttgatccagggatctttttaaatgtcatcttttggccactgtgtttttttatttttattttttgctatctgctttaacttcaacgatgagaaaatcaaaccatatgctggacatcattctgcccagctgggctgagtcagaattgcagttcaaactacttctgctctccctgggtttcgtgtgctttcaatgtggggatatcttccagatctgcagttctccagagctagggacccctcagctccagctgctctctggacaatacctgaacatccctacaatatctgaaattgaatgtttgccatttcttcttctttctcctcacacaacctactctgatgttcatgattactggagcccccaggttctaaaaagtgttgaattagcaagtgaacaaataaaatgagacccaaagaaactgtgatcttagcatcctgttttctgggtgaggttgagggtccttggcctctcttgctggtggagatgggctttatgactttggggaagtcaacttgacttcctgggtgttggtcttctcttctacaaaatgacaagcttgaagggagaatctgaaagaatctgtgtatccgttctcagattttctttttttttctttttttttttttttttttttttgagatggagtctcgctctgtcgcccaggctggagtgcagtgatgcgatctcggctcactgcaagctctgcctccggggttcatgctattctcctgcctcagcctcccgagtagctggcactacaggcgtctgccaccacacctggctaattttttttttttgtatttttagtagagacggggtttctttgtgttagccaggatggtctccatctcctgacctcgtgatctgcctgcctcggcctcccaaagtgctgggattacaggcatgagccaccgtgcctggccagtctcagattttcatgatagccctctgaactctccttggcttcttgcctttggctgttttctcaatgcatatattttcctgggggacaaatctaagttttcatctgatgctctgccttcagaggggaaccattccttaatgacctatttaattgtattatcattgttgtttaattcatcacatatttactgagcttcttttgttggtggtggtgccatcagacacagtggtccaggagctgcaatgcgttgctgatgaggatggtcacacatagctctgccctcatggagcgtcccagggtgaaatgagacctcccctgagaaccgactcccagggtaggggaaatcagtctgcaggcaaagaggaattcaaatttagcctgaagcacaggttttctgtgcttctaggcaccggctgcattccaaccgtagtgccataaaaatacaggaaggaagggaaacgtgttcacaggttggttagagatgtggaaaccaacaatcagctctctcttatccgtaagaaactagaatctactgctggcttcagtccctcagacctgctgctcaacagagtgccctttcaaacctgggttagactctgtgctaatggcttttttcatgaacctcagacagccggaaagtatattctttgaggattatgatcgactaggatgctcgggaatctttaaagagaagcactatcttggctatatttgccctcagttgttttaaggccagtgaggagactgagcatttcagaggtgaagcatttagaggatggcctctgaaagcatacggctcagtaaacaactgacccatcctttgtcaccgtttttgtccagcggctgtcaccataggggctcctctggtgtggaggagagagaattagaggcagcaggcctgggttctaggtctgcctcattgtgaaccagcttcaggaccttgggtgagtcacttttctgccctggcccctggcttcctcttctataaactgaaggtgttggcttagcaggattttaaagtttcttccaccttaaaaactctgattcctgcacttgcattcaaagaaatgactctattactcatttgaatagtttcagaatcactgtatagtcaactctggactagaaatgggggcctgcagttgaggacaggatggaaagaggtttggggttcagggtgggctgtgagggctaggattcttgattcctcatgatttgcaattggttgttggtgttaccatggaaggttctcaaccatggctgcttttaaaaattttgatgctcagaccacccctggagaccagtgaatttcaaatttctacaggccggcctggggaaatccatgttttttaactttcctaggtgattccggtatgtggccgggattgagaatcacagccatagatgcttatgtaaagctgtgttcagtgttacaggcatctgttctgggtggaaagtgatagtggttggtcaaaaaaaaagcgtgcacacacacacacacacacacacacacacacatacacagagaacagctctaggttctggaagtgtgttgatttggtcaccacaagtgctggtggtgagtagttgccctgaggtttggagttccagttccctcctatctctgggtcagtggtttctcaacatctttgaagtagtgaaaccatctgtagttggttatttctgctcagaaactcacagtacaaagtggggggtggtgcaggggggtggagctggaatggattaaacaggcccttacaaatgcccacacttttttcatgaaactaagttagaggccttagccaactccagcataccttagtgtcagttctttggcattgccccggtggattctaggggctgtgaaggctgtaggggtgtgtgttactccctgctgctttggtgagagagtgtccctgtctttggctgagagcatcctgtcctgccacttcatcagcagtagcatctaaacagcccttgaagggaatcagtatctacagcctaagaaatctgatgggacacatctctctgcattaaaatattaacagaaaaggtcaaactgggaaggggcagctaagttggaatatctcattcaggtaaagggatgggcttgtggatccttaattggtgtgaaatgcgccctaggaggggagactatatcagtgctgaaagcccttgagggctttcacagatgaagggggatggtatgagaagctttacaaataacaaggtttgagatgcagttgtagacacatgccagatgtaggttgctattttctcagctcaatgaggaatctgtcaaggcactcttagaaatggaaaatatagttcctgccctcaggaactatagtgtcacgtgatagcagtgaagaccttctatgtcctggccacacagtgaggatcagaagacagagcatggagagtggaatgggacacatggatcaaggaacgtggacctgagcaagcaaaagcaagtcactcgggtcccactatcacattgcatatcttctccttttttttttttttttctgagacggagtttcgctcttgttgcccaggctggagtgcagtggtgcgatctcagctcactacaacctccacctcccaggttcaagcgattctcgtgcctcagactcccaagtagctggtattacaggcgcctgccaccacacctggctaatttttagtagagatggggtttcactatgttggccagattggtcttgaactcctgacttcaggtgatctgcccacctcagcctcccagagtgctggggttacaggcatgagccacagcaccagcctcttctcctttctaacgtgatgtcagtgtctctgggaagcagccttagttggcacctcactggcagcaagaatgacttcatgttcttgctcccatgaaaattctctgctttcaggaatacactttcctctaggttttttctttgtctgcaagtgggggggtgttctttgccagatccctgctttgatgattaccatctgcccacctgagtttcctgcatagtttcagttggaaactcttttctctttggaccctaagataccgtgtaataggattgttcttggtttcagtaggcacctggcaccctctcagctgtggctgcatttcaggtatggatgggagtgattatctgtgcatcagaaaactcaagattgtcatgtgagcaagttgtgtgatcatcagtaaatgcagagctggctttgttaggccctggttgtggccaaggctttcctttcccggcgggtgattattccagatttcatggtcactagctgagtgtaatcaggagcagataagaaagccctgtatagagcaaagtatgcatttcttaaggtggtgggggaggtggcagaggcattatatagacgtgtgtgtttgtgcatgtgtttaaaaaaagacttatattttctgggcagcagaacttaagtttccagtaaacatctcctccctttttactttaccttttaattttgtgtttatggtctctgtgctttgaaattgtttttgctgtgatgccagccctgcctgaaatgggtggagcaagccaagccctttggaagccatggtttagatcagagttcttgtactgacatggcccagctgattgacagctcagatgtgatcactccgtctcaactagaagaataaaaataaaaaccttgagctggagcggagaggggtcacacatttgttagtttatcccctactctcacctttatcgcaggaggagtgataaagtgctgctgtgtgtaattctggtctggggttggttttctgtagtcccaaacctgggactaattctccctggagcccgtggcccagaagatgggtgcacagtagggttacttgatgctaaacggctttcccgatagacttgggatctcactgttcttgtcttagctttacttgttgggttggaggaggtgaggtgggtgggcaggggcctagggaagcccactatagaaacactgggacagagaatccagcccaggctaggtgagagcatctgccagtgtgaaaacacgtggaagcgggggaggcaggcgagaaaagctgtgggagaaaacctcacaaatgcagcaaagctgcccagggcccaagcggtggggcggtagcgagggaaacacagtggtgtttggctgctgcttcacaccacttttaattcagcgctgctaggaaggctatttcagaatgctcccgagtgggagggggcagctgctctagggtgggaaggggatgctaaggccgggtgcggtggctcacgcctgtaatcccagcactttgggagccgaggtgggcgaatcacgaggtcaggagttcgagaccagcccgaccaatatggtgaaaccctgcctctactaaaaatacaaaaatgagccaggtgtggtggcgggtgcctgtagtcccagctactcaggaggctgaggcaggagaatcacttgaacccaggaggcagaggttgcagtgagctgagatcacgccactgcacttgagcctgggcaacagagccagactctgtcttaaaaaaaagggggtgctggagagcatgtggggtggatagggctgactagagacctttgtcagggtgacctttctccagagagcccagtaggctcagaaggaaggtccctcagcaccctggcccacacagttccagggagaccccaaataaagcatttgcacaaacagtcctgagtggagcacacctagccgccttctcttgcaaagtgggcctttaaaaaaggggtgtatggctgcttagttctgaagaggccaggctaggagaccccagagggacacccagaaatcccagatatacctcctccatctgctctgcctgccagatgacccttgctactttactgttttttctttgagcctcttggtgatcttgaatagcagaaaaatgagccaaatttccttcaatctatgccagtcttcgtcctcagcctcccggtggggtgatgagtcacaccagtgggaaagtgcactgtatacttggtcatgtgcagagcaccttcccattggtttatctttacaactgccctgggtggagacatggcaaggtggtcctatccctattttgcaggtgatcaggcacaacttacagttagcgcaggaacagggactgaggccagccctcagttctttgacagagttctttgtctacactgtgttgcctcagaaaaaaatgcccatggggagtgtgtgtgcgtgggcatgtgtgctctcctcgtgtccctcagaaaagaatgaattcttttccaactgatgtcactgggaaagggggacaccactactttcctgcgtactgcactttacagtttacaaagcactttcccacacgtcatttcgtttcatctccctgacagtccctggaagtgggtgctagtctggatgagcaggcgcagacttggagaggctgagggacttggcccagggcatatagctaggaagcggccaggcagtaagtgggtagcaccactgcatgttgggggtggggaagcatgagctggatggagcattcggtggtctaaccagtggccagcagtagtgttggggtttgctgccctcacctctgaagccacacaggctcctgcttcctgaggtcaccctctcctggagggctgcccccgcatgggagtgtggacaagtgtgcacgagggggaggcacacccaggccgagtggaacaccaccctaagggggtggtgacaggtggcactgggagtggctggagtcggggttcaccttactcagggtcagggcttcccattttgcaggactgagaggtggactctgaaggaatgcagtgcttagaatcttggtgcctctcctggggtggtgggaagagcagggagtctcgagtccgattttgccaaaaatcccaactttcctgctgagtagctcatgagacaggcatttcacctctctgaacttcaacttgggggtactcagatttccttcagaggctgtgaaagagtcccctgccacaagttactcctctgttcagaagtgacttgactgatcatctagcccaaccccatcattgacagctgggggaaactgagctcctgagcggggcagtgacttgcgcaagtcatttgttgggaagaatggggcaggatgatgatgatgtccacttcttggggacgatggggcagggtggtaaacacttctcaatgcttgcttatgggctctgatgtgaaccactcactataggctgaatcctggttttccaagtgtttagaggctgagctgttgtcccctgggattttggaaggtagactcacatttcactgaaagccctagatgcttctccttactgcagttcccctccccagcactcccatctccctgttttctggggatttaaatcagctttgacttgggtctgaaagtaacccgtgacagcagtaagcctctcgatctgttgtttgcagtgtttcagctaaaatattataaacagaccaccaaactgtgtttggtccaaggccaagcccctccctccctacttgaacacttgattacctgctgcagggttgcgtcttgagctccgaggaggaaactgtttatttcagggctgttagagtgcagtgcaggaatccaggagaatttattgtattgttaccatctggtttcatggagtctgtttcttttgattttaattgtgccctctggagagaaagatcctcgaaatggtggaaaaagaagataccaccttcctccctgccctgcccatgccctggcacacacattgctatggtgcatggtgggcatggctgaaccaagtccccttattctttgaacatctttgcgtattattcctgctcccccagccgtctccaggccccagtctcctctggagggatttcccagatggcttccaggccagagcctgacaggagagataggacctgcctccacggtaacaaatggctgaaggcggtttggggtgttgccagtagcctgcccttccgcagtggctaaggatccggtgttgcggtgatacatgatgtgacctcttcaaccagtgagtcactcacccccagataaccacccggtactttcaggggaaaccgttgtatcattgtggctgtggccatggtttctccaaaataaggtgtttttagaaatgaaagtacagggattggtttccttagattcattgtcatggattcatagttccccaacctttttcacgtaaagactcacctctgtttcctcttaaattgtacatttggtgtctgttttatatattaataataactgacactcttctaaagttttttggggaaagaaaacataagtttaccaagctctcaattctagaaggtaatagccttctagaattgtccatttgcataagcatttttatgcttattgctgtaatcagtgtgtcagtcaaacgggaaggaggaactacatcaggtatttagcacaaagggaatttaatacgggaccttggttacacaggtgataaagcagctgagaagccacaatgggaaggtgaggtgacccagaacttggaggaagccgctgcctttaggctggagggacaaagggaacaggtggtgttcccagagcccagggttggggtcaccagtgggcctgtctagagcagttgcagctgcttctaaaattgccgacccaaggtagaaaaggagagaggggagaaacactgtggcctctccctccctcctacccactacttgctgtgagagcctcctattatttaaaccctgctggaggcctcctgatctggagcctggaaagtcagggctcagccccagggaggacacagcagagcacaggaagatgagggatggatcagagggcaaactggacttggaccagcacagggtgcaagcctgatgctctaattttatattttatcagcattttcttatatgtggctttcataattacacatattttatcaagtagatgaaccgcatttaaccattccccagctgttaggtgaacactttaaattactataaatcagcagttctcaaagtgtggccctgggccagcagcgtcagcatcaccagggaacttactaggaatgcagagtctcaggccccgcccccaggcctcttggatcagaaaccctgagggcggtcccagcagtctgaattttgtacactctccgagggctgctgatgtgcatttgagcttgacaatcatgattataggcaatgatgcaccgtgtggaagctgggggcaggatactgaggagggtgctgggggtaggagtggtggagggagtttgtccaggggaatgtggtgtagcggaaaaggcacaggactggtagggctgtgcccctttaggcccaagcctgcccttgctcttaacctcttaatgggtttcttctttcttctgttaaacagctaaaaatatcaaatcatggggttgctgtgacggttaaatgtaataacaggcacgatgttccatatatgttgggtcttctggagctttggggaaggaggtgtggcaataacagccagcttctgcatcatggaaaatggcccccatgcccatccctgagttgtgtggtctgaaaatcaatgatgaacacttaggaggcttgtagcctgctttgagtcaacaggaagactggacttgagagtttggaatctatagtctaacttcccttcctcaccctgtctttgtaaatggtgctcatctaaccctacagttactatcttttcactcatgtctagccacttgttagaggggaaggaaccctggtgtcaggacaggactcctggctccctgagcttgctgtgtattccggggcatatccttaacctctctgagatgtacttttcttatctgtaaaacctctatgttgatgcaaatcaggtgcgatgatggacgcaaaaactgccttgaacaccttagcgggcctgtgaatataaagccttcaggatccacacctctgccagggcccacaccagcctcgccacctcggtgagcctctcattccactgccagtgcaggggtgcataatcaggatttgccagtggaggtaggaagggtggctggattgtgactgtcacgctcctggcatcagatgatactggtagcaagctagggtcgtctgtgcactttgctctctctcagtcttcccagcagccctgtcaagcggggagtctagcaagaagtggccaaggcgcagatcatttaagaggaaggatgtgagcaaactggatcccaaggggacagacagaggcccactttgcctcagagtccagagagctgctgctgctaagaagggaaagaggaactgggtcggggtgcctgctgacttgcagcgctgtgttggcatgcgaggtagcactggttgggaggcggttacctgaaggaagcaaaggcagctggtggttcctatcttcttgcctctggcagcacctaaaagaagcctcttgggccaatgagaggatggactgtcccccacctgcagagttctgtgaagtggtgcggacgtctttgttgatctcatttggtgcctccccctgttgatggctgaggaagccaaggctctgagaaggcacatggtttacccgaggggacacaggcaaggaatctgaacccggattgcattttctgttttagggctctttgtgtgaccacggtgcttcccaggcccacacttccagtgttccaggcccttgaccaccaatcctgtggaggggtcctcagggcaggcagtgggaccacctgaggcctgcgtggggtggcctgtggtgtgagggacccaggaagtcagcctgcacctcggcgagtcagaagatgtggccatccaccaaccatcagatgttcccctacgcttagggctgtgaccagaagtggcatcaagatgggaggcgaagcttctgggaccagagaaccagctgctcctgttcatcctgcttttgggtgaatagctgatgctctgggcccctcatcccaccatcccaccccgtggctcctcctgagcagggctgagggcatttacctggctgccttctaaagcagacttggcacgagacaatcttattcaaactctgctcaaaattgctaccctgaggagagggctgtgaccaggcaggacggggtgtgataacatggaacgcagggcctgctggagcaggccctgatgagtgtaaataactgtgttagaggcaggacctgagcttttcactccataaatatatattacttctaatgtggccagggccgagctgaagatcataattatgtgagatctgctttacaggcatttagggaaatgcgtggggctgcactgatgtaggcaaagatgtggccacatacatttaacgtgtctcagaggagcctttgctttaaccctttaatcagacccttccagggtgctcctgacttgatgttccagagcgtttggagtcaagagttgcactcttttttcttgcattaaatgcacttgagttttaacccagtctctgggcggatggcagggctgcatgagggggtctccgtggatgtggataagtccagagaagtcagctgagctgactgggcaggtcttgggtaagtcacgccacttccctgagcctcagtttctccagcagtaaaatgttacctgtctgttagggttgtaagattgagtcaacatatgtacaaggcattgcttagtgtttaccaccttgctgtgagctggtaaatggttggttggtcccttcctctccccttggtgttaagcatatcaaaagatggctgcgtgctcacctcccctgctttactgggtggacaaaggagctgtcacacagtgtggcagccttagaaaggttaaagaaggccagtgaagtcttctggctcatctggtcctgaggtgggtgagcattaaacccagatcctttttgtgtttcagtattggatcctttggccgtcatatctgagacccagggcctcagagtgtggggtcctaacctaatttggctttgggtgaactggccagcaaatggaaggatggctgtggaagtgtgtcttgagcctgtccttacacaggtgtggctgtcatcaaggccatcttcatgggcacgtgacgagtacagtcacatagagttcatgctcaggagggccctatgcttggtttaatgctctgctgtcaccagcttgaaatcctttttttttttgttattgttgcccaagctggagtgcaatggctcaatatcggctctctgtaacctctgcctgcgggttcaagtgattctcctgcttcagcctcccgagtagctgggattacaggcacctgccaccacacccagctaatttttgtatttcttttagtagacgtggggtttcaccatgttggcgaggctggtctcgaactcctgacctcaggtgatccagccttgggctcccaaagtgctgggattacaggtgtaaaccactgcatccggcccatcttgaaattcttaataattttctctttgacctagtgttttggagcatgagcatggatagaggagatgtgggcagcatgtgcccattgagccttctgccccattcacatgtagcatttgagcacagacttctgccggacctacaatgtgggggagttgagtgagagtcaaagtgagtgtgagatgtcacatctgcgactgagtagcaggggccctgacagtcctgatgctttccatctaactggaacttgtcttggttgtagaaagaaggcgatgacattctaagaaacatcaacgaccaaagaaccccatcatatcctttattactcacgtcacttccctgacaccaaccacttatattgaaaatgatgacggaagaagggaaaggaaagatagggcacccatattgccttttcctttcagatcttccttactcctcaggcagcataaagagtgaggtagaatggacacatagcgagaagtgaagtaaaaacgattgagttagctttatggatgtttctctggttctggtacatcacaaaatgcacatccaagtcctaaaatacaattcatgtaatgttggtgattccacatactagttaaaggctttttatatttgcagttaaaactggcatcacacaatataaataggagtggtaaaattcatgctaattcatgtaatttaaaattttaatgttgctttacttagaataatattaaatagcaaattaaaaataccatgacacatcaagagagagactgtggaggaaagagaaaaagctttctattttagtaccatgattgatactttttttttttttgccttttgcacaaagggttccatattttcattttgcactgggccccacaaattatgcagccaaccctgactggcatcctggggctggaggtctcaggctggtcttgcacgtgcagcctctagatccctggtctgctcacattgtctcctgggttgcggagctaagaagcatcatataggcaagtgagcatgtgtgcttgctctgaagattccaagcttccaggtggtggtggctctgttgatagagataaaaagttgaggaatttcagaggctacaaacatactcttgttgaaggtgctttgggggtctcctgagcatttacttttgtgaatttttgggcagcctagtatagaggtgatccagcagtaagctgagagagaggccctagtttgactcttaactcaggcatggtctccttgggtgagtcatttcttcatcaggcagtcctcagtcttttggttgcagtgtagttgttaaaaatgtgggtacttggaggctgaattcttgggtcaaatcttatctccatctctctgtcctttttttgtggttttttttgtttgtttgttttttgtttttgtaggggacaggttcttcctccaccactcaggctggaaggcagtggtatgatattggcacactgcagccttgacctcccagctcaagcgatcttcccacctcagcctcctgagtagcttgggactacaggcacacatctctatgctgggctaattttcatgttttttttgttgttgttttttgttgttgttttttgtagaaacagagtttcactatgttgccccaggctagtctcaaacttgtgagctcaggctatctgcctgcctcagcctcccaaagtgccgggattacaggtgtgagccactgcgcccggccttatctccatctcttaactagttgtttgatgttgggcaggttgttcaagcctcctggagccttggtttacccatctataaaatgggtataatggtaattatcttatagcatggtcatgagcgtgaaatgagagcagggggaggagtaatcattgtgtctggtccatgggactgaatcaatgctagcaatggtcatgatggtgaagaatgaggggaggaggaagaaacaattcctgtgggtgctaggaccaaaagtagtatcctctaggaatcctggccttcaaggtctaacttccaagattctgtgagtacgattctagggagcctctgcctcagacttctaagtagttcttcaggctgtgctctagaagttactggaatgaaagaaaaattgtagtgtttgaaggtcttcaaggatcctggtcctctcacactgtcactcttagtcacatgacctttgactgtccattccctactaagccttggtttacgcatctgtcaaatggagcattcgtgggtgtgcctgccttagaggatgagacccagctgagatgacatatggagaaatcgtttataaacttaagtactggtgttaggaagagctaacacggtgagtcttcagtgtttctttaagtgctgctcactactgtcctgagagactccaagaagcagttactttgtttgggcctcagttcatcatctgtgagatgagaggattgggctttgtgcctaaactgcccccccaccccaccacccaagacagattaaaaaagaaggaaggagggagggagggagggagggagggagagagcgagcgagcaagcaagcaagcaagccagcaggatttggaatcgtcccctaattggaaccacaatcgcaggtttcagggactcaggaaagggtgcagcccagcttgtggttgagaaatgaatgtcagatgttaggaagaaaaaggcctatctcaacatagcaggggtttcttactgcccctgcctcctcagccccggtagcctgtcactccctggcgaacagcttggcagcacagaggcaaaccacagagtacatttgaggcccagatctgcttatttcgagggtggggccgcgtttttctcctgccacagtgagctaattaaagaaaacaagcttcgggagttgggagagaactgtccacaggacacttggggaggcttgctttggttgtggaggcctccacagcccccggaaggcaggtggaagtgggcatggagggtcctacgcatccccagcgggggtctgagggcccactgttgctcagctgggggatttggggacggtgggagggcatacatggatgggagggtggactccgttcctgagggggccagtgtggaggagggtcaggcagcccatggagatgggacagtgttctgaaatgcttcacaaatgtggacttttgccccaaactgtggacagagcgtatgtcctgagcgaggatcaactctgtgagtacccatgataattctcctttctgtggttgccgccctgttgattcatgtgtcagccttagagaaagtggctgtgacttctgcattcctgggaatacactgacatgagaagaagtagccgctcttgttcacagtcacagggctggaaagtgggataaggactaaggacttctgtctctggattcagcatgctgattatggggaaaagcagacatcaattcctcatgtcttgtaagcatcactgtcctccaaagttggagcccagctcagacagctgcatagtattttatagagaaggtgtgttgttgaaatgttgattatgcaaattgaattgtgttttaagactactgggaaaaccatttaaaggaatcctgttgtaagtcattttgaaaaatggagaattacaccacctccccaaggattttctgttttggtaaatttcatgtggcaagattacttgaagaagggttccagtgttttgctagcttataatggttactgcataaggaaggtttactcgccagaggtccgcatacattggagaactgggggaatatgtaatacttgtgcagaaatgttttgattcatgtactcagaagatgggatctggatgacacctccagcctattgattcccaagtaaggtgtgatgacaccaccaccagcgaggtgtgctatgaggaatttttgttgatgatgaaaagtgaatgctaactgattgcacaccacgtgccccataccttacatagattatcttatttaattgttgctaataatagtactacagtctgtgaatgatttacttagcaattaattcaaaagcatattccactctacaatggaatattttttgagccaagaaatgaagtacgtggccgggcgcagtggcttgcgcctgtaatcccagcactttgggagaccaaggtgggtgggtcatttgaggtcaggagttcaagaccatcctgaccaacatggtgaaaccccatctctactaaaaatacaaaattagccgggcatggtgccacatgcctgtaatcccagctacttgggaggctgaggcaggagaattgcttgaacccaggaggcagaggttgcagtgagccgagatcgcacccttgcactccagcctgggcaacaagagcgaaactccatctaaaaaaaaaaaaaaaaaaaaggaatgaagtatgtgccacaacatgggtgaatcttgaaaacattgtgctgagttgaagaattcagacatcaaaagccacatatcacatgattccattcccatgcagtatccccataggcaaattcacagagacagaaagcagattagtagttgccagggatggaggagaggggaatggggagtgactgcttcatggatacagggtttccttgagggatgttctggaacaaaatagttgcggtggttgtacaatattgtgaatgaactcaatgccaccaaattatacacattaaaatggctaacatggtagatttttgctgcatgtattaatatattaatgtattaataaatgtattaattacaatattaatatattgtgatatactgtgatatattgtgataaatatatcaatatattgtgataaacatataaattgattttaatatatattaaaatcaaatgtattcctctaatggtgtccatgtcactgacttagtttctgataggtttgtattgggtaggaaagaaaggaatgggacatttacgtgtacactgaggcagaagaaagaatgggactttccaatccaggctctacctttatgaggaaccagagacccagagagtgctagtgacttgctcaagggcacagagcagcgtaccagagttgagctttggcttctagcctcctcactttctattggggaagtcacagtggaaaagggggttttggctcctttatgtctttgggtatgttctgggtcactgaggatcagctctattccacctggcattttgtgctttccatgggtgctcaggaaactgtctgtctcaccctgaggtgaggctcaggaggctctggggctttgtagtagaaatagaaatatcccaagtcctgggttgtgtccttgtggatgtgtctagaacaattcctgttgtgctactcgctttgggcagttagcgaaagggactaattgtgtgcaaatacatacgtttggtgtttgttgggagacttgccatgtgacactgcttcttcttttcttctctttttgactatgaacacctgacactacaggaaataagaaactttccagtacctaatttatgcttactctactttcaaaccctgttggccccagcacagggtaaatgaaactgtagcttatagtaatatttacgtatgggagtcaatgagctgtttaaatacttggatgtcagaaaaaggtttcaaatttagcaagccccctgactctcccaccctctggcatgtactgggtaggcctgcctgctctctgaggtcgagctcttgtatcctgtcctggtcggtgccagtatagcaatgatgatgacagtgatgatgatgccactggaacaggctgagctgtaattgaattaaatatctgtgtaatccctaggagaagctgaataaggtttgaggatcttggaagttcagttatactctcagtaactgaggtgagatccgtaggcaaggaatgacaagatcgagattgattagctacatgaccttaggaaagtgacctaaaggttgttcacattcagagtcctcatctttgaatgtgaatgatatttctggcctctcctatcttatggagttggtgtaagcatctgcatgagatgatggacgttaaagtgctttgttagctgttgagactcttactgaaatgaaacccaaggatgggtgccactgaaagaaacaagaatgaatgcaaactagtttgtgttgggagttgtacttgacacagctgaatttgcctttgtctttaggagagccttagctgtgggaagcagggcttggaatgcgctgatatttatttcttccatcaaatcggattatgaggcacctgatctgtttaaggctgtgtgagtagaaccaggtcctgccttccggaagttcatggttaaattgtgttttcatgggtcacctggaaggcgagcttgttcagaatgaggataattgacccagtgaatccttcctgcctcgaggcccaccatgttattcagatcagtcttgggggaaatgctgtgaaagtgtgtgtgtgtgtgtgtgtgcggtgtgtgtgtgcatgctcgcgtgcatgagtttgtgttgagagaaagaaaaaagccaggagagtaggatgagtcagatttaaccactgttttttcccttttgaaacttgttatgttcatacacatacagcagtcatgcacttgctcagaaatgtgtgaaaaccacttaaaatgtgtgaaatgcagccctttagaaagtgtgccttccaccacattcttttgagcagtggagtggatttgtgagtgttcatatctgtcctcatctgtgggaattgtatgtccaaggtgctaattcagggccatactgggatgacctgtgtgtatagacttgtcctgggtgagatgggagcaagaccatccaatgtatgatggggaattctgttaaacaggtagaattctgaacctcttggtggtcctggctggtcagttgcagggagtgacgttgaatggactgggaagatctggatataccatgtttctgtaggcatgatacgtggtcccttagcttggtatttaaagttctttggaagtgaccgctttctggatttacctctgtgcagcccctctgctcctcccaggtgaggctcatcatagctcctcttcaatgtgctttgtccacaactgctgccatgttttagctccccattacgtttcctgggatgctctcctagactcctctgtacctttcttctttcaaacccaaaacaggtcccatctccttagtcttaactgtctatgaatggtctgttgcctcacttcccagctctggtatgtagtacgtgctcagtacacatttttgaatgcattaatttggctcttttctgtgaaggcagcttgtctgtgtgtcattcatctgcccaaatttgattgtcaacttcctttgtatggagctgtactgttctttttgttgtttttcttaactccttgcccctgcctcccatcaccccagtggaagagttatagtcaaggtagtgtagtcaaggtcgtgcaaaagctacacacttgaacctgttccgtgtggtttcacacaaggcacatggcctccttgggactcacttcacatcactcgacaaggggatagcaggacccaccttgactgtattgaagactgcatgatgatcaggagagagtgagggatgagaaagagtttggaaaacagcagaacacgatgcaaacatgagttattcatggttttgtgtccaggctaactgtgccctgacattaaggctgggtgggtctggcccagggcttctggggtaggcgctgtgctggtgtgtgctactgacctggagtccaggatccctgagtcccactcaccctccctgggctgcagtttcctcagcccagctaccctttccagctgtgactgctggttgtggagctgaatgtgtgtggggtgtgggcctgtgtgtggactccccacccctgtgcggttttcctaagcacatagcacaacaaggagctggaacagagctgcaacaatgaggagggtttcctccaactgtcagtgcttctggatccaccgtttcggctttgacattaccgtgagtgaccaccctggacctctttctttgtgccaaactcgttgctggattgccataaacacttacttggattgattagagaggctatttgccgtattgaaggtggcagaattatttcaccttttccagaggtgttgacgttcaagggtagttggtggtgactgtacagaagggagacaggaagcctggaggaaggaaaggggtgcgtagccgagaaagtgcacaacgggccctatttttaaaagtgcctgcctctgctggttttgttgtggcagcgctcaaaggcaggaagacagataagatcggatttcaggattttcgtctgccccccatctccgcccccaacttttgacaaccaagaacttttccccaccaggagtgggtatatttcaacttctgtaatccctgcgtctcgcacaatgcttggtattacaaggtgctcactgagtgtttgaatgaatgaatgccttcccagttctcatcacagctatagggtgtcactgtatacatcaagtcatggttagccgcaggtttgatcggggaagagacactaatcaatgtatctgattctagaagaagatggagcttctaggaagggcctgccctcaggctgtcctctgtgttccccggcattctgcattttgcagtcacccctcattatccctgagtccaggaacacctgagattggaaaggattccagccccatagggcctttatcgtggcccccagtaagtgataaatattcgtactaatttggggcagtgtcctttttccagctgttttcccatgagtgccctctgttccgtcaggtggccgaagacggataactttggcaaagggcttggcacaaatggccaagtttacactggatcactatactccgtgttatcttgtttccccgatggtcattgccacacaagaaagtacttcctctgtgggctttgcccaccctcttctcttgacagagacctctgggcctagataaatgtataaactgcattgcaggaatgaagccgtttccattaagaactggggtctatgtcctgggatccagttcttctcccccttttagtactgaaagctgcttcccatctgaaagctgtctggggacagacaccgtgcagctgcgtgcagacttctttcagagtttgatcttgcaggcttcccagtggctctgctcttccttgtctgcttcctgggggtctctcagtatcaaagccacctgtggctccatctcacctccctgaacaggaggcactgtttgtcaggaggccttgccacctttggccctttctttccaaagaaagatccctggcctggagtttttgtctcagctctgttgtgtgaccttaggcaagtcagttgacttctctgagcctcagtttactccttagtaaacaaaaaggttggatgaggcgctctccaaagttcttgccctctgtgtccttcctctgcgttctacagggagggagtagctgcctctgtttggtggtggggactcaggcaggatgggtagggaggggtaggggaacaagatcatggcgcacctccacggccacagtggaaaccttgaaccttgagctgtatgcggtgagtccaggatgctgagaagatgccgggctgttgggtaagcagagcccctacgggaagcaaagagtattattcagccctgtggaatgctgaggcagggctgagcttgggcagggtggctgagagaattgtggctctagctgtgggcagaaattcatggccttgaagaatggctactgtatataccagtgataaatattagtcactctggcagcagaatgagtttcctgtgctgcatttttggcacttccagaaaagggaaagcctttctctctgacagggcacaggagggagaaacaggaatgtgtctcttaccctgatgccctggctggagatcccgtggggttttcaacctgcctgaagcaacgcagggcctgctaatgcctcctgttgccctaggtcaggccagggcccattgttgacatctgtgctgtgctgcctctgaaggtcttgcttgagcatgtcctgaatggaaggcttcatctgcattcattccccggccctccctgccgtctgcacagcctcctccaggcctccccttcccagtgaaaagcaccaccatccagacctcaggaagcaatcattttagcctcttctccttctccctcaccatccaggacatcactgagccctgtcagttctgcccccagaatatctaagttcatccaatgccccatttccactgctgcttcctcacccaaatcaggatgtttctggccccgtctccctcctacctggtctccctgcctgtaccctcctctccactgggcccattctccaccggcagccagcatgatctctaagaaatgtacatctgtcatctgtcatatctgctgaaaattgttcagggcttcctgctgccttgagaatgagggtctgaatcccaaacaagggttcaaatctcaacctctcaggcctaccctgaccttacgtatctttcctcagggcctgtgcacatgctgttccttcttcctggaatgcttgtccccatagttttcagctggcgaatgtgagtcaggtctccccttaaatgtcatctaagagagccctttctaattcctccccttcatcttaactctatccccaatacactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgacacttatctgattacctaattcacacgaaggtgttaatggtggtaatggcatagtatttattaccccaggggacccagaacggtggtatcaaaacatatcattccccagtggtttaaaactctggtagctttccagggagtccaagtggagtccagtctccttagctgagttcacagggccccgtctgcacgacttggcttctgtcggcttccctagccctgacttcccaagccttagtcatcaccctctctcccacccagggctcagcacagtacctggaacagtcaagccctcaataaatgtttactgagtgcattaaaaaaaaaaaaaagattttaatgagtcatgctttaactgaagattttagtgtagtcagtcattgggccttggatgccaaaggaatgacaaatggtgggaatttcaggcacagtgactgtgatagccccaaggaaaccaagagagaagtagctttatctgggtggaggggagtgggcctttcagagcctcgaaatcttcccacctgctgcgccactcccaccacataagcaccccacccttcttcccagggtgagatttctcagctctgctttctggggtgccagacaaggggagagccttgttgccatgccctcctgccctcctgccctcctgatgcagtctgtggtcacctgcaggcagagacagatgaagtccgtcattcggctgcgagtaatttctgatgggagaggggcttcccccggcccttcccgcctctctgagccttgccacggtcacttggtttgcccagcctaagtcactgcctgtcgctgtggttattgcatggacagggcctccctctgtccctccacttcccttccctgccccatactgttgccctcacccaccccaaagcctcacccttcccttccatagggatatggcctgatagaggaggagccatttgattttgactattgttgaaattgagtggggaattttgggtttgttttaggttttggaagggaggattatctgaggcttgaggcttctgtgatactgacatctggtgtggaaagtcatcctccctcacctaggtgactgggcctccaggtcatctccccgagcagcctccctggatctgctctcctctcccccccacccccccaccacctcccgcgctgtgcccagggtgatctttctaaaggacagatcttgcttcagcacctccctggttagaacccttccgtccagtggttcctagtgcttcggggataactcgccttgtcccttggggtctgcacagcgtcctccatctcctctcacttggccttgccctcgggggctccggtaagaagctttccaacctggcagctgcagactctgtgcggttgtattattgctgtaaatgggcagggattacgcatttgtggagtgactgatttcaagtacaactgccaccatgggagaggtctgtgaaaatcactggaattgaaaatgaccatgctttgcccaaaaaggttgagaatccccactctgatgatactagaagcctgcttgcctccccaccctgtgccaagccatttcttgcctccttgctttgcccataccagcctggaatgtcccaagcctattcaacttacttcctccaaaacgtagtcccatcttgatctccaggaagcagccttcagatgccccctcctcctggccactgcaaatgtgtccccccagctgctgagcatgcctaggtctgacacacaccacgatatgttgaaatcattggtttctgggttattcttctcacagtcccaggcagtgagccctcaaggacaggggctccatgggactggtctctgggtcggaggccaggacccaggtcactaagggcatgtcactcatctggaccacagctccctgccttgtggtgtggactctgttctctgcactgggctcgttctaaaacggagcatttggtccttgcagcctgccttgtggtttatgacttagtagattgaaaatgacagttgtgctctattttcatttggaaagaaaaaaaaaagtggaaaaccagagattgcactgatctggaggtagagagaaaactgtggagatcaaagaagatattatgtattatgaatgttacacagatcaaggcatgtttgaaataggcttaattttcctcaagttggcttttgtctcacaattgagttcttgttgacgaagaccagttattattcgtcttcgtgtctctggagtctagcacctagcacggtgcctgataaagcatggtcacttcacaaatacttgtcgaagaatgcatgggatgaatatgcatttgggtatttttaatgcttgatgattagaacattctcatggcttgttaacttgtaagacataattttcattgtaagttctttgtgtgtgcaaatgctttttgtgtggaatgcttgccatgcactgaaaaatgctttgtgatagcagttttgaaaaattgagtcattttgccctgattgaagctgggtgaccttgtgcaagtcactttaaccctctgggacttgtggccctcatctgtaaaatgggtagaaggtcagagtggacctcgtggcctgagaggctagtaccccatgctgcatgtaagtcttacatcctcctctttggtgattggatactgaccctctccccaggggttcctgcacagagctggaattctctctggtgtctttgcattctagtgggtggaatgccttgtttctcagtagcaatgagaaatgttaatgtgaggttatgaaagcaagccaagagccatggaataattaaaacacacacgcacacaaagaaggaaaagcgagagggggaaacacacttaatggacaagggatgagtaaaacccaatggactgagaaaaccccagagctgaacttcacatgaccccgcgtgctgcctgcagttgcgacacccgcgtgccccttacgctccgccggcctctcagtgatgtcagtgggccatgggccccacaggaagcaggggctgccatcagcctggtggagcgtgccagcccgctcctcctccacggcccacttcccacccacccgggtctccagataacatgaagccatagctcccaggctcgtcagcgggggaaaccaactcagtgcttctcagaaaatagaaccccagcccattagtgatgtccacgcaggcaagagatgaccaagaagaatgtttgccttttaggagttctctgcctgaaaccagcaggtttcctttagggatagggtgactgtgcttgctgaacacctctaggtcgtcagtgaatgaaataattcattctgtgcttgagtgtctaagacccagggggtttaggaataattaggatactggctgtacccttggagttctgtgctgcttgggggatacgactcaaactcacagacatctgtggctcaaatcaaggcatatagatgcagtgactcttggaacattcgagggagaatcaccacctctgctggtggaggaaaggccaggaactgcccacctagttttcccatgaccccagcctgtagcgggatatgtcagaagatttggatttagaggaacttgggtttgacaaaatagaagtgtatgtatataaacagagttgggagtgatgggggataggatgctgacagcaccttggtagtccctccccctacgtgacagtattgacttcatagtgttgttgtgaggcttgaagaagatacaagagggaagaggagcgttccttgccgtgcagatgcaaatgctcattgttacttgttctgcctctctgtgtctgtgacatccagccctgtgtgggctaccctggttgcaaagtgggcctcctgccgttgagcagctatggtccagtgggcaggtacaccacagtcatggaagcctagttaaatcattacataatagttagctctgtatgaccaatcttttctttaaagaaattcttccttttggaataatcgtagatacacagaaaaactgtacacagataatacagaaagttccagtgtacccctgacccagatgtccgtaatgttaacatcttgtattaccatggtacacatgtcaaaactcagaaacaacattggtacattactagtaacacaagtccagactttattcagtaaaccttttgaaaaataatagctttattggcatataattcatacaccataaatctgctcttttaagggatatgatttagtggtttttagtgtattaatggagttgtacaaccatcatcactatctaattttagaacattttcaacaccacaaaaagaaacctcatacccattaacagtcacttcctgcccatcccccttagccctggcaacttagtctactttctggttctctggatttgcctcttttggacatttcatgtagatgaaatcatacaatttgtggacttttgtgtttgacttctttcacttaacatattttcagggttcatccatttgtagcatgtgtcagtacttcattcctttttatggccaaatagtattccagtgtatggatataccacattttgtttgtcctttcttcagttgatagacatttgggttgttttcacttcttggctattgtaaataatgctgctacgaatatttgtgtacaagctttttttgtggaaatgtgttttcatttatcttgagtagatacctagaagtagaattatggggtcatttggtagctttgtttacctttttgagaaactgccaaattgttttccaaagtggttgtgtggttgtaccattttacagtctcaccaccaatgtatgagggttccagttctccccatccttgtcaacacttgttattgtctgttttattttagccattctagtggatgtgaggtggtatctcattatagttttgatttgcatttccctattggctaatgatattgatcatctctccttgtgctttttggcatttgtgttttttgtttgtttgtttttgagattgagtcttgctgggatgtccaggctggagtgcaatggtgccatctcggctcactgcagcctctgcttcctgggttcaagtgattctcctgcctcagcctcctgagtcactgggattacgggtgtgtgccaccacacctggctaatttttgtatttttagtagagacagggtttcaccatgatggccaggttggtcttgaactcctgacctcagatgatccacctgcctcagcctcccaaagtgttgggattacgggcatagccaccgcacctggccttccatttgtatatcttgtttggaggaacatctacaaatcctttagccatttctttttttttctttccttttttttttttgagacagagttttgctcttgttgcccaggctggagtgcaatggcgccatctcagctcactgcaacctccgccacctaggttcaagcaattctcctgccttagcctcccaagtagctgggattacaggcgcccgccaccactcctggctaattttttgtatttttttttttttttagtagagatgaggtttcaccgtgttggtcaagctggtcttgaactcctgacctcaggtgatccacacgccttggcctcccaaagtgctgggatgataggcgtgagccaccacacccggctagccatttctaattgggttgtctttctactgttgaattataagagttccttatatattctggatataaattcctttatcagatacatggtttgcaaatattttcttccattttatttctttcaattctgtgggttgttttttcactctcttgatggtgttttttgaagcacaaaagtttttaattctgatgaagctaaatttgttttactttcgtcacttttgctttttgtgttgtatctaagaaactgttgcttaatccagggtcacaaaaatttactcccttgcattcttctaagagttttataattttagctcttatatttaggtctttgatccatcttgacctgatttttgtataagatgtgaggtaggggttcaacttcattcttttgcatgtgaatatccagatgtccatgcactgtttgttgagaagaatgtgctttccccagtgaattgtcttggcacccttgtagaaaatcatttgactgtaaatgtaaaggtttctttttggactcttaagattctcttttattgatccatacatctatcctcatgacagtcttgactactatagctttgtagtattaatcaacttttaaaatatatatatatgtgtatatatatatatatatatttttttgagacagagtcttgctctgtcacccaggctggagtgcagtagtgcgatcttggctcactgcaaactctgcctcccgggttcacgtcattctcctgcctcagcagcctcccgagtagctgggactacaggcgcctgccaccacgcccggccaattttttttttgtatttttagtagagacgaggtttcaccgtgttagccaggatggtctcgatctcttgacctcgtgatccacccatgtgggcctcccaaagtgctgggattacaggcataagccactgcgcccggccttaaaatatatttttcaaaatctacattgttcaaaaaaagaatctgtggtaactctcagaaatccaataattacaatagtaaatacaagtaaagatagacaaggaaattaggggagaagacaagaaaataggaaaataagatgacataagagttaatgttagtacaacaactaatatgttgtaaggtttgtgagattgttggaagtagcctgcacatttggccttgagctttctagcagccaagggtaaaatggaaatgtgactaatgacaagattaacacagatgtctgaaagattgtttaaaaaaatgtccccacctccaatattttcagggactgaaatataagcatatttctcccatagatcctaggaacctgagcttctcacgcacaggatcatttcatttgtgttagttctttccctttagacgaatagctctttgaggacagtaactgtgtcttatttccctcacatctccctgtagtgcttaggacaaagcatgggagatgcttacaaaatcttgattgaattctttttcaaattgggaatgtttattacattctttggcagcatttctgccaccaggttgaggttagttgggaccaatttggcggtggagaagtggcaggggctgccctcctggatgcattttagaagtgttttcttgcatcatgcttcctgagtgctggctaagcagtggaaacattgggcaggtggggttgtgtgcccttgccctgagagatggccgtcactttggagtgaaggtaagcagcattgcttcactcatgtggaacccacccgccttcccacctcctcagcgctggagggtcctctctctcgcccactccctctgacatgcctctgagactgcctgcccgatggaaatatccagcatgtatgagggaggtcctggccaaaactgaacagcttctcatggaattgggcccctcatcacctacggttatgtgtggcgcacagatggccactctgcaaagaggcccacccagatagctccctcaccgggggcaaggaacaagccaccttcaactgattacatgtcatattgggtggacctcttcgtcccacacccaataaagggctttaccatttttcagtagcatcctttcttaagagaaacaaaaaatagatttgaataccagtctttaaaggggtagttgtcattacttcgcagttgacagatggggaaatggaggttcagggtgcgttacctgcctgctctaagtcatatggtgagtgggttgcgaagacctgactccaacccagagaatcttgactttgacttcatcctcccctccttccacctgccagtacccagtctttatctaaatttagggggcttgagaggccattctttctattttgggtaccttcaaacaggtaagcacagttttctttgaagttacctctgcctccatgtgggagagtatcaacaaacagttcccccttccccctccaaaagcactctctgcacagtcacccctaggccaggagcagccttgtaatatgccacacatgttgttactgcctgtggcttttcacacctcctgtctcaaatattggagcttttttggctacagccctgtgatgaaggcagtgtgggtgctgttgaccctatcttacccatatggacactacatcatctagggtcaccctgttggttgggatctggagtaagcccagaggccaggattctgacttctggtccagtgctctgccctaggccttgagcaaatgtgtatcaagttgcactgacaatctttgaattcctggaactcatgccatgagcacttccaggagcaccttagtgcttcattacaaagatgatgagacgtaggaaagtctttttttttttcccacggaagcagaatctcacccacacccgcagattttgttgtgtcccttcagcactgagctgtgttctcagaacagaacaggtagaatagagtcaaaatgcaaacagaatggcctccctccacagtctgctttgatggaaatgtgatgccaagcaaacagaaaagttgttttggctccatctctgaggtcatttagttgctatttccatctactttgaatccacatctgctgtgtgctcagagccgtgctggttgccaaagaatccaacaagaaaaaggcatggccccctttggggcgcttgggtcctctcgcagtgccccaagcccaggtgagagacatgccctctgggccgtgattccctcatcagtaaagcaaggaagataatgtctggttaaccaccctcctggagtcatggcaaggctgatacagattcagtggcattaactcatttgttcattcagcacattttactggcaacttatgctgtgctgggctctggatatagtagtgagcaaagaggaagcactcacaagggtaacactgcaaatgctaggagtcatgcatgagaagtccagggagcctgattccatttgagcaaggggtggtggtctgggaaggttcccccaaggaaaagacataggagccaagaccaaagggtgggtaggagtaatcagaagagcatgtctctcatctctggacttctgtagagagacttctgtaaccactgtaccctctggaagtgggtacagaagtccagagatgagagagatgtttaacaacagagagaaatccacccgaaggactttttacatctctctaacatctcctgttcagtttatctcagctggcctttgctgagcaccagttagttgccttgtgcatccttgggtgatggattatggagatggcagtggttgacactgtctgagagcagctcccagataaaccagcgcactgtggttgatgggctgcctccaggtagagagtgaggccctccaagcacatcctggccatccacatcttcacatttgcagtgcctagcacacagtggacaaaagggatatactggacacgttgtcctaggatgcagattcctaccaggccttcaaggcttgtagaaatcttccctaaaactgatcatgtggcctccggtaaggaatctaagcttttgaatcttggatccatctcgggcacagggataacggtggcgcccatctcacggggtgtgtggacgttgtctcaataatgactgacgtgctgagcaagtacctggctggagaagcgtgtggtaaaggggagcagctgtgattattatgggtatcattcctagtggttctgcaattagtcttgacagtaagtgctgcaggacttcagacaaggagaggctacaggtgtggaagtgctcctcaaagcctgtgggacctaaatgggcacagtgaaggagagtcttaggtggaagcaagaaaactgagcatcaggaagggagcaagacccttggtgatgggggtatctgttctgcatggaggatagatgacttctcagccattgggaaaccagctaaccagctttctgcttgatggttgtagtaaaatcccatgattagtgacaatggcatgccaggtttgaagagcaaaggtcaggaggtgagaaagcagataaatgcaatgtttatcttgaaagaagttgtcaactacttggaaatccccaagcttacttcctccaggaagccattctggactacttcacccagttctcatagctcccgggccctccatcttcccagcactgaaacacacactgaaaagggcatttttctaaatatgtctctgcctccccttgtggagggatgtggctccttgagatctggggtcacggctggcgtgtttcgtggagtagctagaaagagtaataatcctttttgaatgcacagcatttacagaggcctcacaggctgaaaatggtaattaggatacacaattgggtcttttgacctcaaatccaggcattttcccaccttgtgggcctcactcaaatgatgaccccaggttctgcctgtgatgaatgagcaggcatggttttgttctgttaggatatgacggtagaagagagctgtttgtcagaaccagcagtggcttcagatcttgaaagtccaactccttcattttacagaggaggaaacctgtgccccaaagcaggtccccccaagttccagcccagtgccaccccactgcacagagcagctgtctccttttgatcatgaggaagccaccaggtccctggtggagttcagcagatgtgccgggtgggcgactctggtgggtgtgaggatgtttcctttcctgctgggaagtcctccaagctcttgtgaaagagatgtggtttgtcgagcatggattttcaaactttctttatagagagctgttgttagcttaaaaatgcctggaaacatgatcaagtgtaatgttttaatgataacatagaagcacatagtactaagcacatgtaatgagaatgtacagaactctctagtaagagtctgaaatttggccgggtgcagtggctcatgcctgtaatcccagcactttgggaggccgaggcgggtggatcacctgaggtcaggagttcaagaccagcctggccaacgtggcaaaaccccgtctctgcccaaaatacaaaaattagccgggcgtggtgacgggtgcctgtaatcccagctactcaggaggctaagacaggagaattgcttgaaccttggaggtggaggttgcagtgggctgagatcgcaccgttgcattccagcctgggcaacagagtgagacaatgtctcaaaaaataaaaaagagagagtctgaaattcattctttcaacatgcttgtgttgggtgctgcctggcacagcaattggtgcccactaactcacagcgtcggggaagataggcacggaacaagtcatctggtgtggtccctgcagtgggggagcccagtgagggcctgtccagcccagctgagaggagactgagagaaggctaggtggcataagtaaagatatggatagcgctttcctcttcagagtgtttattaccagggttagataaagcagatctcatgtattttctgctactaagtagaagttcttgttttgtttgatttctggtgggctttgatattttccaaaaagataataactcattgtagagtaagatcaggactggggccagcagacttgggtccaaaggtgtgtcatttttataccagactagaatcgggtgaggggagatgtaaagagatcactattgtcacggaaggcgctggaaggagctctgcttagaaaaaatgcctttctctaggaggttttcatccagcatgggaacacaaaacaccagtttaaaatagctaggtaaggcttcacagtctctcaatgtgatgtgggtgtcctgagtcgtgaacatcccattgtgcaggataaaatgctggtttctgagctgtctttcaagacacaacccaaatgctgtctttgccatggtgccttccttgggaacccaagccaggtgaggtctgccttttctctgatgttgcctaacttttcctctttgtgtcccttgagctcagggacatgcatcccctgttgtacctagcacagaatcatgcacaagcaggtgcttgttaactgttggtgtgtaccaacaaacatttacggagcacctattagcaggagcacaggccaaggagctggatagatgagcgtggagtttgggggagaggtctgagctgagatatacatttgtgagtcatcattgtatggatgaggccgggctggggaggatatgagcgtagaatgagaaggtccagacctgcacctgaagaacagccccatttagggaatgcagggagagacagaggaaaagcaagatggtgcacagtgacattgaaggtgagtgacgagaccctgcagcaagaggaaaggagcagcagtgctagatgttgcagagaacccagaatggtaaggcctgaaaaccatgtgttttagattctgtaacctggaggccactaggtgaccttagcaagggcagtcatgatggagtgttggggctgaagcccattgcagggaggcccatagtcaatgggaggtgggcagtagacacagagagctgggttattcttgccacacagctgtgctggggccatggcgggggtgggggtgccacagagtgggagccagagagggacctgggtaagggctgaccgtgggtggggagcgcatggagtgctttcagaggccaagtgagtggaactgtctatgaagcagatggatggaaccctggctgaattatctcagacttgccaaagacattcataaaattcagacccgcacacactcgggaatgggaaaaatgaattattttgtaagaagcttatagtccaaaggtagaattgcccaagagagcttctgaaaggaaaaagtcatagcaagttgatatttttaaagtgaaataacataggttggatttttctagtaacttcaaggggtaaagactttgaattttttttttggagacagagtctcgctttgtcacccaagctggagtgcagtggtgcgatcacagctcactgcagccttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgggctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgacagtatctgagtgggaggcctggtaaaatgtctgtgtttaggatgatgaacgccataatctaagactgctaagtgctgtggggtggtctagaagggcagatgggctagctgcgaggagggcagaggcactgtgcaatggtgttgcctgggaacactccgtggagagtgtgggaatctcaccctggccctaccaggtaagaaattgggcctgggaaattgggaagggaatttttcaagcttcatggctgctccaggacttgaactaagactttcctttagagcaagcttgtccaccctctggcccgtgggccgcatgtagcccaggagagctttgaatgcagcccaacacaaattcataaactttctgaaaacattgtaagattttttttttgcgattattttttagctcatcagctatcgttagttagcgtattttatgtgtggcccaagatgacgactcttccatcgtggcccagggaagccaaaacaccggacacccctgcttagagaaagtgcgttttctgttataaaaggaccttgaatccccatctcatatgttgggactttgtcttgcatgttttcaggcagggcatgattgtatctgtaacataataatatgtaagaatgtgtacttcttagcctttgcagagaggcgggaggcctgtttcctgcagcccccgccctgtcctggctgaggggtgggaggcagcttgctggccagccccgctgagtcaccctccggcgtggagcccagtggggatttccacgcggccccagtgttctcttctcctcgtttcctgttgggctgtgacgcaggctggctgccagcgggtgccggtgggcactcctgacacaggccactgccagccggccttgtgggtcctgagggcatcgtgggtggctctccccccacgagtgactgtgcctggcagggtgtgccccacatgtcagttgcactccgttctgggtgggcagctcccagaggccccggggagggctgcagatgggcggggggtggctgcctgggaggacgggaggttttgttgaagagagagcttgctcttggggcagtttgtactgggcgtttagggttataaaaacctagatttgctgaaaacggctctcttttatcttctgacaagaacatttgtgaagaaaacaaaacagaccttcagccatttagtctatacaccgagagaatggtttctacagtatgcctgatttctctgggtctttctaacacatccatgtatgtgcttgtcagcttctagtgcctccatttcttgatatgaggaaattttgcttaaaaaaaaatctctactgataggacctctgcatattcatgcatgtttttcctccagaactttgtgtcccaccactgtgctaggcagtttacaaatgccatctgatttcattcctgccactacagtctaaggctatattgtccgatacctatccaccaccctcatgtggctatttaaatgttgggtcattaaaattaaatacaattacaaatgctgtccctcagtcacaccagccgcatttcaagtgcacgggtaggctagtggccatcagatcagctcatatagagcagcacgttttcatcaccaccaaaaattctattgggtagcactggtctaaggtccggacatatgtccccattttgtagatgaggaagctgagtcctacagaggttaagttgaccacttagaagaatgaacagatgaaaccttttcattttacacatgaggaaactgaaggttatactcccctttccttcttagaaaagagaaattgatctgtaggcttcagggactcttcagttagcctgggggtactgtgcgggtcagctcttttgctgttccccccagaccctgtcagctgtgggtggtggctggtttctcttggtttcctcaccagagtttgggaatgagcaagtcaggactgctttccgtacggtaatcctttggcccatttcctatcgggggatttatggagctggtgatctcttgggttttttggccatttgttagagccaaaagaggtcacaggaaatgatatactagtttcattgcccaaaatactgaggtccagagaggtgaggggatgctgagggtcttgcatctagctaagagctgagctggctcttaaacttgttttcaagccaggacttacctgactttcttaggaaagtaatcactccatagacaaggataggtttttttcacagagcaatgatgttccctgtggtccctatgtagggtggtaaggaatagggctttgggatcctacagaccagggttcaaatcctggccccaccacttgtaagttatgggacttcagacaaggacttaaacattctaagtcctcagtttcttcatctgtaaaacagggataaaatatctcagtgaatttgttttaaatacttgcgtccgggcatggtggctcatgcctgtaatcccagtactttgggaggctgaggtgggaggatcgcttgaggccagaagtttgagaccagactggccagcataacaagaacataacaagatctcatctctacaaaaaattaaaaatattagctgggcatggtggtgtgagcctgtggtctcagctactcgggaggctgcagtgtaaggttgcttgagccaggagttaaagtctgcagtgaactcgccactgtactctagcctgggcaacagagtgagaccctgtctcaaaaaaaaaaaaaaaaaaaaaaatcagccaggcgcagtggctcacacctgtaatcccagcactttgggaggccgaggcgggtggatcacctgaggtcaggagtttgagaccagcctagctaaaacatggtgaaattccgtttctactgaaaatacaaaaaattagtcaggtgtggtggcacacgcccgtaatcccagctactcgggaggctaaggcaggagaatcgcttgaacccaggaggaggagtttgcagtgagccaagattgtgccatcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaagctataataaaacatcccagagtatccaaaaagcctggaaacaaagggaaaatagtgtgtcctgctttccaactttcggatatgctgtagaatagactgaaacaaatcactggaaaataggttgttgtcgattttatttagaagcttttgttcctttggattttcgtctcttatttttagacagagtctccctctgtcacccaggctggagtgccgtggtgcaatgatagcttactgcagcctcaaactcctgggctcaaatgatcctctagccttgacctcctgattagctgggactacagaagcaggccaccacgtctggctaatttttgtatttttctgttgagaagaggtcttgctatcatgggcaggctggtcttgaactcctggcctcaagtgatcctcccgcctcagcttcctgaagtggtaagattacaggcatatgccaccacacccagcttttttgttcctttgaaagaaggcattgctaatgattgccctgaggtgtctagatgacccggccagccatccacctctgcagtttacacagcttgttgatctccacagtgagaattaacttcacaacctgggtccaagaggctggaggattgtcagtctttagaaaaaaaaaaatctattatctttagagaagatggacttgttgaggaagaagagtagacaaatactttctggaaatattttcaaagggaattagaaaaagaaaaagattttggttgtcctttggtgaatgagaatattcatcagcagaatgcctcattaccacgtcacacagctgaccaaggcctcatctgagactgtgtttgaatagaaattaaacagggctgacagtgaagtttctgcttttaattagctttcaaaggtacacctctacctgtgatgttgaaacatcttgaaaaacctctctgctctgtgcctgaatgaggggcatctagagggcttggaagagaagatgtggcacagggcagccggggagaggctggtggccagaagatggacctgagcttggtgaatttacctggcatctgagcctggcctgaacaattcagaaacctcatttcatcagtcttggagtcagggctcctgtctcttagcaaaaagctaaagcatacatcaagcatatttattgacaagcgtaaccactgtgaggttataaccagggtgctctgtctgcttatgggcaccccacccgaccagccaaatggtcagagagctgggtgggtcggggaaagggagggagggagtcatgggaagcagttgtgttgaatggctacaggccctggtggctgggtgcatccccgtatgccatccaggcccacccactgctgggccggaccttcccctctggacagttcttgcttgggcactgactgggtttgctgctgaacctcctggcctggcagctctggttgctgatccacccgcttctttctttatagagattaagagcggctccagtgtgtgtacggagagcctctttgaagcgctgttgcctttctgtggctagatccacgatcttctctctgggatcaccccataggacatttgctttccaccttctccagtcccagtgaatgcatggacctctgtcctcattgttactggctgagccagatgtcagtcctgtgacctggcctcaggaccactcttgtagcccaccgtgggtggatgaagccggtgggaacagaatgataggagttaaccactttttaggcgttattgggccttttcactttaatagcttaacagagacatctgtgatggcttgcatccagagtgcgtggtgtttatttttgatttgaaatatgaaaagcatttttttaagacaactgactcctctgagtcatgcccaggggagcaaacggcctgaaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcgtttaaggcccatcttcaccccataaatgccagctccccaaggacagagccctttcctgtcttgtccacaccatgttccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacgaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacaggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtaaccttggccgagtccctcaacctttttgcctcagcttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggtttgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtgtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcttacaccaggggtccccaaccccggggccgtggactgatacccgtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccacgctgggaatgctaagtacttctcaagccttcaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattatcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttaaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcaagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctccccactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgccagttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttcttctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1990 - DNA, 69480 bp, Homo sapiens
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtaagagttatcttatttggcagggtgggttaggtgtggggtatttgtcactgagaagcagaaactgtatgctcgacacacactccctgagtccttagggaattgcgtagtttttttcttttcttttctgggttcatcttaccagcagtcgtgtttgagaatgtgcacagctcaccttcgttcagccctttacagtttacctccatagccttctttgcgtcttggcaccatcttgcgaggtgtcaggccaggtgttaggatgctctgtttacagatgaggagattgaggcatgagttgtgattgctcacaattgcctcctgagtggtggggccatgctggggcactgtgcccagactctagacttccaggggtccgggacctcctgctgccagtctcctagcccgttaccacagctgtctgtttcttggcctctccctagatttctaatggaactcttggggtacagtctggaaataggtattttaaacatgctttgcagtgattgttacagatcttcatgttcaggtggcccaggggctgaccctgctccaacttccccctcagacattaaacctgtaccacccactgagatggttttgattttctattctgcgtttaaggcccatcttcaccccataaatgccagctccccaaggacagagccctttcctgtcttgtccacaccatgttccagggccctggacggtggttggcacacagtaggcccttggtaaatgtttgtcggatgagtatgtctcttcctcagctctgtggttagctgggagagctccgacagtagagtctggcaggtctggttcaagcatccctttggtgtaacatggtgtgaatggtggggcctcactgaattgtggagtggggggcagtgtgtctccctacgacctcctggtgaggagaagatagtcaccacccacacaggcacactcttgaatattccaggacgaggtgggcactcattagagggcagctcttacggccactgcctggtatgttttggcgtgagcagtagggtcatcgtggtggtcagtttttccactgccatcaaatgggatccatttagctctcagacagacaaggtatagggctggactctgtgccgtgggctaaataccggccacctcgagcctcaaatcaagcccagacaccggcataaacccaggtggcccaagccgaggtcgctccccagggccaggctcatgaatggataagtaaatatttaccctgtctgaggtcgaatgtgaactgtctaccaggtgttttgtttttctgtctcctccctctgtttctgcagtgcctccccctgtaaaaaaggaaaccaagaggctgacaggttaagtgacaggcttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagccttggccagacgtggatatggttatgcacggactccgttttgtggtttgtcatttctgacttgctgggaaatcctttgttgggggtggggatgggaagtagagcatctctggggctggagtttttctaagatgtgtaagatttagaggctgtcatactgcaaacagggagagcgggctgtctgcttggcttcatggtcagtggagaacagcctggacttggagtaagaacagctaggttcagatccctgcttttactcctgaccacttagtaaccttggccgagtccctcaacctttttgcctcagcttccttatctgtaaaacatggggttcttgaaggattaaaagagctggtgtgtgtaaaacccaggaacatagttcctggtgtatagtgacttataatttcgaaaaccttaagattttattcataagattttttttttcaaggccaacttaagatttctaagagtttgtttttcaaagagctggggtcttgctttgtcgcccaggctggagtgcagtggtatgatcatagctcactgcagcctcaaacctctgggctcaagagatcgtcccacctcagactcctaagtagctgggactgcaggtgcacgccaccacacccagctagtttttaaatatattttttagtagagtgaacctcgccattttgccaagcctggtctggaactcctggcctcaagcgatcctcccacctctgcctccaaaagtgccaggattacaggcctgagccaccacgctcagccttctaaaagtattttggtgtgcaccattagcactgtgtcttaaaggcgatgtgcaccttgagcacagagtgttgagtgcgtggtggatggatgtcatttgcgttttacagatgcggcaacagaaactcaggcccagccacttacccgaggccacatagtcccaggtagagttggaatttggaataaagcctgctgactccaatcctagatgccttccacactcctgtccccctacctctacaccaggcgtccccaacccctgggacccctgggaagtgatgtgcacttagcacctcactatgggaaacataaagcaggaactaacaggactcctctctcaagaaggaatttcagtctacttggggaaagaataatagccaagcagtaactcaggtttgtttagccttctagagcagtgttgccggatatcactgtagtgtgagctacagtgtatggtagcccccacttgttcttggttttgccttatgaggtttcagtcagctacagtctggaaataggtgaatatagtacagtcagatgtgttgagagaaagagaccacatttatataacttttatgatagtatattgttataattgttaatttcattattagttattgttgttaatctcttactgtgcctaatttataaattaaactttgtcttgggtgtacatgcacaggaaaaaacacagtgtctatagagtttggtactgtctctggtttcaggcatccactggtggtcttggaacgtattcccctcggataattgcaattacttctaaaatctaaaatcttctggccatgttaaaatgtaaagagagggtgaaattaattttaaatactatatcttgtttaatacagtgtatcccaaaccatcatcactttagcatatactcaaatataaagattgttaacgagctatattacattcttctttatcatactgagtctgaagttgatgtgtcctttatacttgtggcacatctcagtttgcactgtccacatttcaagtgctgccatgtggctggtggccaccatattggacaccacagctacaggatttcttcgttaggtcagttgatgtcacctgcattttggagtggagtcattgagctcactggctgagttacacagctagtgaggagccgggtgggaccagagcttggtcttcttcccattaaggaagaagggaaacttgcatttgctgaatgtctactatgtcccaagtgctgtgctagatactctacctttgtcattccatttagttctcacagcagccttgcatggtggatgaatatcatgtgcattttacagatgaggcaacagaaactcagagaggcccagcaacttacccaaggccacgtagtcccaggtagagttagaatttggaatagggcctgctgactccggtactaggtgccttccactcacctgacctccttctcttacaccaggggtccccaaccccggggccgtggactgatacccgtgtgcggcctgttaggaaccgggtctcgtagtagtaggtgagtggtgggcaagtgagcattacggccagagctccgcctcctgtcagataagcggctgcattagattctcataggagcgtgaaccctattgtgaactgcatattggagggatctaggttgcacactccatatcagaatctaatgcctgatgatctgaggtggaacagtttcgtcctgaaacatcccccccaaccctcatctctggtgccaaaaagattggggaccactgccctacacagagaaagagaatttgcacgtagcaacttaggcaaagtattcaaggaaagtgccaggggacaggaaggacaccatgggctggtggcctgttcagtaacagcttcagggtatcagttcagaaggcctaggcctgctttggttggggtggtgtatgtgtaaaagcagcattctgtctaatcacaggttctgcctgaaaggcagacacttttaacccttcggtggacagggttggtgatagctagtggggggtatgaggtgggggtgaggaggtggtggtgggcagcaattgcagaggccagagatcttggctgtgttctacctgccacgctgggaatgctaagtacttctcaagccttcaagcaactgagactttctgctcggggaatccccaaggatttggggaggctggaattgagcaagctcttgaatgcatgcatggattcatgcagtcactcactccacaaatattcacgtgctttgggccagaatgatttcggcaggaatatcttgtcctacatgctattgccatgttctctgaggacccgcggcttcgcatgtgtaaatctccctccagagtactcggcagattcccgaagctgactgaggctcagggagtgtcagtcccttgccacaggtcacatagtactgaatggaagatatgggacctcagaaccaagaggctttgactcatttgtccctctttctgtctgttttgccatcagccaggagatagtcgttgagttgtttctatttgccaggcatcgagctgtgttctcgggtttcattgttgttgttttcattttgagtgtgtttgttttgttttacttttaggagcaatcacagtgctcctgttgctgaatggtggctgatgtctgttgcatgccaagcactgcgcagggtgctggtcacagtttgctccagggattcctcccagtcccgctgtaaagaggaggaaactgatgctcagagacttggacctttctgaacatcatgaagctagggatttcagtcccagcctctctctcgagagccctaacttagccactatacctcactgcctctctgtgaccagggttgagtcctggtcctcaaatgaagcccgatttgccagaaccttcttttgaggccttacctggtcttcagttttaccacgtgttaattgggggcagggcagccagtccatcctcttctgcagaaatcaccctgtccaggagatgggtgcttcttcaggacactacctggctaagaacactgcattaacaggagatagagatccagtgtgtgtgaaccttgtgaaaacatctctgtctgttcctccaatctcccccttctgtcttatcatgcagggcaagctcaggttgttgtcctgtctctgttgggaggacccttgagtggtatctcctatgcccaagcagacctgcagagaaccctgtccaaactgatggtcatctgagacatggaacttcatgataggaaggtgtcttggaggataactagcaagtctttcactttatagagggggaaactgagtcctcagcgatcagccacatagattctgtgttgtagagacctgaggatgtgtctcatctccttatctgaacagcaagttcccatgctgcgaacgtctcaccctgaccctcaccgtattttttaggaagtgaatggggctttgagaaggacaacctcactgttttgcccatttctgagatggaaaatcaaggaacattgccccatctccaccccgggaatctatatgcccctcccataggcaagatggaagctagaccagaatgtgcagcttgtgcttcttgcgggaatggtgaggacagatgagggcagggagacagcattcctaaacccagccttttgacccaagaggcagggactccaaggctgtagaatgggaggaattgtgggaggaaaagcactgggcagaaggtctcagtcaaatgcacctgcagttattagctatgtgacttgggcataatgccacctgtgagcccccattttcctcactaggacagtgaactcaccaataggtttgagttgttgccctcccagaactgttgcatgaattgaatgaggtgccttgcttaactgtactgaatactggggaagcctgcttaaatggatgacaggctttttatcattagcaagctgccgcactccccactcatcactccaaggcagaccattgcattttctttcattctgataaactccttgagttgaacagaaatcagactccccgtaacttctgctccacagtttaaaacagcccaccatgaagccttatgtccttcaggacattctgccctgttcacttggatttctctcctccctgcaaagcatcatcagcttcctcctctgacccatgttttgcacttccttgcttgtcactcctctttaaacacttgtccaaactgtttgtggcccgtcctgtattacgcccagggcagatgcagtagcccagcccaagcagcagagaccatggcctccctgatgtggggtctgtgcctcttctccaggcaagtggctgtgacagtctaactttatggaagggtgaactcaatgacattggctgaactgctggtgaacacgggaaaagcccttctggacctcttatctctctctcctggccagaggaaaaccatgtcccatttgtcctgtttgagcactatcaggcctatagccataatcttttacaccgtaacataactttgccaatgccaatattatatgccctttttttttttctagaaaaacttaattgggattttaaatgcatttgggggatgggctgcgtttctgtttgcctctaaaaacaatgagaaggcaaacaaagtatgatcctatcgccagaaaaatggagccaaatctgaaattaatttacaaagtcattagtattttccatttgtgacccccaaaatgaatgtaggtgtagttccttgcaattaactgcaaattaggaaagggttgggaggatgtttcagggaccaacacacagaactgtagcagaagcagatgggggaatggaaccaagaattgccttggttttcactcaaggccgtggtttgggagagtagtgccgactcaaatattccccagaagagagcactttttcaacagtctgaaaagtggcagggacctttggaatgatctgttttaaccttttcattttctgaatgaggcaactgagagattcaggaagggtaagcgacttgcctaaagtcacatagccaggaaggtcagaaccaggaccagagctctgcttctgactccctggccagtgctccagctgccactgcccccctctctcctgggtgcttgtctgcttgtgcctttaatgttcagcacttgagatattttcacgtttagcaccttcacgtttagcagtactcctcattagaggaaaatgggatgatgtgggcagagtcacccacagagtcactccaggtttcagatgtgctggtgcttaccgagtgccacagggagaaagtggtggtttctcccttcccttaagaaacctggttatttccaaggctcaacccctgcaacgccccaccaagccagtcacccaccactgcacattgagaatctgctgctctgtgaatgaaattggcctggggttaatgagtggtgaatgtgtgtcagtgtttggtatttgcagcaggagctcttctgcgattccctaagctcagatgaacggggcctttaagatgccatccagccatcggagagatgcaggaaaggccttttgaaatgctgtttcccctgacctatttgaggtgaggccctgtgatgtcatttccccagtggtgtgtgtgagagagcaagcagcactaagaaaagccactgctgagagttcacagtccttgcttcagtgttgtcttacgctcggggtgccttaaagggcttacagcgaccctacctccagcttctccagctccctttccttggcaaacacttgacccatcccagccccttgggctttctttcctcctcctctgctaccacatactgtgggtgttgggaaattactaaaggcgcgactctggctctcaaagactctgaagtccaggatcgagaagaactgtgtttacacggagttgtcaaggatcattctgccaatgataacctattatcgtgcaactctgtgccaggtcctgctctgggagctttatgtgtgctgttgcccctcacactcacggcagaggtgagacagaatgctgagagatttctgcagacaaggaatctgaggtttaaagaggcaatgtttgatgagccactgaggggtggggctgggattggaaccgaagctggctgcccttcagcccccagggtcctgctggggagatgtacccagggggtcctgtgctgggagagtggaagcaggggtgtcactgggggctttgtcctgggagctgggcaggtgctagggacagagctggcctggttttggagccacaggagagaagatggccgggaagagctgtgtttggaaggttcctttctgtgccaggggtcagcaatctgggttctagcactgagaggggcaaaacgtgggtttgtaggggagagagggtgacccccagtgagggtaagaaagataagctccagtgagctcttctcaccctgggtcccagcctgtaccaaaaatccaggggcagcccccgggcccagcctgcccccttcacagtcccctgactgcttgaggctgtgggccagtggctttgccccttggaagcttggtttcctcatctgggacagaaaggggtcaaaacaccctttttcattgttaagattagataatttgagagccaaaacttcttgcagggtgcctggtaccaagtaggccctctctaaataaataaatgatagttttcattttcccttccacttaattgtttttttttaaaaaaaacttttcttccctgtaataacaaatttcagaagacaagttaatacattgctgtgtatactctcaggccaagaatttcctcagtgtttacataccagagcagtactttgaactttgattttctcctctgcctctgtgctggttcagacaccctctctaagatgccagaagcattgccctgccttggcctgttggtggtggggtatgtgtgtgtgttttcatcgtattataaaaacgtgaaacatttgaattacgggcaagtggtattctaccagatttaataaacgttaatattttccatattcacatcaggtatttgtaacatctctttctttactaaaaataaaaaccttctgctgaagacctcctgttactccaaccccttcccccttcttctcgctcccgtttcacaggtgtttactctcttttaaattggtgtgtgtccttcccagctagaattttgtagtgtattatttgtaaagccaaataaccccactgcaatgtgtttgaaccaccaaagcaaatgatcaccttttgggaaaagaaggctgaatatccaaggccagatcagtgattcaagatcacagaacaaacctaactgctctcaaattgaaatctcaaaattataaattcattgcctttgacttaaaacttggaactttcaaccctgcataattgcagatacattaaagattgtgccatcttgagctcccagggtcatctgaacctttcatgtgaggaaacacatcccagagtcagtcattcttttttttttttttttcttttcgagttggagtcttgctctgtcacccaggctggagtgcagtggtgcaatctcggctcactgcaacctccgccttccggattcaagcaattctgcttcagcctcctgagtagctggtattacaggcgtgcaccaccacacctggctaatttttgtattttttagtagagacagggtttcgccatgttggccaggctggtctcgaactcctgacctcaggtgatctgcccacctcagcctcccaaagtactgggattataggcatgagccactgcacccggcccagagtcagttattcttagagcaggtgttttggcttttgtctttaatgcttccctccccactttaacataactgtaatatataattattgtggaaaatttagaacacatggagaagtaaagagtgaaattgctgactgccctattaccccaacctccaccctatagagatattttctccccatccccccaagggcagaggatggagatccctgggcttctccaggtggggagtggtaccatggtctcttcaggtttcgtagcagacaggccccattgaccataggatatgtgtccccaaggtggttagaggccatcacctgcctgaggtcagctcaatgggcagggctgggcatctcctggtggtctacccaccatgccagttcatcaggctggggtctgacctctttctggtgtctggtgctgatctaggcaaggtgacaagtgctcaacagaggagtcctggttccttcaaggaagctgggaagtgtaagacggagcaggctgcgtttgtggtttttgccaaggcttgacttttgaccacttttctgaaaaaggacaagggtgtttttttgttttgtcattttttttcccagtagatgttcctatttggttcacagatataaacacttgaaccaggtgatatcagcactgcaagttgatttagtaccacagccattttctgtgtaccaatatgaagctgttccttcataagttcttccttttcgcttttttaaactgaaattattttcattaggatcactaccttcccatgtgcattttaccacaaaatttggttctgattctgttggcttgcttgctgttagtactcatgttagcttctgccattctttccaccattgtcctgggtaaaattttgcatatctgagttgttggattctttcatcagtttttggttagtgactttcatggtctgcagttttagttgctttcagttttattttgtgttgaagttttttctatgaggtttgattttttcagggtcagtttttaaatgtagcaaggagtgtgctttttcagtttgcttattattttcaacaaatgtttttggtgggtaattttacctttgttgatcaccagctttgtttggggtgcatcatttctctcaagccgaattttctctggtaatctggccagaaggcccatagggtcagaatggcaggtcaaaatgtcttggtgctttcttgaagagtttgaaacaagcttgcaaagtactgtcctccctttggatttcttctgtctgggtgttgccagggctcttctgttagcgacagagaaaataggaggtactagaattcggacttctaggaagggctgtattgtccttatcatcagaatccctccctcccgtccctgtgacctcccaacttcacaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1991 - DNA, 57175 bp, Homo sapiens
acaaacatgtcttgcctgcaccctaggcaaacgtggaaaggcgcagctctggtacaccggaaagcatggtggatggggaggtaggagccccgtgccgggacatgtcttttctctttcttgaactcgtctccccacccgtccacagggttgctggccagagatctgtcagagtttctccgggcttctctttctctgggtggggatgtggactcttaggatgtcaggaagcaactgtaggaaaccccctgtgtgggtgaagcagaggcgtcgctcagggccctctgcctggttctgggctctgggaccctgctcccctcccctgaaccccccctcccccggccccaggatggagcttgcttgccatcgcagtggatttgcggaagagggttccagagtgtggggagagcgtgctggggaggggagctatttgttcctttccagtcatcgctgtactgagcggttccctgggacagttgaacccaggggaactgaattcatctgtgtaagtaaacatccatctccccttaaaggaaaagcccctgctcagcctctctgggcagctggaatgctgctctgtgggtctgggcatttgttccttctttctttcttcctttgatttcttgctgtctccttcaattaggcctgtgactgttttcacatggctatttgtatatacaagccatgccaggcatcataatttgtgtttgtctagatcaataagagcagctttaaccaaaaagtccagctgagaatttataaatacccctcacctcctcccctccctggaagatgtgaaaacaccatcccattaaccctccaaagcagttggttgacttgatcagggaagatatgaaatataatttctttgaatgtgctttctctttactcttttagtggaatttgatcagtgtttaaggaactgtagccgattcccagcccacttcaaagcaaaagcccttcactgtgcctatttgcaaaattacctttgagagactgaagtgtcggaaatgcatttagacacagattgtgccttatattagctctccgttgccccataaaatgggcttgggcatatctgaggcagctaccaaaggaaacttaaaaacagattctggcggcagcgattcttgtgttctgtgctcactgtggaaaagaagggggctagagggatttaagtttacgtggatcttgaggattttaagaaccagatttcttctctttgctcacattaggggaaaaaaaataaacctcagatgccccgtgatatctcgttgcgtcaggttttcctataaaatgtcaagacggcaatattaggtttcctggcttgcttttccccactgtgtctgctcttgccagaatttttattagggggaggggagcattctctacccctcctccctcaatgaaatcatttcttccctagcctttaaccctttaaagtttgggaagggaatactttgattttagggttaaatagaaaacttccttaatgactgtggctggaattaaggtgtacttaaagctgtagcagccctggtgggtcctgggctgactgggtgctagggtttggtatggaaagcagcttgcatcacctgcttttcttcccatgcctgtgccttccccaagctccccctcctaagccaggtacgattccagctatgttaaaaggccctgggaaatgttaactgatcaaaaatgctgggtaagtagaattattatttcaccctgaccaacttcagtcagattagcatatctgctgtcaccaggtatggcacaggcatgggtggaagctgtgcttggaaagtgaatgtgtttaggccaggtgtggtggttcatgcctgtaatcccagcactttgggaggccgaggtgggtggattacttgaggtcaggagttcaagaccagcctgaccaacatgacgaaaccccgtctctactaaaaaaaaatacagaattagccaggtgtggtggcacatgcctgtaatcctagctacttgggaggctgaggcaggagagtcacttgaatctgggaggcagaggttgcagtaaaccgagatggcaccattgcatcctagcctgggcaacaagagtgaaactctgtctcaaaaaaaaaaagagaaagaaaagtgaatgtgtttgctggaagctgtgcttgattaagtgaatgtgtttgatccaagagggcaggggattctggaagagacattaagtacagattgatgagtgtcttgtctcaccgcaaaaacctcctttctctcttccttcctagtccccactgaaaatggagtggtgatagcttagttctcactttggtttcaggcaagagaaatggtacccaggaggtagagttgagtagagactcctttagctctcttcttttttctaacttctctttattccaccgttctctctttacttctgcctaccttagcagcatgctgcagaataaactctgctaggaggaagtttgaaatctccaggctgagaaactatgcagagagcaaatgaccttctgagggctctgggtacagaatccttggtatgacaggtgggtctagagccggcagagactcaaggcagcctgacaggacagtgagagtgaaagggaacgctattaataatgacaccaggtcaacacatgcgaacccaactgtcctgaacaaacgggggtttgtggttgcgctacaaaacccaggcttcagtctcttcgagttctgttttgatttggaaggagtgacgccttcccctttggaagcttaggctagggttgcaagctgaggtgttcacagggacagacagagtgtgggaaatggggccaggtgtaaggaaacggagcagaacttggggttcattcatagtctaaagggggcattggcaagtcggcatcagacagtagcaacttgttgccagatcttctgagtttttttcaagagaagccaaaaatcaagatttacacacaaaatctcccagtttgtaaaagttggcaaccatttaaaaattttaaaaacgctctgcaggccaagcacaacatctgtgggcagtgggcagctgcctgtttttgacctccagcccagaccgatcaattgatggctgtcttctgggtctcccaattccggcaacgggaagtttcttaaggaagttgcctgggctgaccgcaagtgaggtggggaagtggaaagggagcttgacttggcttcgattgatcatttgcacaataaatatttattgagcacctgttatgttcaacgtactatctgtgttgtgccatgtttcctagtctacattttgggatgagctgtgtcttcctcatgcaggtggactctttatgccctgcacagggatggttccatgcttctccctgagattatggccaagatggatgcagtgggaggaacttcagtgggggaatgttggggaaagacctgggtccgattctcagaccctgtaaagttcattgtatttcagcttaacccagcagtagtccccaggatgagacagtcttcagctgaggaaagccctggggatttggaagctagagcagagagagtccagccagggacccttgtctggcagtccctgaaggctgtaccaggaccaggcggcaaaaatcacagaacagcctccattcagctccatacatggcagaactttctaacagagctctgtaccttgtggttgttggactagatgatctgtgagctgtttttcattacctggaaagtccgataccttgagtccaccccccatacacccattagactcctgagtcttaaatctgctctggttcatggcttacctcctgcagctgaacttggggttgagtgccccagaaaagccgatacaaactctaagttgaggccaactcagtttgcctggggatgaggtggggtggtatgggggaataaaggcttctctaatgctgtgaggtgtcattcatgttttccattctcctgctctccgaatttaaattagggtcaatcatacaaacctcacaggcttgttcagtcaacaaaggcacagagagcttaagtcacttgctcaaggccacgtagcgaggcagtgaagagctggggcctggaccagctcatctgtcatcccccgctcttttaccccctttcctaaactgttagattttaatttccttttggtatattcattcttttgtgtgtctcctccccacaccccccccaccattgtttctagaactgtcagtgttcaaatgtttaatagctaggttttttttttcccccgtacacttggccagaagtaggaattcatcaccatgtgtgaacatttactgtacctccatggtttgcgtggaattgtactagaaacactcaaccccggggctttgttggcaataaactaggtctttctgcagaacttttgaggacaaatcaccaatgggttggaaagcatttccttcaggaatggcgaaactctatttttcaccttgttaatgctgctcccacctttgtttctcccctagtgtcagtcttaagtgtgttaagtgcttttttctgctcagtgtcctagataagaggtttccaaatgatgtcccctgatctgtaccccacccccaattctcaggcttctggatagacagagaatggacatctggtttgttttggaatgacaggctagactagaggcgtccagaggcctggtaacggcagaggctgctggcatcttaagacattcaaaaaccactgtgctaagtaacagtggagatatattgatctcaacatttcaaggagaaaagagcttgtgaaataggcttgtgatgtttgtgataagggccctgtggggcagctggtgggcaccccatgtagagctggaacacagggacatgatcccatgtgcaggagacagctccagcctctgcatacccgtcggctcactcctgggttggaacatcctcctcattttctctggcatgtccttttgctcaatgaatcattcccggccaggccagacgtccttgctggagagccagctctccgtgcaccagccctgtgattctctaatgccagcttgaaattcggtgacccaccttgggatgctttgcctgtcaaggtttttcaatgatgaatagttgttatgagcatgtcagccagaatggtacttttcaagtcattcagtaatggatctgtatgattattttttgcacaaagaactaaatagctaagatactattgtggcagatatgccataagtaccttttcagtgaaatctttagtgtacatatttgtcacactgtattagaacatattaaggcagctcattaatgttttagtatttagagtttgtcatacagtgagcaaaggcagacacctttgacacagtctattggagcaaaatatgtctaggcttttgcttgcttttttcattttcaaatccatatttccatcagaattttagagttgtttgtttggaggcagagtctcaccctgtagcccaggctggagtacagtggcctgatctcagctcactggaacctccgcctcccaggttcaagtgattctcatgcctcagcctcccaagtagctgggactacaggcatacaccactacgcctggctcatttttgtctttttagtagaaaccattttcaccatgttgaccaggctggtcttgaactcctggcctcaagtgatccacccacctcgacctcccaaagtggtgggattacaggcattagccactgtgcccagcctagggagtttttttgtttttgttttttgagatggagtctcgcactgtcgcctgggctagagtgcatagtgtgatctcggctcctgccgccacacacagatcataatgtgatctgcaacctccgcctcctgggttcacatgattctcctgcctcagcctcctgagtagctgggagtacagcctgctttggcctcccagagtgctgggattactggtatgagccactgtgccctgccttttttttttttctttaatgtttgtattgaggtgtaatatgcaataaaaggcacatatttaatgtgtacaatttgatgagtttgatatttgtatatgcccatgaaaccatcaccagtcaagataatgaacatgtccatcactcctctaaaactttcctcctgcctctttgcaatttcaccatcttgtttgcctgctgcccccatccctaggcatccactgatctgctgttattatacattagtttgcatttcctaaaattttatataaatggaatcatactatatgtatgacttttgtctgattttttttaatgcagcataattattttcagattcatccatctttttgcatgttttagtagtgactttttgtggttgggtgatatttctttttgtggatataaagggagggttgttgatcttcagggattatttattttcattttaaaagtttctcctgaagtagtattttgtttttgaaaatgtgctttgaaagaaatttgtttagaattcatttggccctaaaatccacgtaattaatgatttaatgagttaaatagtgatttaactatataaatatagtttgctaccatgtttgctatgtgccaggcttgatggtgcttgtagggcacagaagaggttcctgtcctagccagtggttgatgtgttcaggagggcctatcagtagtgcactagtgcaccatatcctacatgtgatagagctgccgtgttcttagacacaaagacagctgttatgctgtctttgcaaaaatgttgaggtcttgctttccacaggcttgtggcctgatgcacgtttccagttttgcacaatgtcacagcagatatgccttccacgcccttggtttttcacagccaggcatggggctggaatctcagagctgcggttgctgtggttctctgattcctgctcagaggattgcgtgatgggggctggagtgcaggcaggaagttagccttgtggattccctcatcctcacaaagccaggcgcacagggaggggttgggggtagggggttgccatgggaatttcttccccagccagagagccagggtggagtgtgttgctggggagttggaaatgtaccctcttttccatatccattgttcagtcacgttctcctgaaagaagtcttcttactgtgtgtaagaaaaatcagtaagcctctgataaatagtcaaagactgtcagaaaagggaccttggaaatatctggtccagcctgcccattttataggtgaggaagctgaggctcagcaagcaggagtgactcaggaataagcactcatagcacagctgggacttgggaaacccaggcactgctttagaccttcattttcacaatccacgaaggggggagtttgaagaaggcttggcaaaatttgatagacctgggaaagagattgttaatctctcattctgtgctcaaggatgctgtgccatttaaaaaacaaaaacaaaaaacagaaaagaaagacaaaataattctcccagatgatgtttctagaatgttctgacatcttacagtgtcctgaccttgcacaagcttgttccagtaataacgttaaaattcaggagtggatgttcggcaacatcattgggcaggattttctggttcgtgaatgaaaggttatgggtgacactgtatgtcagtgtggcgcttaccggtttatgaagggcctacatgtgcaatctctacaggaaccacttcccacatggcccctttataccaatgaggaaatgggcccccggagatgaggcacttgacctgaggtggcccaggtggtaaggagaggagccagctttccaatgcaagtcccaatttccagtctcctgttgtttccaccgtgtctccctgcaaggcggctggggcacgcagaacaacagcttgacacagtgggaagaagctgggctttaatgtttagagttcagagttcagctctgctcccctgcctgctgggtgaccttgtggaatactcctaacctctctgagcttcattgtcatcttttggaagatgaggccctgtcctacaggattaaagtatttaaatatagagtgcttaccataaaacttgcttctaggaagcaactggtcagtgttaactccttaatgaggctgaagtagacatggtaaaactagttgtggaaagagatcctataaagcaaaactgaggacacatttacatataccaaggggtgcccagccctgttcttcctgcacatagaatcttaaatgtttcctagattgagccattaatcttcgattttttgcaaaggaagttaagacagagataccaagtgccttgcacatagtaggcctgtagtaaacacagactggatgatcaactgctctttggaggagcagagagtatgcctacacatcatttgaataaaatgtgacagcctgccagagaccagactttgaaggttatagacccagggcacgtggccagagcagctgtcagtggaggtgcggcctagagcgggtagtgtggaggctggagggggctgttccatggcaccagggttgagtgggagtcagtgcagacttaggagagggaatgtgtgttcggggatggggagcggggagggacttctctcagacacttatatggaatctcaggtcatacagagacattgtctctgtgttttatattttcctttgaggacatctccatttaagtagctgatgcctgagcggggagagaagaatgagccttttccttctgttagagcctgtagctgcctcttcagggtcagactttaaggtgtatggggacaaagttgggtcagtgtttgtagaaaaaaggctctttctccatttctccctcctgcttaatccaaggagcagagaacaccagggaaactcggaagtagcggggttgatttgggagctagatggggcctgacatatgaagctgctacctggttacagccaggcagagttgaaagggtgtcctttggcggggtgagaagagagcagcctccaaagattcccctgcaccccgccaggccctgccaggggcccctcccacagttctttgctccttccacggagcctgtttgagaattcagtgattcacttcccgtcgtcaactcttgtttaacgttcccctccattgttaccaaacaatccaggccccagtgatgtgtggtgttctgagagtagaggagggaagagagagagagagccagaactgtttacagagcccgggagatgggcccaggcttgacagccgggccgacttgaaagacaggctgcagtggactgtggccccaacagctgggtgtgtgcagggtgggaaatgccaggcacagccgctcctccacagaaaccactctgttctttctgctcttgatggaagctcctgccctttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtcaaagttctgaagttttctctctcatcctttctgtttgttgctccatgtacagtagggaagaggaatttttgttggtagtccacatttttgattacttatttgctctgctgctatattatgattcaggttttctccaaggccctaggtgcctaaaagcattgaaggaatgagaagtgtagacacagaacacctttaagccacttccccctgcaaattagtgtatttcacaggtatttggaatgctagaaggtactagaaggtgagaagacactagagatccgttgaacccatcattttttaaatgagataatccatacctaaagactcctccatgagtcggtagcacagccagagggagggccacacacacccctgtcatctaatgagcagccagggctccagtccatccccagtgtgggccatatatctgtgtgctttctcctctattaaatccaacacttgataaaaatctccagttaacaaatatttgttgagcaagtttattgcaaatcgctgtatttaatgtctgcctacaaccttagccacagatgactctctctccctggtatggcaagtgggcagagcttcctcattcaaaaacattttagcttcctgcacttccccgctggttgctttcgcctaactggcacctgtggctgtcattcccctgctgtttttaattgcacctctcaagaccagctgattgcttaaagaacatttctggtattgggcccatggcagtaatgtgcgtctgtggatccctttgctatgaggcttgacttcttgatcgggttcacaaggctggtgggcagcctgagatctttgcttatttcctacgtcttctgaaaggtactatgaagcttaccagttgctgatgcacgctatcagctaataattccattaccattactattttctgagcaaatgtgacctgcaagcccctcgctccatccaggatgcaggcaaagttaagctaggtttcctttccctcaaggagctcctggcacagttgggaagggaagtcagaaacacacagaagtcacttcatcataccaggcctttggtgctaaatgatgatgaatttgaagagtgtgggacagtggggatggtggactgtaagagttcgaggaggggaggatggagagaggtcattcttagcagagagccacagagtgggttactgtttgagctggaagataattggacctccaagggctctgtccccacctgcacctcagcgcactatgctggtggccaagagtgcaggagcctcacattcagatactgtggctgcaacattttacctccactacttgggcctgttcagcattttgagtttctatgcctgtaaattaggcctgtctaggaagtgggggtgaggtggtgggtgggcaggtgctctgaatctcagctgggactgggtgggctgataccggggagagttgtaagtatctaggacccagcgggaggacgcctcacctggaaccctttgcttgttcctgattgtagctgttttagggatgcagctttcagacaagggccacttagttgatgaggccggcttaatcgaggagggctgttgccaccctgacattgttaagtgtgggcctggcttctctgaagtcctcctttcttgcttgtgtggaattcctgttttcctgcccataggggttctttgctgtcttaggtgaattgccccaatgaaccagaacctttttttttttaggtacaataggaggtctgtacccttagacagaaaggaatgctaattggccacttaactgtcctcagggtacagatgccagaatatacagggcacccattctttgttaccatttgggatggaaactgcttatataagcttgtaaagctttggttcagaaagcaagagaatgtgtatggaacgttagcaattgctgtcatgcaaatgctgcattttttgcatgtaaaggtacctctttacctccatggtccttaaactaactttttcaagaaacatggtcatttcccacccttcctttacttccagctccccattcatacccaacagtggctaactgaaaggtttgcaaatcctgaaggctttggggcttcttttaaaaagaagagactgagttgtaaatgtcataagactgagatggttgtaaatgtcccaaccatactgtgtgacatttgctaggaattgttgtaaaatcactggagtgagcgcttgtcctgaggcactgcctctccgcgtgaatgtcactgagtcgcccggttgacccgttgcatgttatgcagcacttgtgacattgttttatctctctagccggtgactcataattaaggaagtcaaaactgtgcaattaacacaaaacctcctcatttgccctcttcacctctccccaacccccgcccccagtcaggaatgcccgcctgacattttctctaagtctttggaaactttaagatttgttttgatagaacaaggccgccagttatcatcgcctggttccacttgttttaccccaaaagtctgtgagaatcttttccaggaaaaaaaagaaagaaagaaagaaagtaaatcccacccccaagcgtgcagtctgcccacaggaagtgattcatggtgctccgattcgggcagacctgactgcaggaggcgggaggctgggaaccaggtctgggaaaagagggcagagagaggatacccagacctaatggcttctgctctgtggaagaaagtgaaaaacagaatgactaagagtcctgtaataagaattgtttgttttgtgaagttgaactaatagtgaggtttgccggcagataagacttgagaaattgcagttgtcaggggaggggacttttccatgtcctgctttttttttttttttttttttattaagagagcaaagctatttctcagtcttttttttttttttttttttttttttgagatggagtctctctctgtcgcccaggctagagtgcagtggcacaatctcggctcactgcaacctccacctcccaggttcaagtgattctcttgcctcagcctccccagtagctgggattacaggtgcccaccaccatgcctggctaatttttttgtatttttagtagagacggggtttcaccatgttggccaggttggtcttggaactcctgacctcaggtgatctgcccaccttggctacccagagtgctgggattacagacgtgagccaccacgccaggccttatatctcagtcttaagacattcatatattagtggaaggcccagatttgtgtttcagttctaccttgccacctctaagcctgttttcttttctttggagaagagggtctaagatgagaccattatctcacagtctccaatagctctttctccccattttcccttttatttatttatttatttatttattttgagacggagtctctctctgttgcccaggctggagtgcagtggcacaatctcggctcactgcaacctccacctcctgggttcaagcgattctcctgcctcagcctcctgagtagctgggactacaggcttgcgccaccatgcccggctaatttttgtatttttagtagagacagggtttcactatgttggccaggctggtctcgaactcctgaccttgtaatccacccacctcagcctcgcaaagtgctgggattacaagcatgagccattgcacccaggctattttccctttttcctttccctctaaagttagagtttttgaaaaatatttgatttttttaaattgacaaataattgtccatattcatgggatacatagtgatgttttgatacatattaatgtcattatggtgatcacatcaggttaattagcatctccatcctgtcaagcatttatcatttctttgggttggaagcattcaatatcctccttctatttgaaactatgtaatatatgaatgttactatgtatgttactatataagcattcaatattctcctatttgaaactatgtaatatatgattatacatagtaacaatcatatattacataataattgtaaactatgtaataataatattgtaatatatgattgctagatatttgaagctatataatatattattgttaagtataatcatcttacagtggtttaggacactagaactgatttttcctctttagctgtaattttgagacctttaacaaatttctccccatccctctgttccctttacacttttcagcctctagtatcttctattctgtttttacaaagttagagttttggggctgataaatgtttttacctaaatactcatttttgtttccaccaaatggaacatcatgttgtcgtagaatgaaggaatcctttctgtcctatgggttattttcttctccctcaaactgacaatgcaaattaatttgattccccaaagtagtttggaaacagagaagactctaagtgttggctacatgaacaggcctgctgccgagcgagaggcccagatcacccagaatgagaagatgggtctaaacacacctggctttgtgacttactccatttcaagcttcctgtattgttggaggtcagcttttgggggtgagggattttaatgaaagctgaggtgaagtccactgttgccttaagcccatcagaacgttgccaagggctgtgagtatgctgaatgggtccatgagtgatctcttaaaaaaacataaaccattgtcaggcctaattttcagcagagtgaaatggccacccagaagattctgtgaagcctggcaacttttccctttcttccagtagtcacagaccaacccagatctttgtagcatcttttatttgtgacttgaaagttctatgatcctgctgacactcaagaaaaagcaatccccatcaacttggtgcttggagaaaaaagtttgtgaagaccaaagctattaaatagaaaagccctaaacactctcctcctcctcctccttcaatatttaaccgtcttctttgcatgggggaagggaggggctctcaccacagccaaaagagaatctctgctgatttaaacccagtgtgctttgtagtcatagagaactgagtttggagtgtaacatctaggttcaagcccaggcactgttccttgctgggtgactttgggcaagtcactcagcatcaaaaatttttcatctgtaaaatgggagtgatgagatactcagcctgcaggatccctttatccagtgagttactgagtgagaagtgctgggtaaacgcttgctctgaggtgtaaattgcttctgtttggccaggtgcagtggctcacgcctgtaatccaagcactttgggaggctggggcaggtggatcacctgaggtcaggcgtttgagaccagcctggccaatattgtgaaaccccgtctctactaaacatgcaaaaattagccaggcgtggtggtgcatgcctgtaatcccagctacgcagaaggctgaggcaggagaatcacctgaactggaggttgcagtgagccaagatcactccgctgtactccagcctgggcaacaagagcaaaactccgtcttggggggcgggcgggggggattccttctgttttcccgcatcttgctcatctcagagcatttccttagcccagggggatctcaaggggagggaagagagcagatttgccccccaggggacatttggcaatgtttagaggtattttttttcagttgtcacagctgcaggtgggtcacagctaccggcatccagtgtgagggagccagacatgctgttaagcattctatatctgtctctacacaggacagccccctagccccaacaaagattagcccaaaacatcagtagtgccaacgttgagaaactctgggcctcgccaaatccatagcctgatgttgaaaagttcttggtgtctgcgtgctttacagataattatcatcaggctgaactttctccagtaaccaaccttcttcttttccagaaagtacaaattctgtgcccacccatggcccttgggaggtgggatagcccaaggtctaggcgatctttgtgtgtttccagtggagtccagccctcccaaggataaggcaaggtgtttcttggcttccccctccaaggatctgcccaggagccttctgcaacctctgtggctcctgcccaggttgccccatctgcctggggcacttgtcatggacctgagccggctgctctggagaactagcagagggaaagagaggactaaatataatgggaagaagtgaagaagaggccagctgctggtctggaggatggcatagggggctgcagcctggcattttatttggtttccccctagactggcagcattcatgcccaaagcactagatattgtccatttataagttcagatgaaaattgagttgttcttggtggaaatgttttagtgactggtatcaagggttatgaaatcctgttttcagctcttcatgtccaatctaaactggaacattcaaaaacatgcttagcacacttacagaacttgttgggaacactcaggaaactcagctacaggcagagcacatggtcactgtggtagaacttgcagtgagacctcaattatctagaacctggccaaccacatacttgacctcactagatgtctttgtggcaccaaatgaaaagaacaggctaatgttggaaatggagtttaaataaacaacaacagttttaaaaatctttgaaaatgccagggtgtagtatattcagtgtacatcctgagttctgtttgtaactctttgattccaagcttcagaaaattacaattataggctaattttttatactactactaatcgtaatataatcaaattatatgtctttcaaccagagtcaacaactgctcagtccctttttttaaaaaaaaattaaaaacacttgtcatcttaaagaccttcagacaacttaagattcaatacaacaaagaaaaaattgtcttgctgttcttaacctaccaaagcaggcaagtagacgcacatgtgttttacacacgtcattggaagaaggctggcaataccagcttggttgcaaggaaagaggcaattgtgaggactccttctcacactgcagtaatttgctgagtgaccttgaacaaggatcttaatgcatcagagtctgtttcctcaaccccaaaatgaagggattggaccagatgccctcaaggttcctcaagggtcagctgtcacagttctccaaagtgagttttcaggcagacatagagttagccagtgtcgcctcaccaggacattttgttttctgaacattgggcctctgtggtttgtcacatacacccaggggactgggctcataactccctgaagaacctctgcccagaacaaaggatgctttggatttgactgtgtgtaccaaagggaataagtgaacccccaaatcaaacatccctcttggcagatggtgttttcagggctttcttatttgttcctttattaagcagttgtcctggggcggtccattgcatggaagaaataaaggcatgttctaatacttgcgtattaaagagcagcagaaagagagctctcagggtgagcttatagttcaaaggccaaatggaaccgatgcaaggagactttcaagccacaagcagaatttttttctgccttcccagaaggtccgatggaatgagcacttcacccaaacttgaagtcactcaagtcttgcttttattttgaaccagaaaaaaagaaaaggaaaacccacgtagaatgcaaaatttaagtaaagatttttgggccagtcgcggtggctcacgcctgtaatcccagcactttgggaggctgagttgggttgatcacaggtcaggagttcaagaccagcctggccaacacggtgaaaccccatctctactaaaaatacaaaaatttagccgggtgtggtggtgcgcacctataatcccagctactcaggaggctgaggcaggagaatcgcttgaacccgggggcagaggttgcagtgagccaagatcgtgccattgcactccagcttgggtgacaagagcgaaactccatctcaaaaaaaaaaaaaaatgtaattgcaggtgagtgaacacggggatagtagggtagcttgattgctgttcaaagggaaagagatggggaggatatgaaactctgagggcagatgggcatatatctgctgcagcatgtatgttctgggaacatgtgtgtatgtaccagtgtgggttcagggcattcattggcaaccccaagatctaaaacagctcctttttgtccattaaacatagcagatgggaaatgtaaagatacagaataaatggaggtgaaatgtatgccgtaggtttggtttttgagttattaatgtgctacttggggctacttcaaaaaatgaatattagaggagtatttgggggtaagttcacattttatgcaaattgactctaaggcctctaggtaggttgtccttctgaaatggttaagtcttatccagcttcaagatctgggcataggggtatgccccatttagaattagggaaaagaatctgagtcatgcagcctagcttcactttatattaactctgggaaaagttaggaaagttgggtaacctctcaggtgctctgtttctcaatccatgtatggagataatgatacctgcaagttaattgggaaaactggtggtggagtcagtgcatcagtcagctagtgttgcgtaacaaagcactctaaaaacccagcagcttaaatccattgtttatgctcactcatgcttctgtggtggcttacctgggcttggttccttgctacagatttggtttaggtctgctccacatgttttcatttctgggcccagcctatggggcagtagctgcctgggggtgggcgggtgggagagggaagtcccatgatgatggcagaggtacgagaggacaggcagagacatacaatggcagtctgtcccttctgctcacattccactggccaatgcaagtcaatagtctaccccaaagtcacgggacaagaaaatacatgccactcatggtaggaggagtggcagagccacagagcaaaaagtgtggctgcagagaggggtgactaattcactctgtcacagtcatcaagtggccaacacagtacctggcacatagcagcagtcacttccacctctgttgttactattactactcaatgggcaagttgaaaaagaaagtttgtctgaaagtgactagaaagttcggtattaagagcatgtgtgtgtattcaataaaataggtttcaactgaagtgtgataatgttaacaaatttactctttgttcacttctatggcccagttaactggcacagttcttgggatatggtaggtattcaataactatgctgtgattgatgaatggtcacttttaataatggtgatgcagcatgggatgacagaaaaagcgctgttcatccaacctgcccctatctcccatgtatcagccctggtctgggtttgaatcctggctctgccatttacaagttatatgaccttgggcaagcctcctgagttctctgagctgggcgagggtcctgggggtgttgccgtttctgcgtgctcacatagcagtcgtgtgcctggcacgtagttcatgctgaatggatcttggcatgtttctggaacttatgtgctgtgctcctcaccttctccccagcctctgtgttgtcccacagatggctgtgagtggctgatcggtggaagtgcagacgtgagtagcacttggcatgaggtgggccccagccccaccctctctccttggggtacactctggcaggcttcaccttcaccatcggctttgggctctgccatggccacatccttggctgtggctctcaccaccattttgggacactttacgggtcccgcttgaagccaatgggaggaaacctaatttcctgccacaggaaattgttctgctagggaagaatatatttaaggattaaaaccttctgtcagaggaacttgagggagttgctagagaaagacctttgggggtctctcatcaggaagccagtgggtgtgggagagatctcagtcataaatggggaggaggcccaacggcaggttcctgagactgtactcctaatgctagcagctggtcttgggctgggaggaagggctgggccagggagaagagtgggtcataaatagaccattttctgcaaccaagtatatttatggtaacatcagctcagaattaagacttatttattggatttacttaatgggcccagtgccctataaggcctgggagagtgtgttctggacacatcagctatattaaatccagcagctgaaactcccaattcactcttattactttggtaaggattgctacatattttgagtggggcagagggagaaagaaagaacaatgccagggctctgggcagcccagactccgaaccaagaggtgttgttgctgatgcgtaagaagtgaatgagatgtcttccctgtcgtgagtttgggaattgcatggcacagagaagcaggggcatggtccagatgacttttagaaaatactgccaagccagactggcggtcgtgtgctcacaagctggagagtgagaggtgcctgtctccttgctatcagaacccagcctgacagccaggagtcctggccacttggcatggccctgatacagactgctgtgtgatcctgcgacatgcactttgcctctccaaggtatgggtgtatggtgaggtgggaccattgtaagatgtgccttattatccacacggcattgtggtgagaatgatctgagataaggaacacagaagccttgtgaacattcaaagcaccagacagacatgaggactcactgtgaccctcctgactgtgcacccagatggccaaggcagggaaagagatgtgttgttgaggacctaccgtgttccttactttgccggccactatcatagtaagcaggcagtaatagttacatgacaatactgacaatagattcctgccactttctggaatatctttctgggtagtgtctgttcaaatcatatatctctttttttaaaaaaattggattgttaatactgagtgttcttactaatatttcattaaaaaaatttttttaatccctctgggggaaaagaatttttttttttttgagacagattctcactctgtcacccaggctggagtgctctggtgcaatcacagctcactgcagcctcaacctgctgggttcaagcaatcctcccatctcagcctcccgagttgctgggactataggcatgggtcaccacgcccagctaatttttatattttttgtagagatggggtttcaccatgttggccaggctggtcttgaattcctgggatcaagtgatccacctgccttggcttctcaaaatgctgggattacaagtgtgagccaccacgtccagtcagtgttttagatgaaaaatattaagaccaagacactaagtgatttttttcaactttgtacagttagcaagtactgaaccattatttaaactgaggcttattaagtccattgcctttttttggaatggtggtataatttataaataataagccttgcatatttaaagtgtgcagtatgacaaatgatgatatatgtatatacctatgaaaccaccatagcagtaagagaatatacataacctttacccccaaaaaagtttccaagtgcaccttggtaattgctccctccaatccctactccctccctgtaactccctctgtccccaggcaatgactgatccctgctttctgtcactagattaagattagtgtgccttttactttagtttaaattaccttataattttacacgaacagaatcatgcctggcttctttcacgcagcatcattaatttagattcattcatagcgttgcatgtatcagtagttgatccttttttgttactgagttgtatttctttgtatggatatgttatggctcattcatctgttaatacatgtggagtagttttcaatttggggctattacattcatgcacaagtctttggacataggcttttatttctcttgggtaaatactttgaagtggaatggtggatcatatggtaggcttatggttttttagctttttaagaaacttccaaatgtttgagggatgaatatcccaattacccagatttgatcattacacattgtatgcttgtatcaaaatatcgcaagtaccctataaatatgtatagctactgtgtatcccccaaaataaaatattttagaaaggaacttccaagctgttttccaaaatagttgtaccattttacatttgcaccagcagtggaagggagttccagttgttccacatccttgccaatacatggcatgatcaggctttttaattgtagccattctaataagtatgtagtcctatctcattgtagttttaatttgtgcttctctaatgatcaacattgtcaagcatcttttcatatgcttgttgtcttcatatctttctgggtagtgtctgttcaaatcatgtatctcttttttaaaagattgaattgttggctgggcgcagtggctcacgcctgtaatcccagtactttgggaggccgaggcaggcggatcacgaggtcaggagttcgagaccatcctggttaacacatgaaaccccgtctctactaaaaatacgaaaaattagccgggcgcggtgccaggcgcctgtagtcccagttgctcgggaggctgaggcaggagaatggcgtgaccccaggaggtggagcttgcagtaagccaaggttgtgccactgcactccagcctgggcgacagagcgagactccatctcaaaaaaaaaaaaaaaaaaaaaaaaaaaaaaaaaaaaaaaaaagaagattgaattgttaatattgagttttcagagttctagaaacaggtctattatcaaatatacgctttgcaaatattttctcttagttagtgcttgcctttttattcctttaacagtgtctttcaaagaccagaggcttaaatcttgatgcggtctgattttttttttattattattaagtgctttttggtgtggtatctgagaaatcattgtctatcccaaaaagtcacaaagattttctcctgttttcttctagacattttagagtttaagtttcacttcagtttgtttttgtatagggttacaatgtgtagtttgaagattatcttttttacatatccagttgttacatcaccatttgttgaagactgtccttgctccactaaattgtctttggacctttgttgaagccagtcgtccatatatatgtaactatttctggactctgttaggttccattgatccgtttgtcagtccttgtgccattaccatactgccttgattattgtagctcccttgtttttaaaagtttaattaatatccaagtgattcatgtatgattaatattactactaaggcaagagggccacccacttctatcacctagatggagcttacctccacagccccattctcccccgctgctggcatgagcttttctccaaggccttctcttgcagaggaggctatgatgtccagctggcccttttttgggagttttgtcaaacaccgaagagcaaatacggccacttccctaatctgtgggcacccagtggctttgcaggagaaggagaacagctgaataattctctattcccactcaccacttcccactctcccttttactcctgttcaacctccagctcaccctacttatccagggctgggtttggggagtatctgctgtgatagagaataataacgctaatttgtgggtgtttatgaagcactttcaaatggaaaccaagcttcaggaggtcggggggcagaataccccattttatagatgagaaaactgagtgtcctaggaagctcatgagctgcccagtgtctcccagctaggagagtagaaccctcctttaccccaggtcttatggctccacatccgccagtcctccttttatacctcagggacgagtcccaggctgtcttctcgatctgcctggtaattactgtttttcagctgtagggcttccttgttctggggccccaagggaggaaggtaattacatccttcaagatgcccttagtcagcagctccaggtcagttcctgtgaccaagcccagctatgacctttgtctgtcctttccccttcccaggccagtggcttggagagtgtgattggatccctctgtttctctctttggttggtgctgttggtggcatctggccagcccttccttcacagagtgcccatgaattctctgtattcaggcaaatgggtgccctcggtcataagaaggcacagagggaaagcttgcaaatgtctcactgccagccctgccagctattagaaaaattatggcactgactggcagggtcctaggatgggcctccttgaagaaaaagcagtcctgcctcttaatagggtacctgtgactcatgagcatccatctcatctgctccccacttctatccctgctacccgcaatctgttggtcacacgtagccagagttccacagggcctgtctctttcacacgtatgcacagcccacttacacatctcagaggctacatactgcttttagaaaacaggagaagcctttatcatggcctttggggccctgcagagtacccctgcctgcctccccggcctcgtctcaagccagctctctctcatgatcccctctccagtccttctggccttcattctgttcttccgacctcaccatgttttccactttccacagggcctttgtgtgtgcctttccctctgcttgtactgcccttctcccgcacccctttgcctggttagttcttacttaccctttaggccttcaggtcaaccatcacctcctctgagatgccctgtccagtccttcagcaaagtggggtgccatggtcatacactcttggggttccttgttattttcgttcaggacactttcattgtgtgtaattgtaggtttctgtgatgatgatgatgatgatgatgatgatgatgatgatgatgatttgaaacggagtcttgctctgtcgcccaggctggagtgcagtggcacaatcttggctcactgcaacctccccctcccaggttcaagtgattctcctgcctcagcctcctgagtagctgggattacaggcgcccgccaccatgcctggctgatttttgtacttttagtagagacagggtttcaccatgttggccaggctggttttgaactcctggcctcaagcgatccacccgcctcggcctcccaaagtggttttggtgattatttgattaatgccggtcttgcccagtggaatggagggtccctgcagacagggaccactttgctggccttttctcatagtgaagtctctttccttaccactgtatccttagtgtcacacataataggtgctcattaaatatgtgttaaataagggactccattttagtggcacctcctcacctgtctaataccagacactatctgaagttttacgtccctccagaagccttctgcctcccagccttgcctgtagctgacaatgcttttgccgccccaagctccccagtcctttcctgtaagccacccagactctcatcatccagatcacctggggatttcacaaagggaaagattctgatttagtaggttggggtaggcgctgagaatgtacatttttaacaaacttccctgaacctctgctgctggtcagggaccacactttggcctggcttgagaggtaagggcaccgggtcatagctgcttggccaaatcaccatagaagacatggttcacacagggtcatggcactggccaattgtaagtaggcacagtagtgtgcccctgcagtcccagctacttgggaagctgagctgggaggatcacttgagcctgggaggcggaggttgcagtgagccgagatcatgccactgcactccagcctgagtgacagagcaacaccctgtatcaaaagtaaaaaaaaaaaaaaaaaaaaaaaaatccctttaatttccgtctttcactccctgctcaccacaaataactaaaaaagaaaggaggggccaggcacggtggttcacgcctgaaatcccagcactttgggaggctgaggcgggcagatcacgaggttaggagatcgagaccatcctggctcacacagtgaaaccacgtctctactaaaaatacaaaaacaaaattagctgggcgtagtggcgggtgcctgtggtcccagctactcaggaggctgaggcgggagaatggcatgaacccgggaggcagagcttgcagtgagccgagatggcgccactacactccagcctgggcaacagagcgagactccgtctcagaaaaaaaaaaaaaaaaaaaaaaaaaaaaagaggaggaaaggcaagttttctttttttcccctgactttctaatgtgcaagggaagacctgagtgaatgaggggagacagcctttgtactttgtcactcttctttggatcactgtagtcctcatatctgtgcctaaagaactctcattgtcttccccagccctgtcccctctccacacctctgggctgagtaggaagccgatgagtggctcctggaccttttccaagcacaactgaagtgactgaagtgcgggcccttcccatggaatgccactccctgaagagcagtacaaagttggggaacccaccggggactggtgggtgaggcccgctctgccagctgggagtcctcacggggcctttgttgtcttctcctgagatccctcccagcactctcagctagcagtgctctgatctcctggacctctggatctgggagaaatgaggggagagagagctttccaagtgtctgaaagtaggaggccggactctgcagaaagcaagcacaatccacatttccctctctttctgcccctccccgtcctggcaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccaggtatgctgcctggcctgcctgtggggacagcaggtgccaggggtcatcacctctccccggctccccatccccccgagggtctgcggtgcacttgggggtgcggggactttggtgctggtctggcatcgacactgagccacctctgctctgtctcccccggacagttctacctcctgtgttggtgccacgccacacagagatcccggccgagttccccccactggacgactacagccattccatccccgaaaacactaacttccccgcaggcatcgagccccagagcaatattccaggtaggcacgtgggcggcacaggctggcctgggaggcaggggcagcggtcagccccgacatcagtcctgtggccccaatctctgccccctggccgtcccccgctcaccccctctttgcgcacagctctggcctgagggcccctgactcagaaccgcatccctgttgggagaggacccatgacctcagctcccccctcactagtgatgcttttcttggcatagaggagcagcgtgacccttccgcccggccttggtgcagtcatttattttggaagcggaaatagcaacactgtttctctcaccgcccttgaggcccggactggtgttcagtcccaatagactgggggtctgcagaggcggggagtgagctgagggccaggcagcaagtgcggagagctggctctgtaaattcgcctgggcatcaggcctcggtgaggggctccaacctgggtgggaattgaagtgactttgagttttcactctgcagggagaaatgggctttgccgtcaaagactgcaaatgtttttagaagcccctcatttacatgcaaataacgtgtgaatcaccagcactttcagactccaggaaagctgtgcttggcagcacttgggctagtcacttttgcttgctggggcagtaatcctgctgcgttcctcttagagcattctaatttggacgtgacgttcatcctgggttagtttactgggctgagattggctacaggcctgtgtgcttgggtcagagtgttaaggaggagacccactgtccaaccttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1992 - DNA, 29041 bp, Homo sapiens
cttctcagatcctttgcgggtagccctggcgtcccgcgggtaagtcaactactccctgttcaaagagcaaatcttggagggcttcagtcagggtctgggggaggtttcagagaaatagatcacactgtctttgccgtcattgaacttgcaacctaactgctgagtgaggacacgtcccttagagacaacaaataataacacctggtctgcacagaagaagatagtagggaccaaagggtgggtctgagcctgcagatcttcagaggacagaaaggggtgaggcggaggcaagtctggacgcctccctggagggggtggggcttaaccctcaccttgaaggaccaggataagttagcctggcagaggctctaggagtacacatttcagacttgggagttgatccggtcctgcgtgagcaaaggcagttatgatccaagcgggagtcagaggtggacaggggcgaggacaacagaaccaagagctggaacctctactccaagacctggagctcctacagccacggatgctagcatcatggtgtgcatgtgtgatgtctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggtcagtcatgcagggtcatgctcttattcttaactgattagcagctggtgggttcatcccttccatcccttcctcttcgccctctccctccctcccttctatctctctctccagtatttgtagagcaaccgcgatgtgcaaggggcagggcatagaagagggtccgagctgctcacagatgatgggggagattgacaggacagtcagtagtcactgggccatctcgtgtatgccctgatggaagatgccgcatggcaccaggcacacagcagggccacttcacccggtctggggaggagcagcaccttgcagtccaggtttttccccaggttgagtcttggtgatgtgtaagtgttagccaagctgttagagtgggcaaggggtgtgccaggcagagtcatgggggttgggcaggacagcctggtgcattctggggacagtaagagctcagtgtgtctggagtccagagagtgtctagcccagggagctcagcgtggctggaggatacactctctccagtggggagaagatgggagggcctgccacacaggggtcccagtgtggtggaccttcaagctagccagaccacttggcatttagtcagggctgatgggaaccgctgcaggctgtaagcagggcctgtgccttagtgagatgtcaccagcagcagggtagagagtggccttgatcacctcaagcagtcacatgggaggcaaggagaggctgaatggaactaatgcctcttctgatgaccagtggagacccctgaagccagtatttttgtgtgacaaccacatgtgatgtgtgtgctcctgccgtgaggggcagggcttatttctctcctgctacatctccagatgtttcccatatcatttgttataggaccaaattggctccagaccagcagcttcttgaattgaaccccagctgccacatagaatgtgtactgagttgtgtgtggttgggagaggaggagaaggggagagggaaccacgcagatgttccattccgatggtggtgggcatgcctcgtacacacagagccgctagacacagcagagccacctgccctcgcacacagcccagaagagattgtgcaattccttcccccacctttcccagacagagtctccctctgttgcccaggctggcgtgtagtagcgcgatctcagcttactgcaacctctgcctcctgggttcaagctattatcctgcctcagcctcccaagtagctgggattacaggcaatgcagcaccacgcccggctcatttgtgtatttttagtagagacagggtttcgccatgttggctaggctggtctcaaactcctgacctcaggtgatctgcccgcttcgacctcccaaagtgctgggattacaccgcacctggctgaggttgtgcaattcctgagagaccgaaagagactcgcatgtacattgtagttgctgaaatccagcctggacatcgtggcacttttgggttgagcacacccggtgaaacacacccacccggcggagtgactagtagcgcgaaccagctggaatgcatcgaagaccttcctgtatccgatgccaagtgaccgctgcaagcttgcagctattcagtgcaggcgtgggaagcaggccagcggagcagcatgtctccagctgctgtgtttcttcccactctgcgctccctcttccctttctgctgctctccatatttgcacaatgattattgttacaaacaaacatggaccagaggggctggagattggaaagagcagcccagatttcaccctgtcagctcttgtttcttctccctcctcttcctccttgtgcctccctttactctgtcccctctcccttcttcctttcttctcattaagtgtgcctgcagggtcctgttgtgaacatgagtgatttatctacagtagagacagaccagacttgcggaccccagccagtgtgtgggtgggggctctcctgttttagtctctgttcttcagagttgcctgcttggatagtccagttgctcacgggcttggcttccctgccccccagggtgtggtagtgtctcgggccagagggtcacgttgttccccatgtcccttcacctacatatgcgcccttttagacttgtgagaaggccccttggacttcctaggtctttgtggttcaggccagcacaaaacaggggacaagcatttatccagtgcctaccatgtagcggtcatggtgtaagcatttttatatgcacagtcttacttaatttttacatgtcacacagtagatgatattatcctcattttatacctgaggaaaaaattaaggctcatagaagttaaacggcttagccaaactcacgtagctgattcgtggggttgtctagaccctgtgactgattctgtaacttagttctctcggtgaatattccacatccccctttgcatttggggttacaggggagaaggagaaatccgtggttcttcccttgccctcaaggaggttacagctgagttggggcaaaagaagagattcccacaaacagcgcaaggcagcattcacttgaggccagatgctggacccagtctcaggactgatagatttcatggggtggaattagaccccatagggtggttaacaaatagtctccttttttatttttattttttgaaacagtctcactgctgcccaggctggtgtgcagtggtgcaaacacagctcgctgcagcctccatctcctaggctcaagtaattgtccagcctcagccttcaccacttacggcttatttttttttttttttttttctgtagagacagggtctccctatatcacccaggctggtctcaaactcctgggctcaagtgatcccccagtctcagcctctcaaagtgctgggattacagatgtgagccattgcacccggcctccgcagccttcttgatagaggaacagaggagcggggacgagcaggatgctgctctggaaaagtgtccactgttttatttttgaaggctgataccatgtgagttctttttttctggaggtgagaggtgtagagaacataatagagtaagaattgggtagattgagactttttcccacgtgcatcatcatcttttgcataaagtgtttgtctggttgctgagttgcagggtttctgaggcaggtttgtgagtttcctgaaattgatctttccagcacctgagctgctgcagcctctgaccaaggtcggtggctggtgatgctggggaggcctcaagccctgcctgtgtgggagggctggcctcctgcttcctgggtctttgcagcttgggagaagggcttccctgctcctctcattttcctgagggcatagttaatagggcaggtggtgtaagctaaagaaaaaatgtgtcacttattctagttgagaatttagcagccctgagctgggagtcttggttaggatcataaaactatctgagacctctgagatcataatcataagagacctctgagatcatccactcaatgcattcattccagacaagaaattggggcccagggagggaaagtagaggcaagggtatgggctaggccttctcctgggacccctcagtccagggttttctttctgctgtgttgggctacccctccttgatatgtaagtgtttagtaacttggctctccaggccaagaatcttttgtgaagtctcacaacttgtctcacctcgcaggttctccaaacctatccccgaatccgatgtccccagcacataataacttgggtgagtatctccttgtgcacacaactggaaccccctctagctgcagccctggcgagtcgccagtgtggggagggggccctgaaggtaaggctctcccccgacccctaccatcagcccagctcagcccatcaggtttctggttacggtgatgttgaggtcaccacggaatggggaaacttgagaacagtggtggcaggaaagacaaccatatgccaggtttgtatttcccctggggggcgggtagacgtgagtgaatgaaaattcccccaaactttatgcccaggagaacgagggtctgtggtcagctaagcatacgtgtgcagtttggtgcaaagccacggacagccatgcagactccagccccctgacatttatagacctgtttcagatatacttatttgagtgtttcatcttataattgtgtaatttttcttaaaatagcaacatatacggaatttgaaaataaagtcaaagtgcccataatcccaccaccctaacataactgtctatgtgtgattacagtcctgatgtttgtgcatcaggcatatatatctctgtgccttgccactgagatcatagtgcatatctggtgttttcattctcttttctccttatgttattttgtaaacacgtttccgtatttaggtgtcttgtttatcgttgtgtgttatctcatgatgttttggagtggagggtccattgtttccgcaacatccctccatggttagactgctgggtcagtttttccaagactcaattttctaacccagtagggtccttcagttctccagcttgggataggctttggcatggaacctgccaaagggcttcaaacaaatgaaatatccatttagtttttattgaggggagatttttatattctggtctggtagttttagaaaatgtaagttggattttgtttggaactttattgctgaggcttaatttgtggctcaggaaaagaaatagttaatatttcttggcgaatcaaagtggattggactggtttttgtgcccatttgcttccagaccttgactgacagcgtcagatgaagaaactcatcatttggaatattaggagatgcttgaaaccctttagaacaggctgacctgggcagtgtgggatgtgactttgggagatctgttttaacatttttgtaaaataatatcaccatgagtgccgggctttgcagagggaaggtcagattcctgatatgaaaggactgagttattaaaaacaaactgaaggctagaagcgaagttaacacttgagaaattaaaggccatgatggtgaacttgactccgggctttcagcttttgagattggctgctttagatttattttctatggcatttaaaaaccctcctggggccaaggtagcacttttagtcaacagccttccaagcagacacttgcctttgaaaccatagcagtcccagggcaggttggaggtggctgatgccggacacggtgctccagactgaaaggtggtcatttgctgtgaacttccctctagattgtgtagactaggatgaggatgatgggatgtttcttgagctctgacccaaggcagcatcctctgttgacataattctccctccctactgccccttcctcgggcagcttgcctgaaagttgagaattcttaggttatttcttccaaagggaggaccctccccgagcctggccagcagagaatgagtgccactttgcactggcctagttgcacctctgctgggaagatgtgaatcgggggcgagtcgcccagtgagtcagggttaggcttctgggtaagacaccgtgctgacaggcctggcttcccctctgcttcatgagcccctgtgctccccttcacccattcaaaccattgacttcatccctacccagaaggtcacctggactcccagtgtcatagctggaagggggtgagatggtgatgatgatgggaaacatttcttgagagtttgctgtttactgttattcggagtgcttcctgcatgttaacctgatctttataactttataaggcagaagcgttgtgatttttcattttacagattaggaaaccggggaacacattggtgaactcatgtgtcccagattcacagctagtgaatggagaaggtggctttgaactcaggccctctcactccagagcgtgcactcccattgtggcatgacactgccttgctgggccgtttagaccacctgtccccaccttcctcacttggaggaacaaggctcagacaaggcatttgctgacttttacgttggagacgtaaaagtctgtggctgtggctcccggggggaagccctgcctgcttgtatgcctcttcctcactccctcattcccagatacttcttgtctgcctgccgttcaggtgggggattggaagagggaccacagacatagccatcgaggggctacggccttgttgggatcaataaggcaggaccaaaaatgattctaaaacaagaaggaggtgcagatgaagtactctgagggttcgagggatggagcgatgggattccaggctggccaggcgtctcctctgtatccatgcgctcagtcaacattggctgagttcccactatgtactgatgctgggggccagagctgggagagcactacacatttgcagcctgggggcggggaggggggcagctggaggtgtccatgtccacctgtaatgcgttgtgccaggtgcccagggagaaagtccagaagagggaggaatagtatatgccaaggaggaaagtgtggatggagtggggagacatgggagaggttgtgccatgtgtgagcgggcccttgaaggacagatgggaccctgtgaggcagagaaggatggaaggacattgcaggtccaagggcattatgtggtctgaggacagctggcatggtggttggttgttgtctcaagagggacaaggtgggaaaaggaggctgaaatggcaggtggggcactgggaaaagacccctgagtgtctgcttagcgccctcttgcctatagaataaagttgtttgtgggttttgattggggaggttttctgatgacagcttcataaagattaatctggccactgtgtggaatctaaattctaggggaaattactggaggcaaaacaaaacaaaacaaaacaaaaacccacttagacagctcttcctctggaggaggctgagataaatgctttcgagaaatggtagcagagctgggagaatgcatttgagagggaatcatgggcctgaatgagcagggtttgttgaccagcgttaagtgggatgatggtgatgcccccatcgaggctggacacccaggaagtggaatgggttgggggtgaaagatggtggtgggttgcctgtgcttaactatgtccaggaagcagttggaaagtcaggaaagcggctggcgctggaggcgcagatttggaaaccatgaacacatgtggcagcctttcccatagcggggcctgagagaaggggtttggtggttgaatgagtgtggaaagcctgtattgtggcctctcctccagcccccactcaggagggactcacatggccacgctctgaggagcctgcagaaggaggcctgtctgacccagccttcctcccatgcactgatcactgttcctgtacttctgtcttaccgccccattacccatccatagatctgactctggaaacaccgatgaagtttggctgaagtcatgccagtggatggatttagtggagaggccgacccagctcaagatggaaagacagccagagatgcgctcgggtggtgggggttccttggagaaggctgaggtcagggggatgatggggtcacagcagctcagaggggaggcaagccctgaaggacagtggctacaagcgggccctgcagagatgcaaaatgagatttaagaagaggccttggatttggcatcagggtttcaagggggagcttttagggagcagtgtgtaggaggggaggggctgcagtcagtcagcagtgcactgaagggcaagtaccaggtggggaggtggaggcacccagcagcgcagcctttgtgctgactcacagtcagtgcgtcccaaaccctaggatggaggcaagcacacagggagctcttcctaggaaaaaatggggacatctcaggacatctgattatttcctttaaagagattattatgaaattactgtacaaaaagaaagaaagcagaggacatctggtttctcctttcatttcctccccactccaggtgttagccccagggctcaggtctggggaaggttgagcctccttgccccagcaaagccacttctggtaaggggcagggactcctggttgagacctggctcagcatcctgccccaggcaggctctcggagaccctgggacctgggaccgttgtttgcagggcaggagatatgagcaggtgatgttcctgttattacacagcgtgctgggtgagtcaccgggaatttcctaggcatttaaggcggaaggattggggtaaatggaggggaaggaggaggcaggtggagagaggaaaaaggtagtgagctggcttctgcctggtgagtaagttgttccctgctttaaagtgagatgattagggcggagccatgactgaggaaaataatgtaccagggagagccctgagggagcagttgagctggagttaaaggaggtgatggcttccagagtgccagtggcaggagtgagaggcagggatggggcagcttggagtgagagggatagggcagcttggaggtggctgatgccggatgcagtgcttcagactgaaaggtggtcgtttgctgtgaattgccctctagattgtgtagactaggatgatgggatgtttcttgagcttggacccaaggcagcatctcctgttgacatagttctccctccctactgacgcttcctcaggcaccttgcctgagagttgagaattcttaggttatttcttccaaagggaggaccctccccccagggtgccactttgcactggcctagttgcacctctgctgggaaggtgtgaatcgggggcaagttgccccgtgagtcagggttaggattctgggtgagactccacgctgacaggcccggcttcccctctgcttcatgagcccctgtgcccatgtgtgagcacaggtgtggtggcagggcggcccgaagaccaccagccctgagtgtggacggcggcccagggcagaggcccaacccagttccaggcatcttcatgctgctgcccaaggctcttttacaatgcagcctctggctccggtcttccccacacttgtgaaatcacaggcagggtcttccccacacttgtgaaatcacaggcaggcaacataatgacaggaagtcagctgtcggctctgtcttcatactcctgagggcccggtttttagactttgccactgttcctggttgcagtatgctggtcataagctaaaagggcatgggggtctctgtgcagcttggtttggtattttagtccgcagatacataggttggaattagtaccctgggtgctgggacacagctggcgtgggctcacagagacctcatcctctagcataggagactcaggtacacagtttctgggacacaaggttaattctgcactgaggcagtgagggagtgtttcacagccgtgtgagctgggccttaaagatcgagtccctgcagaggagggggatgggcagtccaggcagaggacccaggcaggactgagaagtggtggatgaggaacatgggaactggagtgtggaatctcctagattgaggaagagctgccttccgcaggtgaggtgggcccagcagaaaccagcccatttctgttttgacctttcgtcttgcagcagcagtgctcctggcctttgcccgttccttgctttcgatttataggagaaagttaatttccccccttgcctccccacctcttcctttacgggatttgaatctcttgcacatgtttttaataggcatcccttaatccaagtgttgccttctgggttttattctgttttctttttcttaaacataatggaacgtctgtgccagcttggaacaggactgaaaactgaggccagccaatgcgttaggctggcagggggccagccatggattaagtgccctatggcacttgagaagtctggccgacaccacactggtgggggagggggatccacaaaggctggagctggaggttcctgcgtctccaacacctctgcactgggaggagagattagcacagactcagaaatctggccaggagcagggctgtttgaagggaaggccgtgggcacgtgccatcgtctaccaccccagctgtgcaaaatgctcagcctagaggtgaaactgctcttcaatggggtgtgtcaccttaccccccgtagtcattctcctagaggagccttctatagaactgcttctgcatttgttggtaaatccttgaaaccagatcttaatttgcttgcttgcttgatcagttgattgattggtcaggggaggggttgccacctccccctgagagatttcttttaagatttaatgccaggacaaactttgttttccctgaggaactagtaagcattgcccatccaccaaccagagccatagaccatgtcatgttccctttttgtcttgtctactaggaagctcagagccaaactggatgcttttgcagtaactataacctcatggttatcccatttatagccgccttctttccagagtcctttttgtttctctggtactaaccagggtaaggataagtactttgggaaagaaatgagggcatatttagtgttttgggtttttttttttttggtgtgtggcagagtcttgctctatcccccaggctggagtgcagtggcgtgatcttggctcactgcaacctctgcctcctgggttcaagtgattctcctgcctcagcctccagagtagctgggattacaggcacccgtcaccacacccagctaatttttgtatttttagtagagacggggtttcgccaggttggccaggctggtctcgaaatcctgacctcaagtgatctgcctgccttggcctcccaaagtgcttgggattacaggtatgaaccactgcatatggtctgtttttttgtttttttttttgttaaggaaaaatgtgccattgaaggcagaacccacaggtggtgaccatactttctggtctgccactcctcttgcacaagttctgggaggaagcagctgaggcatggtgggcgggagggacctagaaaggagggaaatcacggctggcttttagttgtttgcagagaatagaaagcgcatggctggggtgctgctctggctcagtcccgcttctgaacacagggcagcttgtccaaacagcactctctgaaatggcagcctgcagactttgccactggcctgatttcactgctccctcaaacaagcatcttcttaatgatgtgtcaggttcctagtgtccggggttttccacaacactgtccggtgtgtgtctgtgagttgcagggctgtttggataagggctcagatctgcttgggagggcctctcggcctatgaccccaggcctgtctttgattctgagggtccttgaagcccacccttccccagagcatggttctagcaccatgcgacacaatgggtggcctgccagctttttctttttttgaatggtgggctgggttgccgttcctgggagcctagctctttctcttctgcctggactaaacccagagaatgctgggcagggctttatgattttggggtgaggaccctgttctgttctacacattgctgagtaagtcagggccagtcaaagctatatgttcaagctgacccgtgccagagaatgatctaggtggtcagctttattgtagctttattgtcttctagtgtaccacagtgattgtacggactacaaaactgaggttacagaaggaggtcatgtccccaaggtcacacagcaggatcagcagagcctgcgcttgggcagtggtggccagcagcactgatacattgcttgaccactctgaatgcttgggttgcacttggattttttttttttaagtttccaaatcaacatagctcacattttagtgaccacattgtttagaatatagcttatctcattggaatgttgaagcatcaagcaaagccagagccagacgtggctgacgtggctcagcctcacctcaggggccagggcacaagccgcagctgctcctggccctgtcattcctcccttccccattaagtacttttgatgccttcatccttatcttcctttgctccaccccaggaagagagaaaacgacaagaatgctttgcctctccatcttgatggtgatcaagataggaccaggctattttcaagttcacagaatcgggctattatcattgttgttaacaccatgtgctgagtgtttgatgcgcgccctgcacctcacatgagttatctctgtctgtccagaaacagcgccgagagtaaagaggatgaggcccacagagtgtagctggtttgctcgcagttgcatgtctagtctgtgcctgagccaagattgacctccagtctgtctggaggatggctttatagcttgtgccccatgatccagttaaatatctagggcaatggttttcaactggaggccgttttgccccctagaagacatctggcaatatccgcagcctttttttattgccacaacttgagagggtgttatggatgtatactactagcacctagtgggtaggggccaggatgctgctaaacatcctgcaatctgcagatcctccctcccacccatccacccacccaacaaagaattatctggccccagatgtcagtagtgctgaagttgaaaaacctgacctagggtgtcctaatcctccagctgacacttcctgggtgtgtgtggagtgcaggggtgttactggcctgccccttcgccattcgtgatagtgttctccttgctcttagaaaggatcatgcacctagactccaaaaggggattgggacactctgtcctgcaggggcaaccagaccccttccagtgggcagaacagcttctgacttttctctcttgggctttacacaccttcagaaggtctgatgagcagggatcctcccagtgggttccccctcctagacgttgcctggcatccagtgagcagggttctcaggccagggctgagacgtgggcatggggagcgtctcctgttcctccctgaggaggaaccctcagccccatgctgagggttaaagcgagggaggagagatgtcagcctgggccctgggacctcatggtcaagttggacagtcaggatgctcacagagaggcacacccttagtaactgcgtcgcttcgggtatatttaagagccagagggacttcagaggcaggctgaagctttgagatggaagagcgagaatgagcaggggactccctaattcttcagcagatggatggaattcaggtaggcatcaagcagagtgtcgtaggctaagggctcgcgcccagcagtcagtgcagtgcagagaagcagttggaagaggttggcccagggcgcagggcagtcctggtccagaggctgtggcatcggtgtgagtgggaattccgagggcccggccaagggctgagagaatgggcctggagatgctgcagaggcgtgcagtaggagggcacagtgccagggccactgggccggggcaagaggagggcgaggaggccccaggaaatggaaggctgggatccatttctagtgtgaggagaagctgccatttactcttctgagaaagagaaccagccccttgtagaatggcagttttgctttgaggagcccctaatggagactgtacagacaactgggacaaatacagattttctttcagaagggtttgtgtccgagccaccccaacagccggcatctagataagtgtggaaaatagtttctgtgataggaggcatggccccaggctcagtctgcagatgatgcctggtgtgtccactgcgccaacatggggcgctgttgggaacccactcggctgctgcaggcttggaagctgctgctccacaggctgggagtttttgcccccaaggctgtgcagagccaaaatctgaaagcccttttaggggcagggattaatgtgggttactctggggaccttgcaacagaggctgagaggtgactgtgcaggaggtgtggcctgccccacagtgagtacacgcagtggctgtcccaggttcatccaggtactgggtggcccctggtcctcttcaggtttggcccagcccctccttgaagactccttccatccagtcaaggccaagcaggcggggcagggcctttatgagctaaataaataaataaataaataaataaataaataaaaagagaaatcaatggccctttacacacaaggctgatggaatctcctccagacacctgagcatcttgttctggtggctcttgccagttttatacgataaaaggcatggggtagggagattataatccctctgaaatgcggggaaatggttttccagagtgtccatgggaccccatcgagggagcatggggcttgggacacccaatgacccagtagcccaccctgtgtccacagacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggtatggggtggctccattccccgcccccccaccctgcccctgccactctatcccacccccagccccaggcctgaacacacagcctctgaagggaaccttgcgtccatccttagctgtgctctgcctcctgctgggcatgggggaagactcactgccccagcaagtcccctacactctctgttgccctgtttaggggccagacaggtagtgttcaggccacttgatcattcccactcaaagatataatctcagaaaatctggaagccacagaggaaaatagttcatctaagggatcaagaagggaacgtctatgagaaaggcaacatatgaaatctattttttttttttttttggagacagagtcttgctttatccaggctggagtgcaatggcacaatcttgcctcactgcaacctctgcctcctgggttcaagcgattctcctgcctcagcttcccaagtagctgggattacaggcacccaaccaccacgcccagctaatttttgtgtttttagtagagacggggtttctccatgttggccaggctggtctcgaactcctgacctcaggtgatccacctgccttggcctcccaaagtgctgggattacaggcgtgagccaccgtgcctggctgaaatcctctaaataaaaatactctgaaagtacagatggataggttgataagtaggcagtcattgttggaagagtgatcttctcttattttcatgtatcattattctaaacaatttagaaaaggtagaaaagaattgtccactatccaaacaccactactgtgaaccttctgccttctagcccccagaacataagtaaaagatgactttgtgagtttaaggaagatgaagctgtgttacgcatcacttggtttgcttatgaagttatcaagcttagaggattttacgatccagaatcacaactgtcagaacttagaagggctgtagagagatggcagagtgaggttttctcagaccttgtcctggagccccaagggttggcaaagggttcctgcggcaaactcaggaggtgggcaggttagcaaagggaagcctggtcccacgtgaaccagggcacctctgcactcgcttgctttatatctcgggctctcacagaagacttcatttgaagagaggattgattctgtagtgaagagaagaaaagtttggaggccatgggcctaggtctgtgctctcattttctaggaaagggacctgatgtctagggggttggggagggtagggaacggctctgcagagacctcattgtcagtgacagacagccaccactaccagacctgttgttcccatttcgctttttgttttttacttcaaaaaagatacttattctgggtggcataccactgtttgattgattgattgatttagagatagggtcttgctatgttgcccaggcccagtcgcaaactcttgggctcaagctatcctcccatctcagcctcctgattagctgggacaataggcatataccactgcaactggcttttttctatattttattaaaaaaaaaaaaaaatatatatatatatatatatatatatatatattttttttttttttttttttggagcggggagaccaagtctcgctcttgtctcccaggctggagtgcgatggcacaatcttggctcactgcaacctccacctcccaggttcaagtgattctcctgcttcagcctcctgagtagctgggattacaggcatgtgccaccacacctggctaattttttgtatttttagtagatatggggattcaccacgttggccaggctagtctcgaactcctgacctcaggtgatctgcccgcctcagcctcccaaggtactgggattacaggtgtgagccaccatgcccggcctatttttttaagttactgaaacgaaacaaacatttttggtctgggtcttcgcatccccacctctgccttctgctcttactgacatgatacagttgtggacagccaggaagtcatccctcctgtggactctgagccaccagcaccctgcagaactaaagccagaaaaaatggggagtggttggaggaaggggacagtagtgggaataggaggcaggacaggggacatccagtgatgcatgggtcggtcacctcgtgttcatcctaccggatgctgggcctgtaatatctggctccgtgttctgacctctgagcttcttccccaggaatggagcagagactttgccatgcaggagaagggaccatcccctggccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttatcatcattccctttttttttttttttttggagttagggtctcactctgtctcccaggctggagtgcagtggtgtgatgggagctcacggcagtcttgaacccctgggctcaagcaatccactcacctcagcctcccaagcagctaggactacaaggatatgccactatgcccagttaattaaaaaaaaaatgtttttgtagagatgaagtctcattacattgcccaggctggccttgaactcctggcctcaagtgatcctcccaccttgccctcctaaagctctgggattattggtgtgagccaccgcgcctggcccccatccctatcgtagagacaaacgaagactcagagggtgaataacttgactgaggcccatgcctactcagtggcaaaggctgtcactgagacctatcctgtgtgcccatctcttgtcatctgcctcccttggctttaggaatccggcagtgcccatttcccctactttaggcttgggctttggggcccgtttgcctggggaagctggcagtcactgggagcagctctgctgttctgcctcctttgcgagcctcaggtggccccagggccattgtgtgtgagcaaaggcaccctgtccagtctaacctgaatctctgtaggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggtaaacgagccgcacaggcacccctgccttgaggtccctctccgagtgcatgcctaggatgctggagagagtccacctttctcaccttttctgctcactcatgattgcgttgtcaatctggaggtgattggattaggttttctctatgcccacagatctaactgtgctttccctgaacttccagggagcagatgtagcatctgataggtctgcctttaacctgtgggtacctgcctgttgccctgtgcgtagatgctcaggcagtatggcttcctttcttcactcattcattgcacaaacagcatgcagggctctgtgccaggtgctgtaggggatgaagaggtagatgcggccctgctctgcccccgcagaccttacaggcctgcagagcacagaagacaaagacacggatgagttcaatataagggacgggtgccaagcaccaagccagcagcccaggtagagagaaggcccatttagctgttgggatggatcagggaagtcttcatggaggagaaacatccggatcctgaaggataggtaggcactaggcacagggagggcattctagacagggggagcagcccaggcaaagggcctgaggtaatggagggcaggacatggatgggtagctctctggctggaggagggtcatgtatgagaccgtcaggggaaatgtttcaaaagcacaacagcatgaggccgtggaaggacaccagagagtttgactctagggaactgctgagggttttctgagtgagcctgaaaaatcccacctgtaccccaagaagaggtgtcaggctgcacccccgagagtggtttggacagggccacgcctggacagcaagatcaggcaggtggctgatcccatctaaggcctctttcctcaggaaaccaaggcagaaagccccagccaaagtccacttttcacaggacgtgcagccactgtgtaggcagcccacagaacatggcctgtgacagactagtggagcaggtaacctggccaggccattgcctgtggcacgtgtgtggcatgccccttcctgcccactgagtagcagatggtagtggagaagtggtagaccacaggcaggggaaactttagaatgcagaaagtctgaaatgataatagcacaccaggtttccagagcattttgtggttgcatttatagagtacattccgatcgttgacctcatttagtcctcaccagttattctctggctctataagtaaggagacgctttgagagacaagttcagagagtttcagccacctgcccaagcgcacacagctagtaagtggccaagccgggatggggcctagggctgatggactctcaagtttggtgctcttctgcttcttggctctgctgggggtcagggcccaggttcagccctgttccaccacccttgtccttggagagaatgaagaagaggaagctcagtgacgctcttggccttctgcctcttccattccccggccccacccccatcttttgggtgagggctgagttggctgtggtgttgtttgtcagctcatagaatgtcagagctggaaggacctctgaggccagcccttcattatacagagacacagggtccccaagagaaagcgaccagctcagagtcacacagcaagaacaggagcctgctgttggctcattcataagcgtcaccccggctcaccttttggctatttccagcatgtgcttttgtctttatttttctggttgacacattcctggcactcaggcagtaagacttcaaacgacatttattttaaactttatttgtgactgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggacttgctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggtcagttatgggtgctgcctacatcaggggacccaactccaggtgactctggacagcagagcaggcagggctcctcagagatgagctaggccagccctagcgtcaagagcagaaagaccaaagatcagagagaggccaaggcctggcaggcaggaggggccgggccaacagcagatgatgaggaattgcagaacgatgtttgctggcaccgaacagctgtaggcactgtaaacacacgctccatcttatcctcatcccagccctgggtggggatgccagcatcatccgtacagatgagagaactaaggcccagggagggagagtgacttgcctgcagtcacactggtagaagagctgtgtctagaactctgccctcttggcttcttccttagtctcattttaggcagatggctttaggatgaccctcttcaggaagttaggtcttcagctcattgttcctctcctcctctgttgctccatttctgactcagggaccctggtgatgctgaggagcccaggatattaaaactgagagtccgggaagggaggaggagatttgggtagttataaaggaacaaaattttctcgctgagaaatgacttttttagagtcctacatactggtttctttttctttttctttttttttttttttttttttgagatggagtctcactctgtcatccaagctgaagtgagtggcaccatcttggcttactgcaatctctgcctccaggacgtgcctcagcctcccaagtagctgggactacaggtgcgtgctaccacgcctggctaattttttgtattttagtagagagggggtttcaccatgttgcccagggtggtctcgaactcctgagctcaggtgacccacctgcctcagcctcccaaagtgctgggattacaggcgtgaaccaccatgcccggccctagatactggtttaaacatggccctgatatagtcaggtctacctggtctgcttggttgaatctctcaggccatcctgctttgggtttagagaatccagtcccttttctttccactcacggaccaaagtttgcggagaggcagggctgtgtgcccccgccttctgctccacactcccccctgccagccgccagctcctgcggcagatgcagaggtgcccacatgtcagctagagccagcgccttgcaagctactctccctttctcttcatttttccagatgtttggaatccattttgttttgcagtcatgctgcactcaggccaaacccatttcaatattggccttgggccaccgtttgtaatgaaatccagatgagcatgacttatggaaagtcagattctcattagaggatttcatcctgtaaaatcctcctcttccacttaccgtattttagctgctgttcttctgtgtctgccccagggtgtcagggaacacagccccttggtttcttgggtgtctctgaaatccaggagtgaccagtggagcaatcaaagtggtcagacctcaaaagaacttacaactatgttatggcctgaagagatcagcccaggcccaaaggtctagccagagaaatgttttaagcaatcttttagccctggcttagctcatttagggaacaggagtgaaaggttagaaaattaatctttttttagtgaagaagggaaatatttaaagatggactgcagtggaaaagagtaaggggatgtccatttgctcttcttataccagactgtagtctggagggccacactcaggtaccctcgctcgtgcagacaccccagggtctgtctgcaggcccatttctcaacctccctgctacacaagcaaagtagaggccaagcaaggagggtggtgccttcaagacagcaacactgttcctggtgtggcattgcagctctcccgctccaagtgctaggaagaggctctttggtggcagagcctttccctggggacactatcaccacgcgggatgtcctgccagcacacccagtcctctgtggcccaccgcgtcaccgctgcctggcagcactgcacagcagcctgacgggcgggcgcggccccttcccagaacagccttgtcgtcctcctgcctcttgggccaaggagagtaaggtttcagctcttctctctgtgaggtggctgaaagcagggcccagggcccacacctctcacctccagctggcaccagcgactccagcctcagcagatagcctttgctcagtggaggcctttgggagcctgcctgcaagctgcgtcatcaaccagcctgaatttagacaaagtgctttggggaaaagaaacgtgtggtgtgccttgtttttttccagtaattgttccatggctcgttctgcttgtaagattttccaaaataaggccgtagatgagaattatatcagcacattgggaaccgaaggcatgcggacactgttggcgctttgtaaaaaacacccctcaatcagacagacacacgtcatcgtcgcctgctggggctgggcccagatttcgagataggggagcggcacgtgcccgtttggtacagatgggagccaggaagccctttgctcaggatggaggtctcctctattagggggcctgttacagtaactggtgggcctctggggtaccctgcaattgactttacatatttaactctttgccattgactttacatgtttaactctttaaagtcgacttccttccccctcaagagaacttaatttactcaaagtcctccctgggtagaggagtttggccgggtagtttcagcaagttactggtaccgcttctaggacagcgtctaacagcatctttgggaagatgactgtcaccaaagcagaaaaagctttctgacttgtgtaaccccctggagattttttaagtcccccaccccacccctttccctatttcttacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 1993 - DNA, 54829 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgagtactgagagtgacagcggtatgcaggacacattcttagcacctaactgaacccctccttgcccccaataaaacatgcttcctaataaaagacacagctgatcttactgttagcactgcatgtactgacagtgaaattggtgtagggtggagggcggtggctccatcacttgtcccaaactgctgttaggatttctcaaactagattttcaaagacacaagtgtgtttagttaacctgaaaggtttatttgctggtgcagaggctttaaaaagccctgttgaagattgatagctgtttcccttcaaaaacctaagtacgtttgtttttatttaaaaaaacacatttatttcccaattagtttcttaatgcatttagtttttgcaccgtagtttaaggtggaattgccagttatttaggaataataaacacaacaggataatagcggaattaccctgaattgactttctgcaaacatataatcttagctaatttttgttagtaacctttgacttttgccagaattagcatccttctagtcttagtagcagcttggttactcgggtgttttaagaagtaggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagacgatggtgaattatgtaggtttaagttgttggaattaaaactaaaagcttcttttgataaaagtcgttataacattttgtgactctattaatagaagtggctttttctttgctttccaggtttttgggcgagttttaaagaagtattgcatcttcgttttttttatttttgaagtgggagtgtatgtttctgtttaggtcactgccttcattgtaaatcttgagtttagaaaaaaccaaactgcaaatctgtttttcagacttaatgaaaatttgtgccgagaaagtcactttgaaatattttggaataagttttacatgaatgattgatcttttatgatagctttgctgtttgaagcaattctccctctactaggaagcagcaaatcttacttttaaaaacctctgcttcactttcttaagctacattttagtcgagcgattgtgtgtgaattctttttctgtattccccttcagtttttctttctccccgcaaattaaggagcgagaattaacctaatttatgctgcccagtcacactccagctctcccacttggaagcagtttttttctgattgagccagtgttatagtaacatcattagacactattctaattgaggtgtgagttactgaggcctctgctagggaggttaaccctacagaatctgtagggttcattatatttaaactgcatatttcggcttgtctaaatttttgcctattttggtgaaaacatgttgttttgtcgatgtttaaacttagttcattttgtccctctctagttcatgactaaccatttttttcatttttaatccagcgatttttttagagtggttctttaagcatcttgtattagccatttcaatggtcattatatatgtttggatttctcttattttgttgaactagaagactgtgtggttacgccccaaaatttttttttgtcttaaagccatgatgaatggggtgactctgaggtgaccattaatcgcgtataaaagtaacctgactaaaatgttttcattgttttctacagttaaaggacttacaccagcataacacagcatttttttttttttttttttttgagatggaggctcgctctgttgtccaggctggagtgcagaggcgcgatctccactcactgcaaaccccgccttccgggttcaagcgattctcctgcgtcagcctcctgagtagctgggattacaggcatgtgccaccacgcttggctaatttttgtgtttttagtagagacgaggtttcgccatgttggccagactggtcttgaacaactgacctcaggtgatccgcccgccttggcctcccaaagtgctgggattacaggcgtgagccactgcgcctgtcctataacagcatttaatacagttttgtaaaattatcacattttgggctttttgttcaacagttgatgaagtctcaattgttttaaaatgagaaattcaaacagttcacaaatatatctagatatattcatttgagctacttgtagaatgatgctgtttgcatatatcaagcatatgcttgatcataagtcagatttagaatttttggattttgttttctctttctaaaatgtgtaattttggtaatgggaaatttgactgaattccagtttctcaggaacaaggtattttaggttgtgtcaccttaacactattacctggtgtaattggcatccgggaacatttgtttttaactatgagagtgaatgaaaactagggtagtgcttacatatgtaaaactaagatggtaggtagtcggattcttacaatttataaggttctcataatctaagccttgatgagttgctactgcaaattatattatagatcagataagtaccaaagaccagttgtaaagagggtctgttaacattttaatcagtttaaaattggcggtaacagtaaagaccgttcagcccaaagactgtatttcattatttatattccaaatgagaattttttgcagtttggaaaacttgtaaatgtgttgaattcatctttttattgcttttttactcccaatgtttagggcaacggtcttttcttctctcctgtctccctccctccctccctttctccctttttcttctttttcttctttttctttttttttttctgagacggagtttcgctcttgtcacccaggctagagtgcaatggtacgatttcggctcactgcaacctccacttgctgggttcaagcgattcccctgcctcagcctcccgagtagctgagattacaggcgtgcgccaccatgccaagctaatttttttgtattattagtagaggacggggtttcaccattttgggcaaggctagtcttgaactcctgacctcaggtgatccacccgcctcagcctcccaaggtgctgggattataggcatgagccaccgcgcccagcctttttttcctttttctttccatcttgctcagtgccccagcctggagtacagtgctgcaatcatagctcactgcagcctctaccacccaggctcaagcaatcccacttcagctgctgcggtagctgggactacaggcacacaccatcacacctgtctaattttttgaaaaatttttgtagagatgggggtctctctctgttgcccaggctggtcttgaactcttgggttcaagtgatcgtcccacctcgacctcccaaagtgctgggattaaaggcatgagccaccacgcctggcaagtagttttcaatcttggctgtacttttagatcccttgaggagctttacaaaatactgatacctgaattctagccccagaaattatgatttggttggtctagggtgcagccaggttagccctccgcagtgattgagtcattagggtcctctgactttttcttttgaactgtttcacttgtgttagctttacattctttaatacagtgttacacacatgtacagtgtagccatctcacacatctaacttaacgggtcttttgaaagtattgccacatttgctttgcttctgtgtctgtctctttcttttctctcccccttcctgtcacctattcctttctcctctgtttctttcttcactttcagtttatttgaactgtctggtagtaagttttaggaagctgtatttcccatgatgagaagttagtatatcatcactattttaaataggaagttgattttcttttaaagtatattctcaaatgcttacttgtactccttttggagactaattactttaagtccccaagttagcatctgaactccctgtgggcttggtctggtggctcacatctataatctcagcacttcaggaggctaaggcaagaggatcacttgagcccaggatttcaaggccagcctgggcaacaaagtgagacctcatctctaaaataaataaataaataaataaatataactcccaatgcaaattgtcttcttagggcgttaatctacttggtaaaccttacattttcaagcccccaattaactagtcacttaactggtttctgagaggcaggttgcattgggctttttctgtcagggcttaattaatacactgtgagacatttgctcagctaggccagctagctagtacttctgtagagatcatctagggcatgttcagctctccatttacatcacctgaagtagttcccaagtgctgggctatggagtagtttcatctctgtctctggaagagctatttaaaaaaataaaaatattttttcccatctgattgcaacacacatgctgcttcagaatgggaatggagtggaggaggcatgggaatctgtgttatttttaaaaagtgcctcttgattctaaaggttttgtttattttggtatgcttatccttactgctttatttatctattttttagagacaggttgcccaggatggagtgcagtaacatcatcatagccctctataaccttcaacttctgggttcaagagatcttgcctcagcctccagagtagctaggactacaggccggcaccaccacgcctggctgatttttttaaaactgttttgtagaaatgggggggcgggggtcttgctttgttgcccaggctagccaaatcttatttatgatttaaaactaggaatgctaccgaatatatatttttatagtaaggtattatttctgtatgttaatatggatgaatgtatgctactcaggtcttttcaagtcaaaatgtatttctaaatataagatgaattaaggatatttgtcagtgatattcactagtgaattctagagcatatgttatcagtagatgggcagtccttgtaaaaattgaataatctagtgaaaggatgaccggaaataatatttaatggggtaagctaagccaggaatcattgtacataaacacattaggtgtgtcttacatcataaatatgcctactaaaactagttgaaggaagaatgtgtatagatgctgaaataatgaaggggctggctaattgtaaggaaaaatgatacaacttctatataattagtctttttaatcagttgcatatactcatgatacttaatttgtaaagtaaagattgtagactagatcaatgctttgtaaaactaacagtacctcagacttccagagtgttttttaaaggtacagccccacccttgattctagttagtggagctggcctaacctgcgggggattttgatacatccccctttgaaggaataagctagatgacttgaaactctgcttcagttaaaagttttatgaaatgaggccgggtgcggtgactcacgcctgtaatctcagcactttgggaggccaaggggggtgcggattacctgaggtcaggagtttgagaccagcctgaccaacatggtgaaaccccgtctctactaaaaatacaaaaattcattgggcatggtggcacatgcctgtaatcccagctactcacatgcctgtaatcccagcttcttgggaggctgaggcaagagaattgcttgagcctgggagacagaggttgcagtgagctgagattgtgccactgcactccagcctagctgacagagcgagactgtctcaaaaaaacaaaaaaagttttataaaatgtatttttcagttatcagttattaaaattcagtttggtttccaccatcttttaaaacagtggttcccaaagtatggtccacagactcctggagatccctaggatccttatatttaaggggttcacaaaatcaaaattattttcataatgaaactgagacgttatttgccctttcactgtgaggacatttgtatgggtggtgaaggagcagtggtgggtaaactgctggcactttaaaatgactctaggcagttataccaaacatatgagtcctcattgtgttctttatagtcaaacacacataagcatttgaaaaaatgccggtttcacttaataatccccttgctgcagcagtaaaaaggtttaattttaaaaaaatctctaccttggagtatgtctttttaatagtgtgattaaatgggaagtatgcataaagcatttctgcacattgaagtacagtgttcttttctaggaaaagcacttgtgttattgagctgcaagctgaactagctgctttttagtgggacaccatttttatttttatttaacaggatgacagataagctcagatagctatttagatttgagtatttggcaggtaattccttggaaatgaataaagtgagctggccacttcgaggagaacatttatagccagtgctaaaatctgatgtttcaagtgaaaatcagatttttgggaaactcctgtcactatgacttgccagtttcttaatacttaaagacttttctgatgagatgggtggtgatattaaggaatgtgattaaaaaaaatatgttgggctgggcacgatgatgcacacccatatttctagcactgtgggaggcggaggtgggagaattgcttttggccaagagttcgagaccctgtttctacaataacatataaaaattaggtgtagtggcatgtagttctagctgctcaggagggtgaggtgagaagattgcttcagccagggagttcaaggctggattaagctaggatcgcaccactgcactcgggcctaggctacagagcgagactgtgggggggggggcagtatgaggaagtgtgtcaacactgggaagatctgtgtaactcattgaaccaatattttcccaaatgaccaattcatgttacaaaatcgtgcatgggtaggcgatccgttcaaagtacaacatagacaaatggatttttatatacaccagagccaaaaagttcactgatacagtgaattccacattgcaactaacctttcagaattgccacttgagttttggtgttgaataaaagatgaatatccattgttttctgagaaggctgttaaaatactcctctcttccaattagctgtccatgtgagacacgttttcttcatgtactttaaacaaaacaacatatcatagcagattgaatgcagaagcagatatgggaatccagctgtctcctattaagctaggcattaagagaaatttgtgaagatgtaaaacagtgttactctgattcctgactttgttttagaaaattctgtttttcataagatgtttatattaacgtaatgggtttattattttaaatgaattaataaagcaaataccaaaaattttagtagttttatttatttataatatgataaatatcaatgtatatagcccgcataaaagctatttggtgtctttaataatgaagagtataaataaaggtccaacttggccaacatgacgaaaccctttctctactaaacatacaaaaattagctgggcatggtggtacatgtctgtaatcccagctacttgggaggctgaggcacgagaatcacttgaacctgggaggcggaggttgcagagagctgagaacatgcctctgcagtccagcctgggcaacagactgagactatgtctcagaaaaagaatatgaataaagggatcctgagatcagagagtttgacagctgctgttttaaagtaactatttctatgcattatcgactaaattactgattgattgaattgtttttatggtttgtactatattgctgttatttctaaggacgttagtcattcagtttctgttcagttatcagggaacatgtaagagtcagacttaagtaaaaaggggaattcattggcttggtctggagatagagctgacctcagattgctatatccagggtttcaagcagcatcaccaggactcttgactttgctttctttctgtttctcaggtagtttgcaggctaactatccccagcttcaaggaagcatgaagagggccttcccccccccacccccccacccccccaccccccgtagttccatcggaagtgctagagctatgtcacttgcctgccttgcgttctttttcatcagaaacaacactgtggccagggggtggctctggttagtctgggaattgtcccacctggccagatggggagattctccttggaaaatcagactgctgttttacaaatggagaaatacatgctggtacacaaaaactgatgtccacctatagtactttgttatttcttcttttaacagcctttaatttattaatccaaaaagggtaatttttaaataagatcatttaaactgaaggtggcataccaaaatgacatttaagacacataggtaaacaagaagcatacatctcgatttgtcctttgtcattcatcttaaaagttaaaaaaaaactttttgttgcttttattgctgtataaatgtgctcttggaagttcgccaactgccctcagtttgaagaacctcaacttgctgtctaggatttagtctttagcttgtgctgcagacagttgcactaaccgtgaacacctttttttcctgttggtaaacctaagtttagagtttattcctagtaataacattgatatattaccaggcccagcttttttctcctcccctagttaaatttaagcacttttgcgccgggcatggtggctcatacctgtaatccagcactttgggaggccaaggcgggcagatcatgaggtcaggagatcgagaccatcctggccaacgtggtgaaacttgtctctgctaataatacaaaaattagctgggcatggtgatgcgcccctgtagtcccagctactggggaggctgaggcaggagaatcgcttgaacccaggaggcagaagtggcagtgagccaagatggcaccactgcactccagcctgggccacagtgaaactctgtctcaaaaaaaaaaaaaaattttaagcacttttctcaaatattcccatagtaagtagtttattgatcactgatcaaaacacttacaacttctagaaaatacatgtttgacacatataatacagttaattcaaaagtaaactaacatctgagaaaaaatgtcaacactccttacctaaaatacatgaatttacatgagaacctctctctggccagtattcagcctgtttaattttagagagtatcttaattagtttggttatttggctttctcgtccatttattagtatacctatggtcaacgtcaggtgacagcttacaattaatagcaaggctagaggaaaaacaacaggcagataacaagaatcagctgtctcttcttgctaactctttacctctcataactcttgactgcatctaatacctgtatatgttagtgcctttcagataggcctaacttctcatctcttcaaactcaagatatctaaagctgaatttgttacatacctgcttttaaattttttaatcattgagttatctagaaatgggtcgtcttttatttgtcccccctttttcacccttcatatttcagttggttaaagactccagtcttttctacctagaaatagctcactgatttccccctcccctccttggcccattgcccatgccccagtctaggatcttaccgcttttctggtaattgtttcctaactggttttctatttccttttccaaagctgttctccaggctctcactgaagttttctaatacaaatctaatgctgttttttctcctctttctaccatgaacctactctagacaaagctcttatccgtctctgcttttcctcatcattttccttcagcctggcaaattcttattcgtatgtggtaatccattaatactattctaccaatattctgatggctgtcccctggcacatggtagtattgtgcttctttgtctccctcatccctaccttgaaattaggcatggcccagagtttcttgcattggcactgttgacattttaggctggataatttattttgcgtgttgtccagtgcattgcagggtatttagcagcaaccatggcctttagccaccagatgcccagtagtatccagttgtgaccatatattgcctccagatgttgccaagtgtcccctgagggacaaagttgcccctggttgagaactcctggcatggccttatgactttggccagtcaaacatgagcagaagtggtagcctttaaaagaagatatatgagctgtcctatcccttctcctgccatttaaggacatatgtagaaatggagcctttgtcagtctaatttctgagcgatgacagcagtgcccccagttgatctgtgatgaatgtgtattatatcctaagcagaaaataagcttttgttttaagctactgatcttttgggggttggttgtcactgcagcatagactagccaatcctgactgatacgttgtgccaagacctaggttacctatgaactttccatgctccctcatttatagtcccaaatcactttatacctacttcttttagcatttattacttatgtaataatatgtttgggtcttccagattagtagttctcagtggagtaagtactgctctttaagggatgttgtagaaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccttccctccctccctccctccctccctccctctctccctctctctttctctctgttttctttctttttccttcctccctccctgcctccctcccttacttcaggctctgttacccaggctggagtgcagtggcgtgatcttggctcactgcaacctctgcctcccaggctcaagccgtcctcccacctcagccttctgagtagctgggactataggcatgtgccaccatgccccactaattttttgtattttttgtagagaggaggtctcactttgttgccaggctggtcctggcaaccgtgcctttgttgccaggctggtcctgagcttaagtgatccaaccatgtcggcctcttaaagtgctgggattacaggcatgagccactgtacccggacttggttgttttgttttttatttttgagaccaaatcttactctgtcacttgggctggagtgcagtggctcagtcatagctcaccgtagccttggtctcctgggctcaagcagtcctcctgccccagcctcttgttaattcattttcttagttcaagttgtttaagagttcaccatttgggaaaatccatgttactgactgcagtgccattgtgctatttgagttgccagtataacacgtttgtcttggaaggtctgaatttgtagctgtcacatttgtaatgattctgtatataagtgctagcatctaacttctttattatacattctaacttagttggcatgcctgagtatttataggtggaagtacacattatatattaagcttttcctcctttttgttatagttagggcattgttaaattttcaaaatatgtttaagtagtttagaattttgtttcagtaaagctaaggtggtgatataaattatttgttggaaaaaaaatgggatgttggtctgagagagtccagacccactttcttactatgggcttcctgtttttgtatctgtagtgctttgtatatacagtgtttgttgaattggtcaatttatgtttcccacatttcttttatgtacgttgttgcatctaattaccacaataaatttgtgaagttgtcagggcaggtgtttccattttatagatgagagaattgagagagatgttaacattcagtcatgcggctagacctttaattagaatatataattttatttatatcgatattatgctcttgcctaccatacttccataatctagaaccatttaatgtaggaatacatctctttattcctgctagtattattttttatatgcataacttttaattatgtttcaggcacttgtggtcataggaatacaataaagagagagatgagaaagctgtttgtttaagaaagcgaggtcattatcatttgtattcaaagcaacttggtattaaaacaaactttgagataccgttaaggccccagcatagcataaattttagaaatgatgacatttgatggtgagattgtggtgaaatagttaacacttaaacattttaattgcattgtagattcatacacatcttttggaatataatatcagaaaatgacttcaaaagtgtctgcactcttctaatttgttgtaagacaattccacagaataaaaagctatggtcagtccagaaacacttgcctggtatatgtcaggaactgtgcatggtgctgggaatttctaaaatgagagtgttgttgctgttttcttggatttctaatttgtggcaacaatgtgagacagatatgtaatcaaataactaatgtgttacattgtaatttacacatgtaatttacaattaaattgtaatcgtaattgttaaattgtaatttaacgtatctttccttttccctctttcccgattcctttcctttctactgagtctcactctgttgcccaggctggggtgcagtggcacaatcataactcacagcagccttcaactcctgagctcaagcagtcctcctgcctcagcctcctgaggagctgggactacaagcccacactaccatgcctggcgaacctcctacatttttttagacagattttaatagaaaatgcagaaaaatgcgtaatgcattttaggaaaaatcttcttgtaaaactattattatttttttgagatagggtctcactgtgtcacccaggctgtagtgcagtggcacaatcacagctcaccaaggccttgacctcccaaggctcaggtgatcttccagtctcagctccccgcgtagctaggacaacaggcgtgtgccaccacacccagttaatttttttattttgagtaaagatcaggttttgccgtgttgcccaggctggtctcaaactcctgggctcaagcgatccacctgcgtcggcctcccaaagtgctgggattacaggtgtgagccaccgtgcctggccacaattaagcatgttaatatttcaacagtagcttttttactgaacactatgtatcagacacgttatgcagaatttttcctttgagcttctgtataccctccttttaatccagattcagagtaacttcattttctgactactatgaaaactggaattctaattcaaatctcttgactccaaaatctcccatgcaggttatctttggttatttggaaagtgtaccttcagcatgtgtattaatgtgggcaagtgctctaagacatatgaaaaactgcttctctgcatggggtttatgagttgagacagacatttatgtgaaagagataacaacagagggaggagcaagtcttcaatatcaggtgattgatgtacattctgaagaggctcaaaactacaacagtggcagggagaatgggaggagagatagaaaagactgaggtaaagaatcttgtaactgtaacggaatgtagggatagtgaaggaaagaggcacgtcagagatcttttgcaaagcttcccaaggctaggtaattgagtggaattgatactttaacaaaggtcttcagaagaggaagagattttggtagaatgatgagttttattaatcttgtgggaggatactttaaggattcaagtatgcagtaaaagaaaatgaaagcaagataagtctggaatgcaacttcagtgaacaaataaaatacaaacaagcacacaaagtacaggctccagtcctgctttatcttctttattcttaagctaatggccttttcctattctctgtggggtcttgggatcagataagttagttttctacctgttgaatggattctttattaatcttcagtttttgttattttaatttttttgaaaataatttaccctgctgcttttacaggtaaaatcttttgaggaatttagtgatctctttaaagaacagctgtattgagatataatttccataccataaaattcactatttgaaagtgtacaattcagtggtttttactatagtcagagttgtgcaaccatcaccattatcaatttttaggactttttcattataacaaagaaacaccatacccattagcagtcattcctcattccccttcctcccaggccctggcaaccactgatttactttctgtctctgtggatttgcctattctgtatatttcatataaatgggattatataatgtgtgaccttttgtcactgacttctttcacttagcatgtgttttcgaggcttatccatgttataatttgttagtactttattcttttttatggttgaataatatttcgttgtatggaattttatctatgcattcatcagttgatggacatttgagttgtatccattatgaacaacgctgctatgaacattcatgtacaggtttgtgtggacatgggttttcatttccctcaagtagaagtgtgaagagtagaattgctgggtcatatttactctgtttaacattttgtattaataccagactgttttccaaagtacctgtgccattttgtaatcccagcaccaaggagtgagggtccaatttctcggcttcttcaatacttactattgtctttttgatatatccatctcagtaggtatgaagtagcagctcattgtggttttgattttcatttccataatgtctaatgtcgagcatctttcatgtgcttattggccatcgtctttggagaagtgtcctttagaatccttttgttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcctcctgcctcagcctcctaagtagctgggactacaggcaagtgcaaccatgcctggctaatttttgtatttttagtagagatggggtttcaccatgttggtcaggctggtcttgaaccgctgacctcaggtgatccacccgcctcagccttccagaattctggcattacaggcgtgagccactgtgcccagtcgtgttgttttcttttttgatattgtatgtacatttaaacaaccggattacacttagtccttttataatttagaaatctgatatgtttcactgttagcaaatgtttcattggtcacatttttcaggtagaacttcataatacagctcccttgcttaaataaatcttacagaaattttgtcgtagattttaaagttttatttcaagactttacacatagtttctgcaacacagtctttttgcatatttatttattttattttatttttttgagacatggtcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaatttggaatcacatataacatatcctttaaaaataccagtattctaattttccttcatttcagcctaacatttttatgaatgataatgttgagaatggtttaaaattgcactcttttgtattttttcagtcttgttacattttgagtaaataaatcaaggctactttaaagcatatgcccatcacagcttacctaattgtatttttaaaaagaaaaagtgttttaaggtgagaaaatgaaatgtgaatgggggtgtttttgttttttattgtaatatttgagaatggagttttattaaatctttagctctgttacttagaacttaataaactaaaatttctgtaagaactaattaatttgcagagaaactcttataaagaaccactgtcagccaggcacggtggttcacacctgtaatcccagtactttgggaggcttaagcgggtggatcacctgaggtcaggagtttgacaccagcctggccaacatggtgaaaccctgtctttactaaaaatataaaaaattagccaggcatggtggcgggtgcctgtaatcccagctactcaggaggctgaggcaggagaatcgcttgaacccgggaggtggaggttgcagtgagctgagatcacgccattgcactccagcctgggcaacgagcgaaactgtctcaaaaaaaaaaaaagtggggggaggctgggcacggtggctcactcctgtaatcgcagcactttgggaggccgaggagggcggatcacgaggtcaggagatcgagaccatcctggctaacacagtgaaaccccgtctctactaaaaacatacaaaattagccggacgtggtggtgggtgcctgtagtcccagctacttgggaagctgaggcaggagaatggtgtgaacccgggaggcagaggttgcagtgagccgagatagtggcactgcactccagcctggttgacaaagcgagactctgtctcaaaaaaaaaaaaaaaaggaaccactgtcatcttagaaaggtgtgctcttgttctggagggcagttagtagtagtttagcaccttttttgtttgtagaattttagaggtgggtcagaaatactaggtgaccttaaccaaaatttaggaagagtatgcaattctacttgtttttttttttccacctttctcccatatcactggtaatggaggaagactcactgccttgtggtgcttgttagtgattagtaggtttctgacaagtgtgggtttattattaggagctgttgtggtggtctgggaagggttgctttaagattggtgaaaactctgcttctttgctacgcagacattgatattgtatcacttctttttttttttgaaagtaaacacgtttcatatcttcaccattttccatccatgtttttggagaaaacgtttgtctcagtgggtattaaaggttgggagactgcaatgataagtgtgtctgaatctctctatggggctgtttgtgagggggttcaaattctgagtgctcatcacacacctcccctattctaaaattattgatgcactgttattgatgggattgtacgggttgatagcctttctatagtgactgtagggctgtattcagccttgtagatccccctagtggtggttttgtaaaggctgtcttcagtgtcttatttcctcagaaaacaactggtatttctcacagctccttctagatttggacaaaggaatgatacaagagcaggtaactaaaagttaagaaaatgggacagttccttcatttttgagttaaagtcttgtggtaatcatttccagcctatcttttacctttcatgaaactttctatgaccacgttgacctgtgtattcattttaacaagtatttaataagcatgtattgcctggtactgtgttaggttccagggatgcttagataataaggtatgttttgtctactcaagtgagcttatactctagtggaggagagaaaaagtaaataagagagtgataataccatgagataggtgctgtgtcctggttgctggtgatgataaagaacacagacctaaggtgggcccagtggtttcagcttttttgtcacctatagagaatatattctttgaccctcttagaacattttttttttcttttttgagacggagtttcgctcttgttgcccaggctggagtacaatggtgcgatttcggctcactgcaacctccgcctcccgagttcaagcgattctcctgcctcagcctcctgagtagctgggattacaggtgcccgccaccatgcccagcatttttttttgtttgtatttttagtagagatggggtttcaccatgttggccggctggtctcgaactcctgacctcaggcgatccacccgtctcagcctcccaaagtgctgggattacaggcatgagccactgcacccagccctcttagaacattttataatcactatatatatgtataactactctaaaaatatggttaaataataatagctaacactgggtactcgtgtgtcaggtcagactgagctaaatgatttctgagtattgtgtcatcattctcatgatacttctacatgggaggtgggattatttatactttaacagatgaagggactgctacctggagaggtgaaggaacttgcccaagaataggcaactaggaggagccggagtaatgtgtgcttgctattagatatttaaacaatggaaaaatattacaaaagactgcaaactccatgacagcagggatatttgttttgtttatggatatatcccaagtactagaacagtacctggaacagaagtgctcaagaaatattttttcagtgaatgaatttgttgaatgctagcccataaagagaaatatttaacagtttggtatctgtttttctggactttaaaaaatatatactatatgtttttttaattttatttttttgaataggcaatacatggtccataaatcaaaatactataaaaaggtatacagtgaaaagaagtgctcccacccctgcccccattcccccctacctcaggtaatcactttttttagtttctggtgtttccttccagggtttctatatgcaaaaaatacatacctcctttcttacacaaaacgtatactatgcatactgttctggaccttggttttttacttacagtatatgattttttaaacatgcatatgatcatagtgtacaatagtgctttgtaacttgctttgattctcttggcaaaaatatattgcagacttctatccttgttgatacctttagttttacctgagaaacatttattatggattatctggggttaaagagatctgtagaccagtagaagtttcaaacttacatttgggaagtttagccagcatatttagggcaagaaagatttatgggtcataactgtttaaaagcagaatacagttggtacataaagatgttatgattgctgattaaactgaagagtcatctgaaaagcaaaagcagtgagtaccaagttgaccagttgtatcctcaaatcagctagcaaaaccagtaagttggtaaaaagatcccagtcattataacaacaaaaaaaacctaagatgtccaggaattaattagagatgtcaggatttatatgaagaaaatcattgaactttgttgaagggtgtaatataaggctgaataagtgtagacataccaattttgtgccccaaacaatttttttctttttattatttttataacttggccaatgttgatgagtggttgtgttcagttttttttattgatacataatttgttacgcatccttttgattatctttttgtttccataaaatttctaaagaggaactttggaatgggatttataggtcttcagaatatcatcttcatgacttttgatgcatgaacatacttcttaagaggtttttaagaggttgtacatagaaacttgcacaatggatgattattactgccttaaactagtctcaatttaataaaaagtacccatgtaacttaactgatatttacatgtagtagattttttttcaaaggttgacatagggaaagataagggaaatgatatgctggttcttaatgaaaaagggaatgtctttttgtggtctactaattgactgctttaagaagagaacctactgttagttcagtggattgttaagttctggagtagtgttagtttagaagcaataaaggattggttgctaaaggtaaaaagcaaaccttaaaacaataacctaaaaacaaatgggaaggttctgggcagagaattaacattgttaatgcagttcagtttcagttttctttttgtcatacagcagagctaactatttcctggttggttaatggaaagatgttatgctgtatcagctggaatctagctttgcttatgaaggtgtaatcacataggtgaaagatgttgattactgagttttctcacaccatatattaatcaaatactcttatttgggttgggtttctagagggaaatttcagtttgacttttcatttataatttttccgtttggttctaaacctataggggacattacattcagtacacttcatttttaaagaatatgttgcttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagctaacttctatatctctttttaaaatatatgtgtaattaaaaaaaaaaagtgtttcagaaagatccttcttttctgccatgtcataggagggagaggggctgctaggttcaggtttttgggggcatgatcatatgacctggttctgttacttattttcacagtaaccaaaggtttgatagtttgctgcttggcaaatgaagtagcttttttttcattttttttttttcaattaatcatagagcattgtcttggcatgtgtatggtgttagttgcatgcagttgctaaaggaatttatgtaaacccacatcagaatagatttttgacagctctgggctaatactgtgttagttgctaccgaaagtaccattattgtatttgctttactatcagattagattcaacatagaaattttgatctttggaataaatgggggactgatttctgtaattgtgagttttcaagtgaagtataccagaatttcccctttaattcattacaccacttcaaagcaacatgtttttggtttgctatctaagagatgacagtctcactataggcagcatattctaaatgggtcatataggttaagcacttgagaacccagttccttaatcacttggtgcttctattatctgtctactttttatttaccaaattaggaatatggttgacaaacagtgggtagtgatagaaaataaaagaaggtacattatagccacttgaacgtagattagtgctagagcacagctacctacttctgtttatattatctggagattgaatttctgtgcctttgtcaatgcttactaaagtgacttcattttgactgtgttgtttcctgaggttgaatcctattcaaagattagaaaaagtgatagaaatgaaatgcagctaattttatcctggtatttattgggtagattttaataatcgaataccgtaaatactgtaagttttagaacttgtgtcaaaatgttcccttatgtggtggcatgcgcctgtagtcccagctgctccgggggctgaggcaggagaaatggcgtgaacccgggaggcggagcttgcagtgagcagagagcgagtcactgcactccagcctgggcgacacagcgagactccatctccaaaaaaaaaaaaaaaaaaaaaaaagagggttcccttaggtctcaaaaagtatattgatgaaaagaagttgaactaaaatagaagatttgaaaggctattttacgtgagctgatttagtcgtattgtttaactttattttacatacttagaattgtataagggaagtattcagtatggataactacagtgagtcactttacaatttatgttcttttgacacctgaatattttaagaatttccttttaaatacctgtaaattaaaataatttatcctgtgtagttaatgacaatttttgtaagttagctaagagtattgcctgtagaattgttaaaaatatgaacaaaaccataattaacctttaaagataacttgcagaatctgggggatgagtaggaagggaggttgctaaaatgtcatttttacagataaataatttggggagtattgaaatattctctttagcttttggttttgtaattcttagctttaaggaaatgtgatatgtaaagaaaagaaaaatattccttttctttgatactttgagcaatggtgacatgttactctcttccatctgattatactcccatttagaaaagaatgaggtgatgccagttataaataattataactttagtgctttccaaataggattaacagtcgagttaattaatgctctttaagaaaccaaatttccactttaaaaaaaaagccttaaaaatgtaggacagtaagcaatatcataggatggtttttgaatagaatacaagccaagagaagcttgattctcttggtatattacatacagagagggcaattaatttcttgtacatctgggaatatgatggtgttcttgaaaagaaatgattcttggtttataaaagctcttgaaaaaatttgaaagtagactgatagtttttttgtttgtttttaaccagtaaatggtatattgattggacagcagagctagatctttttaacttcctcatcttcactatcacatcctatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttcttagatctcatctgtgtcttgtatatccacgcataatggattgaaaccctttgagtgctaagttctcaaggtttccctcagcgtagtattcagtgtactttggataatgttgaatctatagataactctgtgctggcatgattgggaggaataccctacagataacatgtagtttcaggtagaataggagcattgttcatatggcttagtaaaatcgagagtataactcttatatacattaaatccctttcttctcattataatattaatagtaccaaagaaaacttagaaaatatagaaaagtataaataagaaaagcaaaattaccctgaatcctgctactcaaaaacagccacttctaatattttgttattttccttccagtcatataaacaggtatatgtaaattgacaggggctcctactctatgtgtattgtatatatcttgcttcttttcagttatgttactattttttccatttcttaagagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaagaaaagaactatcttttcagctaaaatgagaattacagaaatgctgacttcagcattgaatacataaatatgcagcagaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgtagaggtaataaaacagaaaacacttgaaaataaaatactgaaagtcccttgtaacacaaacatagattttgaatttttttctcatcctttcgtatctgtttttcttagcataaaaagatgcaaatatattacttcagctaatcaccttaattttttggaaactataaactcaattttcctcctaattaaaagaaaattatgaagaattatatttttatttttacttgtttatttttgagagagggcctggctctgttgcccaaactggagtgcagtggcatgatctcagattactacagccttgacctcctagtctcaagcgatcctctcacctcagcttctagagtagctgggactataggcaagggccaccatgcctggctaatgtttgtattttagtagataacagggtctcaccatgttgcccaggctggtctcgaactcctgggctaaagcagtcctcctgctaataattttatttatttatttatttatttatttttttccgagatgggatctcgctatgttgtccaggctggtttcgaactcctagcctcaagtgatcctcctgtcttagcctcccaaagtgctgggattatagacgtgagccaccacaccaagcttgaaaaattaaaaaaatatatttttaaatgattttatttttgatctttgtgggtacataggagatgtatatatttatggggcacatgagatgttttgatacaggcatataatgcatgataatcacatcatggaagatggggtatacatcccttcaagcatttatcttttgtgttacaatctatactctgttagttattttaaagtgtacaattaaattattggctacagtcaccctgttgtgctgtaaaatattagaccttattcattctaactactttttgtactattaaccatcctcaccttcccccaatcccccactacctttcccagcctctggtaaccatccttctactctctgtctctatgggttcaattgttttgatttttagatcccacagataagaacatgtgatgtttgtctttctttgcctgggttctttcacttaacataatacctccagttctatccatgttgtctcaagtgactgaatcgcattttttttatggctgaatagtactccactgtgtataagtcaagcataaagaattttaagcataccggaataatacaggaagttcccccattgtactcattcctcagtttcagccattatcaagtaatgaccaatcttgtttcattcatactcactctctttcttcattctatattattttgaagcaaatcctatattagttttatatgtaaatatcttagtatatatttccagtaaaggtttttaaaacataaacacagcgcccataatgattaattcaaagggtcttaaattcttaaataggtctacataattttctttgtgtaaatgttctgttattgattatgttggtttaatttttcttctagctgtttaaaaaaatagaagggaacatctttgtgtttataacttttctcatattttagtttaagaaatttgtagaatttctagatcaaaaggccatattacagtgacaccagagtgtgagaaccagggttactgtgctggctagcagtagatgtcatagtttaataaactttttgctgatttaagaggcaaatacttgttctggttagggaaaaggtgatattagtggggcagaagcattcttttaacgatatatatttattatcttctgtaacggattttctgtgttacattgtgtgttgtgattttaaacatttttgtaggtcaaggggtctagccttttcataaactttctttttttgagaaatgtaatatacagaaaagtatgtaacacaagtaagtatatagtctaacatcactaaaaccaatactcatgtaaccactacacagattgagaactaaaacattatggcatcccagaaaccctcctaccccatgaattttgtctctgtcaaaacctctttccttctccccagaggtagctactgtcctgctttttatggatatcactttttttttgctcttttatttattttttaaatttttatttatttattttgagatgaactcttgttctgtcacccaggctagagtgcagtcatgcaattcggctcactgcaacctccacctccaggttcaagccattctcctgcctcagcctcccgagtagctgggattataggcacccgccaccatgcctggctaatttttgtattgttagtagagatagggtttcaccatgttatccaggctggtcttgaactcttggcctcaagtgatctctgccccatcggctcccaaaatgctgggattacaggcatgagccaccatgcctggcccttttaaagtgatgaatacatccctaaacagtctagtaatctggctttacttgttttttttttttttttttttttttgagacggagtctcgctctgtcacccaggctggagtgcagtggcgcgacttggctcactgcaacctctgcctcccgggttcacaccattctgcctcagcctcccaagtagctgggactataggcgcccgccaccacgcccggctaatttttgtatttttagtagagacggggtttcactatgttggtcaggctggtctcgaactcctgacctcttgatctgcccgcctcggcctcccaaagtgctgggattacaggcgtgatctaccgtgcctggccctcattttctttttacctagctttataaatacttgtttaaaacaatttaacatttggactgattgtgtaaagaccacttttaagtgttgttactgttttttgttgtgttttttttggccaccaaaacattgggtaattgttgtcttagacaatctctgtagttttggtttaaccagtgtacctatcagttgtttgctgaagcttcttgtccatagcataatgtgataccttcacattacattttctatagacaatatatatatatttttttaaatttttgagacggggtctcactctgtggcctgggctggagtgcagtggcactctcatggcccactgcagccctgacctcccagacttaggtgattctcccatctcagcctcccgtgtagctgggactacaggtggacacaaccacgcccagccaatttttctatttttcgtagagacgcggtttcaccatgttgcccaggctggccttgacctcctgggctcaagtgatctgcccatcttggcctcccaaagtgctgggattataggcatgagccaccatgcccggctgaaaataatttcataaatacttcaaaactggctttttaagaagacactcagtgaagacacttagtgtatcactggtttttatgttctaagcataatgaaatatatgtaaacaaatatttatctttgtgacaagttcattagagtgacatggcaaaacatttgagtttttaagtttttgaattatccaatcttcatgtgatctgttttgataactcctcattgcattggaaagtattttattgcttggcagcattttgaaaagtaattagggtacatagcttttacaagttgttttcttttaaaaaaattttaagcatcaatcatacttcattttaggttattttttttttttccgtaagatctgggtttcttttttgtcattctaagtaactttgttgaaagtaagattgttgaaagttttattgcttcaaattctagtttaaagttcataaacagcttattgagatacagataaatctttcttttaaatatgtcgaacctatttccaccctggggtctttgctttcgcttcctctttgaaatctgttcagtcttcacatagataaaaggttattcaggtcccatcttttcagatgggatgtcccctaccatccagtctgaagtgttcttcccaatcatctgctgttccataccctgttttattttcttcacagtgttcattgttatctgagttatttcatttgtttgcttatttgtctgcccctgcacctctgtgagaacagggactgtagctgttttgttttctactgtgtatgcagtgcctagaaagatccctagatactctgtagatatctgttaaatgagttaaaacaggaaagccaaataatttttatgtatttgggcttgatgtaataattgttgtttacaaataaaaattagaaatacttgatcagttgtctttgtaaaccagagtagcacctcttttttcccagtgatttaaaattatatattattgttcaaatgagtacactaaatacatctccaaagttaaaattgtggtagttaacatgacctgacttcactaaaaataccttttgctatggcataggtgggacaaatgaccttctacccaagagacagttgagaatctgtgtgtacaacaactgtgtgattagagtataattaaccttaactcagggatgggatagctgacttgcttatgcactttctctcaattagggaatctataaaaatatgtcatgagtcgatgttattcaaggacagttccctggaatacatcttagggtcagtgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcactttgggaggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagactccatttcaaaaaaaaaaaaaaaaaaagtttatataatgaaatggaaatgcttacagtgaaatattacaggaacattccattttagctactgtatgatctcggcttttaaggatgtgtgtgctaaagaacataatcttggctctatcacttgctgtcatgtgactttggcaaattacctaacctctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacattttgttttttattttatttatttatttatttatttatttttgagacagagtcttgctctcgtcgcccaggctggaatgcagtggcgtgatctcggctcactgcaacctgcgcctcctgggttcaagcaattctcgtgcctcagcatcccaagtagctgggattacaggcacatgttactgtgcctggcaattttttgtatttttagtagagacggggtttcaccatgttggccaggctggtctcgaactcctgacctaaagtgatccgcccaacttggcctcccaaagtgctgggattacaggtgtgaaccactgtgccaggcctgttacatgttttagagtaatacaaaggctcttgaaaatactgagtgaagcctccaaagttgtattcctgtaacttgaaatttgtaagaatcagactctggactttcatcttagccaatcttcaggattttatggaagagaattctaaaattaatagcttttcaaattaagaacctgataagcctgaaatatttttcactagttatatattcaacctgtttgaattttactttataatataacctgtttttgaaagagaaaggcagttgtaattagatagcctaaatatatttttaattgtgtgtcatcctcaacattttcattgtcagtgattgtaaattggtagaattaactgtgtctcataacttattaccaggaagttgcttaggataaaaataatgtagccccatagcatccataaaaatggaattgcctgattacctcacaacagcaaacccagtttctcatttccagttatagttcagttaaagaatgttggaatttttttatatgacacttttaaacatgccaagtatagcgaaaataataaaccacatgtacctatcatccagctgcaacaattatcagcactttaccaatctttaatgtgtttctcccccaacttttttttcctggagtcgttgaaagccaattccaaacagcatagtcactcataaaatatttctgtgtgagtaactcataaaatactcctgtgtaactcacaaatctatacagacttctgaaaaacataatcgcggtgctatttattacacttaataaattagcatcaattccctgttaaaattttcaacaatagagcatcagttatagtctgttagaacaatagaataaagcaataaagtattatatttattgataggatatccatgtgtatagaaaagttagttattaaacaatacataaggcctgatttagtggctcatgcgtgtaatcttagcactttcggaggccaaggttggaggattgcttgagaccaggagttcaagaccaacgtaagccacaaagtgatacccccatctctacaaaaaaattaaaaaattagctgggtgtggtggtgcatgcctgtagttttagctacttgggaggctgagatgggagcattgcttgagcccaggagttcaaggctgcggagagccatgatcatgccactgtgctccagactaggtgatagagtgagaccctttctcaaaaataaataaataaatagacaatacatagactatgatctcatttttgttaaatgatatcatgatatttgttatttgtttatatgtacccataagtctagactggtatgtataatggaattgtctctatgaggtggaaattatttgtattttgcagtttttttccacaagtaatttctgtattggttatttatgctgtattattattatttttgagacagagtcttgctctgtcacccaggctagagtacagtggtgccatcttggctcactgcaacctctgcttccagggtttaagtgattctcatgccttagcctctccggtagctgggattacaggtgtgtgccaccacgcctggctaatttttgtatttagtagagacggggtttcaccgtgttggccaggctggtctggaactcctgacctcaagtgatcagcccaactcagctcccaaagtgcaaggattgcaggtgtgagccactacgcctggccttttgttgttattttttaatggctttggatttccttatatgttttgtagtccattttgtattcgtgggccaagtttgttttgagagaattcactcattttattatttattttttcttcctgtcattgcttcaccctatgtggcaattttgccttaccctggcatctgggattcacatctcagaaccaaatcttataaatttaggaagtagggggactttgtctcctgaggaaattgagttccattctgcaggtatgcttggggcctaattcctgattgcctagatttctctgaaacttttccctgccgtgggcaaatattttattcctaggtgtacttctgaattggctgtattttaccagcacttgatttatgggcaggtgcccacttgtagcccccagagagtttggctgttgtctctctccatattattccaagaagtcaaattcctgttccctgccctttgtttatggtcttggtatacccctagtacctcctatctttagtctctgctctccactgtgggttttatttatcatcagtttggatgtatggattgtttccatatgaatttcatgatcagtttggagaggatgactattttaaatagtttttctgttatttgtatgtggttgaagcagagagagaaggtgattatgtatacccacttaacccatcttgactcagaagtctcttgttttatttatgtaatttaaagtgactggatagagaactatggtgttgaatatatactgtgtgccagatagtatttataaacttaatcagatatggagtagtatttaaaacaattgagcttaaataatgtggaatcgtgcaagtgtaatttcttggatgtcaaatagatacattgtgacttatttatattttggtacagatggcctttgaaaagcccccaaggtgtgagacaagtcatcacttgataaaccactgtcttggacagatcttaatagtgatctcatacttttaccatgaaaagtagataaataccttgttggacaagatatttggaatttaaaaaaatctcatttgtgtatattaactaagattttaaaataattatgtctgtttaccaagtatattactgttctttagaagagtcttactagtcagaaagagacagttacaagtacaaccccatccacaatttcactttccatggcttcaggtatccatggtcaaccacagtccaaaaatattaaatgaaaaattccagaaacaattcataggttttaaaatgtgcgctgttctgagtagatgatgaaatctcactccattctgcttgggatgtaaaaccttttgccagcatatccatgctgtctacattacccacccattagtcactgagtagcgagctcagttttcagattgactgtcatggtctcacagtgcttgtcatccagtaacctttatttagttcataatggccccaaagtgcaagggtaatgatgctgggatattgttaacattgttctgttttattattacctgttgttgttaatctcttactatgcctaatttgtaagttaaacttcattatgaggtatgtatgtataggaaaaaacatagtatatgcacagtactatctaaagtttcatgcatccactggaagtcttggaacatatcccccatagataagggaggaatactgtataccttaaaatttaaccattggcattttcttcattcgtttttttgggtagcagtaactaagggatttgtaagttatcagattttcacaggagatgatattattggggtaaattgtatgtagatagcatgcacccctggaaggagtgcccacactttgagtacacaaatgtgtgcatgcacatacacacacacacacatacacacacacacacacattcccctttttaattaaaatgaggaaaacacacttggagagccataatttcattttataagccaagaagctaggactaaattgtggtttttttcacccttctaagttgactttttttcctgcttctctcatgacatagtagtcattttttacttaacgaaaatctgatgtaatgaaatgacattttacaagctttaaatgaagcaaatgtttgaattctctttaagtggccttgttcttttgctttcaaaagtaaaatatgttttgttttgtgttatttagcactgggcgtttcaagtttttaatagctttattgagattttgagagagaattcacatgacatacaagtcacccatttaaattggacaattcaatgattgttagtatattcacaacattgtgcagtcattactactcaattttggagcattttcatgactgtggaaaaaaactccatatacccttttaactatcacccccaaatctccatttccattagctctagacaaccactattctacgctctttgtagatttgcctattcagggcattttatatagaagagaattatgtaatatagtcttttatgacttacttcttttcactaagcataatgtttcaagcttcatccatgtagcacataccaattcttcactcctttttatggctgaatagtgctccacacacattttgttcatcagtttatccattgatggacttgatttccactttttggctatgttatgaaggatactgctatgaacatttgtgtataagtatttgtgtgttttcatttctcttgggtacatacctaaaagtggaattgctggattgtaagataactctatgtaaactttttgagaaactgatagactgttttacaaaatggctgcaccactttacattctcactagcagggtgtgagggttccaatttctctacattctcatcagtacttgttatctgtcttttttattttagccattgtagtaggtgtgaagtataatcttattgtggtagttttgatttgcaaacttcctgtgttaatattgagttgggtttgtttttgaacacatttattttagaggaaggggcagcagatgcttctaaaccactggtggactaggtcagagggtattatgaacctcatttaaatttattcccaattaacactcattgtgattccctaagtcaagtagaacttagaatgtccttagcacaatcttgtttatgttcaggtgcatttttcattctggattactgtttcctaatgttaatttaagattatatagtattgcatttaagccttgtcaaaggaaaatggcaaaatttgactcctggttgtaaaagacaatatcctaaagatgttgtcagtgatctttatgagacacacatctttgttaagtaacggttttgtaataaattcagaaaacatggttaaataaattaaagcagaaattagctcaggagtggtggtcagaaatattttttggatctgagccaaaaagaatatttaaagcctttgattactttgaattgcctttgtcaacaatttagtcaaattatgaaaggaagacagtagcatttcaataatagctttaatttttatcatccagtgtaacaaatggaatctgttatggtatccgttatcaatggattagttacagtgtgaagtcaggaggcaatgcaggttttagttattagtgaacctaactgaataattttaggtcttctggtttgagtgctataattacgtaaataatctgtggaagggaggtttgctgaggtgcccaatgaatcatttttactgcatctacagatgcaagtcataaagtttaatccgtgtgggtaacctgtaatatgtgctgctgatgttagcatagattcaggctgaaacaatcctaattgcgattatttacaacacattggagagagcctatgtgtgacatattacttggttatttttttaaatgactcgtgggggtgggggagtgttaatgttaaaggcatacttgaatcttggagattataattaagttttattccctactcccagataacattatatatatatatatatatatatatatacacacacacacacacacacacacacacacacacacacacacacaccatacttggttagtgatgattaaaaaaaagtagttgtggagacctaaatgtaaaacacaaaactataaaacttctagaagataatataagagaaaaagtgagaactttttttttgagacggagtcttgctctgttgcccaggctggagtgcagtggtgccatcttggctcactgcaacctccgcctcctgggtttaagggattctcctgtctcagcctcccaagtatctgggatcacaagcttgcaccatcatgcctggctaatttttgcatttttagtagagatggggtctcaccatgttggccaggctggtcaggaactcctgacctcaagtgatcctcctgcctcggcctcccaaagtgctgggattacaggagagagccactgtgcctggccaagagaaaaagcgagaacttttaagatacaacatcaaaggcatgatccataaaggaaagaattgataggcctgacttcattgaaatgaaacacttctgctctgtgaaagacagggtcagagaatgagaagacaagccacagactgggtgaaaatatttgcaaaagacacatctagtaaaggactgttatccaaaattacaaagaactcttaaaactcaacaataaaataatgcaacaataaaataaacaatgggcagaatagactgggcatagtgattgactcctataatcccagcacttcgggaggtcaaggtaggaggattgcttgagcgcaggagtagttcaagatcagcctgggcaacagcaagacctcatctctaccaaaaaaaaaaaaaaaaaaattagccaggcatggtggcatgtgcctgtagtcctggctagttgggaggctgatgtgggaggacccttgagcccaggtgttcaagactagcttgggcaacatagcaagaccccatcttaacaacaacaacaaaaaaggcaaaagacatgaacaaacacctcaccaaagaagatacacatatggcaaacaagcatatgaaaaggtgttcagcatcataaatgtgtacaaacccatagaatgtacaacaccaagagtgaacccttacgtaaactgggttttgggtgataatgatgtgtcagtgtaaattcattgattgtaacaattgtgccactgtagtggggatgttgatagtggcggaaggttgggtgtggggacagggactctgtactttctgcttaattgtgctgtgaacctaaaactgctctaaaaaagtaaagtttattaatttacttctttaaaaaagtggttgtagagctatttaccttttcaaatgtttgagtccctgctttgttctgtactgggtaatgccttccaaatgtcatagcctagaagttctgaaacgaatggactgtgagaaatttgaggaagtagtggtttcacttctgggtgttgtgggctttctgatttctagaacctgactttgtcatgctttcttttaaatttaaatttttttgtggagttggggtcttggctggtcttgaactcctgggctcaagtgatcctcccacctgggcctcccaaagtgctgggattacaggcatctgccaccatgcccctgtcattgctttctttactaaagtattttaggacctaatagtccaggaaatacatatatgtatattggacaaattcatgtctgtttaaagaatagggtagtctgagtgttgtccttcattggtgctaattgggaaaagttttttgaggaaatggacactgagtagagaaataggagtaagtaggagtgcaatttgttatttggagagtgtatgttattgtatgtttttgtggttcatgtaaataccatggttgaagatgatcagaattttttcaagcatctgaaaattatggtttaagttctaaaactattgtttatcatcaactaaaaaattatgcattctcagatttctcttattttcaagattatttatgcttgcttgtattgggccccttatgtacgtaatgggactttaaaaaatattcatgtccttttagatagggagtatagccacatggttcagaaattaaagtgatttaaaaacagtggacattgagcagccttgcttcagaacctgtccttgttctcctttcctgcaaattctttttgtgtaatcttccaatgctttttaaaaatgcaaataaacaaatattttaggaagatttttttttccccagaaaaaaaggtgatgtgatttattatctgtaatttgttgcatattaaaagaacattccagtactttcataaatataagggtagatatggcaaccccttccttactatgccagttcttcacttggttgataaaagtaaaattatttattaacgccttaactcatcctgaaagataaatgactacgggggaggctaaaaacaaaataagtaactgtatactatgccaagtttgcaacaacctcatgaaagtatgtacacttagcattcccattttatagataaaagaaactcagcccatataattagcaggtatcggtgatgggatttaaaactgggccttttttttccttaaaaattatgaacatttacaaacaaagaaatgtagagagaaactaatgaagtcccatatacccatcgcacggattaagtagttacaattttatatttgtttgatctagtctttttgttgttgttgtttcttaagtattttaaaacaagtcctggatattattttgcttctatttgcttaaagtacgcatctctgaaaaatgttgatctctcttatatagcgacagtgccattttgttaaactcctccaaataagcaaaaatgataagacaaaaagttggccaggcgaccaaagctatcaactccagcctaaggaaaattcagcaatttgattatgaaagggggagggggacttcttaattgtacattttacacagatttccacaaggacagtaatagctgacccacttcgaactagataaaagatacagaggcgtgtggcagccaaagccatcatgatgttgacatgatcttcttggtgagctccaagccacctttcctaactagttttagaccaatcacaatgtacataaaagtttacatgttttaattaattcttttcatgtgagaggtataatgaaactgagttttaaataagtcaggcattggtttttaatgtatggaatttttctttatgaactcatagtatgaaatgttttttcttaaaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaagcatatttcaatttcagaattggacacttttccaattttttttttaaagtatgctaaacatggagagaaaactaagtgagggtggtattttgataacttgtagacttttttttaattttagggtaaaattgaactgtgtgccaggtttcacactgatggggaattttttactgcagagttaaactcctgactatagacttttatgatggaaacacgtggcacccatcttccacgtctgaaggcataactagtgattcattcaacccctgttcttaacctcttcagtgtggtaagcaaatcacactggctaagaaaactgcagtggccctgcaggtttctctacagtacatgcaaattcctcccattagtttcattgtaatattgatgaatgcagatggactatatgactgtatgttctgactggaaaattagatgcagtctccattgtgacttatgttcaggagtttacaatttagaggtagattaggcatattcattgagagaatttgattttttaaaatttggggtgataccattaatttgctggtttcagtgttataaacatgcttttactgaagaatccagaactattattaagtttcatattctcatcagttgccaccactgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaa

SEQ ID NO: 1994 - DNA, 32210 bp, Homo sapiens
ggagttcgcgcgacgaccgcggggtcggcgggcggggcgaggccctggacggcggcggcagtggggctcctccttctgtttcccagaccgagagccgcgccggcaccatgtcagcttaccctaaaagctacaatccgttcgacgacgacggggaggacgaaggcgcccggccggccccttggagggacgcccgagacctccccgacgggcccgacgcgcccgcggacaggcagcagtacttgcggcaggaggtcctccgcagggctgaggccacggccgccagcaccagcaggtccctggccctcatgtacgagtccgagaaggttggggtcgcctcttccgaggtgagcctggggcagggctggtgtggactcgccggtctctgtgctgtcaaacggagacgagaaatgttttgctcacaatcttttgagaattctcaagttgcctagcatagattcttgcaccttagtgactcgatggtggtaacaatctgttaactatgtaaaggtatgtgcatctggagtacttgaagagggcagtttaccccagaaatcttccttagctattagtctgcttcgttgattttttttttcttacgcctagctcacggggaaacgccagattattttctgtccaggtgagtaaaaattctgaacagcaggtcctaggtttgggaaatggagagtccgtttcttcgacattatttcctgtgcaaaatctggcacagggttttggccattccttccggagtgagccagaaagagaggactatgtgcctgcgagtgtcaggtgataccctgaagcatcagggcaggtggtccacgagttcttcccgcatcattgacatctccacctaaccaaccaatagaggtattgaagtcccttcagcccagacagctgcctagttgaccaaagcctgggtttgattgagtccagggtcttacctttacttcccaaatcctagacaaatagtgtgcgggttaagagtttgttgctccaactcatcttcatcagttcttcccatccttagatttcagagagtagtaccttcaataacaattattctggccgagcgcagtgactcacgcctgtaatcccagcactttgggaggcctaggcgtcggatcgcctgagctcaggagttcgagacccgcctgggcaacatggtgaaaccctgtctccactaaaattaaaaaaaaaaaaaaactagccgggtgtggcggtgcgcctgtagtcgcagctactcaggaggctgaggtaggagaatcgcttgtacccgggaggcagaggttgcagttagctgagatcgtgctgctgcactccagcatgggcaacagaccgagatcctggagggtctttttctttttcttttttttttttttttgagatggaatctcgctctgtcgcccttgcttgggtacagtggcatgatctgggctcactgcaacttccgcctccgggattcagacgattctcctgcctcagcctcccgagtagctgggactacaggtgcgccgccacacccggctaattttttttgtatttgtagtggagacagggttttgccccgttggccaggctggtctggaactcctgacctcaggcagtccgcccgctttggcctcccaaagggctgggattacaggcgtgagccaccataccggtcgagaatgattctttattgtacaccacagtctctcttcagcctgctaatgaaacagttttgtttggacagagaaaaaaaaaggtttaaaaaaatgtataagccaggcgcggttgtacttctgtaatcccaacaatttgtaaggctgaggtaggcagatcattttagcccaggagtttgagaccagcaggggtaactgcgtctctacaaaatttgaaaaattagccaggcatggtggcacacacatgtgagtgcagctactgaggaggctgaggcaggaggaccgcttgagcccaggatgtcaaggttgcagtgagccatgttcataccactgcactccagcttgggcgacagagcaacacgctatcatttccccttgctgttttcttgggttaattcccttccccacctctctctgttcatgtatccctcattgatccacctccctgtggttttttttttttttttttgagacagattctcgctctgtcaccagactggagtgcagtggcaccaacttggctcactacagcctccgcctcctgggttcaagtgattctcctgcctcagcctcctgagtagctgggactaaggcgtgcactaccacacccagctaattttggtattaatagagttggggttttgccatgttggccaggatggtctcgatctcttgacctcgtgatccaccacctcggcctcccaaagtcctgggattataggcgtgagccactgcacctagcccacctccctgtgtttaactgttggttttttatttttgttttgtttgagacaaagtcttactctgtcacccaggctggagtgcgatggtgtgatctcggctcactgcaacctccacctccccagttcaaatgattctcctgcctcaacctcccaagtagctgggattagaggcacctgctacaacacctggctaatttttttgtttttgtttttgtttttgtttttttggtgttttttgtttttgagacggagtcttgctctgtctcccaggctagagttcagtggcgcgatctcagctcactgctacctctgcctcccaggtcaagcgattctcctgcctcaacctcctgagtagctgggcttacaggcacccgccgccatgcccagctaatttttgtatttttagtagagacggggtttcactgtgttggtccggctggtcttgaactcctgacctcatgatccacctgccttggcctcccaaagtgttgggattacaggcgtgagcgaccacacctggcctctgatttttgtatttttagtagagacaggtttcgccatgttgggcaggctggtctcaaacgcctgaccttaggtgatctgcccacctcagcctcccaaagtgctgggattacagatgtgagccactgcgcccggtcctaaccttgttagggaggttttgcctgtagttcttacatctcatacctactggattcctatgttccattctaaatgggaagtcttggcttagatttgagaggattgcctgaggttttagggccctggtgaatgggtcacatgattgaggatctcaagcccaaggaattcaactaacaactatttaaggagacatctttgtaaactgagaacaaatgaagtagggaatcaatgattcaaagtagggcattgtggcagaggataaacttgaatctagcttttaaggctgaggtttacacaagaggagtgagaatgagggatgttcttagggaagacaggaaaatatgcaaatgcactggcccagcaacagagctcctgggtccagaggagggacatgatagactgggtgtgttagaggacaggggatggaggaggtagcttaggagcccttggaggtcatagggaaagttctggtctcatagcgcaggagaggcaaaaatgtaatagtggtgagtttgatatagattgtgatgacatgccccgtgctgcccccaaaggtctttctatgcagtggggacagtgagagctgaggcagagtggcacttcaggcatatcaggcttggccaggccaggcattgctgtgagaagtacagtgtggtcatgactgggcaggtgacaggtgctcttgtcagtgagacaacatgttggaattttccaggattgggtcagttctcaattatgagaagccctgggagtcagggatgacctacatctccaccacacccagtgttctccaagctgtctttgtttttgtgttttgttttgggggaggttttttgagatgggggtctcactctgtcaaccaggctagagtgccgtggtgcaatcttggctcactgcagcctctgcctccaggtgcaagtgatcctcctgccacagcctcccaagtagccaagactacaggtgcacgccaccacactcgactaatttttggtatttttggtggagatgggctttcgccatgttacccaggctagtctcgaattcctgagctcagatgatctgcacaccttggcctcccagtgctggattacaggctccaagctgtctttgaatcactctaatcactctttcattccctttggtgttgggatgggaacagaggagtatgagctcttccaaccctcagtgcacagtgtggcttccagcaaattccagcataccctgctaatcacccaacttaggtgcctggttaccccagcactgtgaaacatgccaacacatgacagatttatgtcaaagatgaggactttacaaattatattaggttgggaagattataattcagtcccagcttggcaggaaaatggcttagttaagtcacctctagcaaagagagctgcccttctcctactgtgaaacctggcaaggattgtttctcacaaaggctcaggccacaggctatgaccacaaaagaacagaggagaagtagtgggagcagggcggtttccccaggccgacctggtaggcgctttgtagaactacagggagacttgtaagccactcgtctctttccctgtttagtaagcatgatttcttcttttttttttcctaaggtttaatttttatgaagagagattccaatcacatggttcaaaatttcaaaacatacaaaagggtgtagtcttctcccacttccctccctatcatccctctgcccctaaggcagccaggcactttccctccttcagtgttttggggagataatgccgtggataaaaatgggtttttttttttaagtgaagtattgtatacattctggtctgcatgtgcttaatagaatggagtttgttccacactagtatgtaatgagctgggctttctttttggctgtgttgtattccattgaacaaatgacttctatttatgcagcctgtcccctaatgatgagcattgaggttgtttacaccttttggtgagtctatttgcatcctacttggacatggtttttgtacaccttttcatcactccagtggaggagactcacctgcccaggacactctgcttcccctcttgtagctgaacttaactccactgaggttttctggggcccgagatctcggttcaggggagtccagcaacaaacattagaccagggttggaacggctggcacagtaacatcaatggaaagggacagagtttgagagttcaaacgtgatgcactcagcagccaccgccagcacatcctccacaccgtctcgtgcaggggcccacccatctctgtgtctttccagcacacaacagtcacccacactgggcattccattcagaggtgggagagaggaggacacccctcctggcccaggagcagaggccatcaaggtgtccccggaacttagagtagatacattgccaaaaggtgatatcctcattctcagggattctggtcttggagcagcccactccaaatgaggggccgtacagaccaaagtcacccctctgaggcagcgtgtggtgatactgatgcagccagagttcttagcaaaagttgatggatggggacaagcagctgctagattaagtaattcctcaaatttgtaaatgtcagcagtggaagaggagcagtctcttacccatctcttgctcaactttctacccccacgcttctcagcacaatgtccttaagcgttattggcgctcccaaaatagttgccaaatgaataagtgacctggggaaggaaaggaaggagggagggaacagaagattgcctgaaaaaggaggagagagttgggtggaaagaatgcattgagctgtgtgccttggttgcaatgcctgtcctgtgaccagaaaatgcatcccaacacatgtcaggctgtgtctagcaggtgggagggagtctggtggagaaatggcattggaccacatactcaccgctaggtctgttcgggatttatttttaattaatttttggtaaactatcaatgattgaatttgaccattgatggccaggtgtggtggctcacacctgtaatcctagcacttggggaggctgaggcaggtggatcccttgaacccaggagttcaagatcagcctggggaatgtggtaaaaccctggctctacaaaaaatacaaaaattacctgggcatggcggtgcatgcctgtagttccagctactcagaaggctgaggtaggaggatctcttgaaccagggaggtcaaggctgcagtgagctgaggtcatgccactgtattccagcctgggtgacaaagtgagaccctgtctcaaaaaaaaaaaagaattagaccattgatcccaggccaatttgctggcttgttggctgtaacaggatgccttctgaggatgggctggttgttcgagcttctggcttctccttcctgggcacatccactcacagctgccacattgtcccaaggaaccttgctttgctgaccaggaaacatgctgtgacaagctgagcggccatctgctatacagctttctgcctctgaggtgttcttagagtgggaagtgttgtagggaggtgtttgggggttcccaagactaccctcaacttcactgattcactggaaggatgcacagaactgttacacgtatggtgatggtttcttacaatgaaaagatgctgattaaaaccatcaaatgaaaaaagtgcatagggcagcgtccaggggaaaccaggcacaagcttccagttgtcctctccccatggagtcatgtggacaacacttctccaagcagtgcgtgacaacacacacagagtattgtcaaccaaggaccctcacttaagcctgggtgtccagagttttttggggagtctgtcacataggcatggctgagtatagtctccaaccccaccagaggtcaagctgataacgtgtagcccaaggccaccatcatatatcacattgttagcatagtctgtctgacctggtctaagcttaggctcacttgagcaaggacactcttatcaggcaggatattccaaaaacaaggaaccaggctagggccacacctctctttggaatgtggagtgtatggacaacccagagctgctgagctagccttttgctcagccccaggttggcctgcacacagacggcgaggggcaccagcactaccgcctttgcccttggtggtttttcctgcaccctaagacccgatttgtctctgaatccaccccatactccagctgccacagtcagagccccgggtttgagcatctgccatgggtgctcacgtatccctgccaaggcttgtgcctgtgcacactcccttgggaagggagagatggaacaaagataaatttcagatttctagattcagctcactgactccagattggcctccgtctacttatgatgaacctcatttatcagaacctgagtttacgagctcagtatgagaaacacagtattgatgcccttccgtcaggaacctggggaggtctcggtcacggaagcccacctgatgttataagatgtgttggctgcgagttgcagttgagatctgttggtcactgctgccctttgaaggccttagtgacatcctgtgggtgttccctgccgagtcctgtgggtagccccgctcactccccacacggttcctctgcccctgcacaagctgcaccctctgcctggtgcccttgccccaccccaactcttcgttgtgatttgtttttaggaaaactaagtccaaatggacaggacccccaactttctgactgcctaacttctcagtctctcctccagcctcaacagggagcctctctgacccccaccttaagctaaacaaagagtctgcagggagaggtgactctgtgtgtgtatgtgtttgtgtgcacgcgtgcagtagctttagtttctgcctcccccacaggactgtaagctcagtgaagcaaggactcatctgcctttcttggattccgagcattgcaatgttgtcaacaaatgaaaagctgagattgaacctcactcatcttgctctctgttagactgtaaacaccatcaggacagagacttgggattgtttcgtggacaaagagagaactcttgttggggttcaagggagtaagaagggcatcacctgtaatgcttagtaatcactgaaacaaggaagcactttgcatgtgcgtcctttacactgagggcacctgcggagctcactcccctagcagccacccaagtccgttcagggacctcattctcccacgggaagttggagaagatgggccgtggctctgcggaggggggtgtggacctgcctcggtacctggagcggttgaggcctgtcttggtggtggctggggcacaggtgtctgcctggcctgtccttacagactgtcagtgttctctttcctggtattttggtgtttgctctgtcaaacccttcttcctcattggttggaactaggtcacaagcacattaagtccggtcatttcctctgccttctgggggtggattttagcagaagaaacaactcctcccttgctggcctcatgacctctggtgaacactagctttcagcaaacagaaacttccagaggccagagcagcactcagtcgcctggccttccagcctcacaggcaagataagccaccctcacagacttctctgtgctcccatctaaacatctaaatcagccatctggtttccttaacagtagcacagactctgggagtttgagagaatgtgtctcttgtgaataagagaaaataagtccatactggggaaggtagctctccaaattgagatgaggaggtcagggtgggagggtgagtggtcgtgggttggccctgatgggaggagctcaccatcagggaagctgaggacctccctcctaatgtgacagcagagtcttggccacctcttcattccccagtccccaacctggctgctctgagtgtctttccagctactggaaagcttcttctgcagcctgcaaagctagctggaactggactgtcagaaaaacatgtagatgctggagaaaatctgttaatcctaacgtatagctctgccttattccagagaagaccgcagtgtggacatgaagatgataaacttgaggtgatggaaggagcagaaatgccagatacattagcagctcttttttcttttgaaaactagcccttgcaagatttgcttgacatactgagtgacactatccagaaaacatcttttttttacttaaaaaaggctgatggtttgttcagacatctcttgtgaactagtgaaaaacataaacgttgaaagctgtaaaattcagcagttctaagtttatttccagcaagagttaaacaaagtttaatagtaaattcaaccaaccagtgttttagctttttgcctatacattatgtttttaaatttcacccattaaacaaggactcaggttacacattgattccttaaggactttaaggaagccacaaccatttatttatagttgcattttgctcttcaggtttccaggatgtttaaaattttttttgactttgtttttaggcatcaagagagaatatatctaaaaaacatttgcatagttagtgtaattgctaagccacagggtgatgggtggatagattcagaggaaggcagctgagggcagaggctgcctgacagagcaggaaaaatgaagctcgagagccttctggctggaaaggcagctcacagatgggccgcagctgtagatcagttctgaactagggactgaagcaagtttgtcgtaaataaaggaaagtggtagtgttgatgttgtgaatgtatatccacaaccagaaccatcagctctggagggaccatcaggctgccactgtggccacagagcatcactcacgtctccattgggcagatttgcagagactcagcagtgaacagagcaagtccctgcctcgtggagctcatatgctgtgagcggtggctcatgcctgtaatcccagcactttgggaggccgaggcgggtggttcgagaccagccgggccaacatggtgaaaccccgtctctaccaaaaatacaaaaaactagccaggcatggtggcaggcgcctggaatcccagctactcaggagactgaggcaggagaatcgcttgaacacaggaggcagaagttgcagtgagctaatatcacgccactgcactccagcctgggtgacagagcaagactccatctcaaaacagaaaaggaggtggagaagaggggtagtggttggaagaaggaattctcctttagggaagatgtctgggaaggcctctctgagagagtggcctttgaaaggagaccctaattggatgagggatgagaggctgagccatgtaagtatctggatggaaaacattacaggcggagacagtggtgtgtgcaaaggccctgggacagggtcacccgtgttaacaggttttaaagctggaattgtggatgggctagagtcagacactaatagggcccagaggggacactggtccttgaaatagaatttgaggatttgaccatggccaggaggctcaggtggcccagtgggaactccttaaatgggaacttcctaaaggaagaatataagaaccaaagtccagggggcagtgccaggcccaacctgtgagggttcccagagttggagggctagagagaatctgcttccagttcaggccatagactctgaacctcacaggcacattgccatccatctcccctcacccccaaccgagacggagtcttgctctgtcgcccaggctggagtacattggcaccatcttggctcactgcaacctctgccttcagggttgaagcaattctcctgcctcagccccccgagtagctgggattacaggtgcccgccacaacacctggctactttttgtatttttagtagagagggggtttcaccatgttggccaggctggtcttgaactcctgacctcatgatctgcccgcctcagcctcccaaaatgctgggattacgggtgtgaatcactgcgccaccctctgccatccatcttaacatggcgccatgagccagcctctcaggaaaagggtctcatgaacaaatgaggaaagcaagtagaggtagggcagggagggagaggcaaaggaatgtgttgttggaaagggtagtgtgcccctcacagatgacagtacccgtctccagatgtgcccactgagagtttatgaaggggctgctccatgtggtccttgactgccctgggggagagtcacagaaagctataatgccactgcctctcggtttccccaggagctcgcccgtcagcgaggagtcctggagcgcacagagaagatggtggacaagatggaccaagatttgaagatcagccagaaacacatcaatagcattaagagcgtgtttggggggctggtcaattacttcaaatccaaaccagtagagaccccacctgaacagaatggcaccctcacctcccagcccaacaacaggtgagtgcatcttctaccatctgggtataaaggagcagaagtggggattagtgcaaatgaccaagactttcagtccacgtcagtgccatgaagggatccaacaaccctttaagttactcatcaggggatatttgtcctcaaacattgtgaaaccaggaactgttcttccctgatcccatgttcacttgattgacatctagtctgtcaatagcttctccaataattgtgaccccactactttgaaagagagggtgttcacctcagcgtaatctgtacaaatgtgactcacttcacataatttttgctttaaaaaatctttagggctgggtgcagtggctcacacctgtaatcccgacacttcaggatgccaaggtgggtagattgcttaagcccaggagctcgagaccagcctgggcaacatagtgggaacccagtctttacaaaaattacccaggcattgtggtgcacacctgtagtcccagctcctcaggaggctgaggtaagaggatctcatgaggcctggagatcaaggctgcagtgagctgtaatggtgcactccaacctgggctacagagggaggccctgtctcaagaaaaaaaaaaaaaaaagtctttatgtctaaatttgtcatatctaatccaattcgcccattgatttttatttgaaaattataaggctgggctcagtggcttatctgtaaaatcccatgctttcagaggctaaggtaggaggattgtttgagaccagcctagacaacatagcaaagacccgtctctataaaaactaaaaaaaaaaaaaaattagccagacatgatggcacgtgcctatattcctagctacaggggagactgaggtggaaggattgctttagcccaggtgttagagactagagttaagctatgatggtgccactgcactacagcatcagtgacagagtctccctgtctctaaaaaaaaaaaaaaaaaaaaaaagatttaaagctaaataattaaaatcaaaaaaataaagttagaagttgctttcctcaggttttggctcgaaatataaaatcatacatgagactgggggccaggcacggtggctcacgcctataatcctagcacttggggaggccgaggcgggtggatcaccaagtcaggaaatcaagaccatcctggctaacatggtgaaaccctgtctctattaaaaatacaaaaaattagctgggcgtgatggcgggcgcccgtagtcccagctactcgggaggctgaggcaggagaatggtgtgaacccgggaggtggagcttgcagtgagctgagatcatgccactgcactgcagcctgggcgacagagcaagactccgtctcaaaaaaaaaaaaattcatgagattttggtagacttcagtgttacatgttcaaggataaaggaatggagtttctgctgaagtagattactattgtttgtatttcagatcactgtgtctgtttttattacaaaaacaacatggccacattacagacaatctatactttacctaccgcaacacaaaaacagaaaatttcattttccccttattcagtattttcatagttgtaaccatagtattcttttggtttgatagcctttttcttccatttaacccagaaaaactgcttgatattatgtgataactcaggttccataaccatctctctctctctcttttatttatttattttttattttatttatttattttttttgagatggagtttcacccttgttgcccaggctggagtgcaaagacgtgatctcagctcactgcaacctctgccttccaggttaaagcgattctcctgcctcagcctcccaagtagctgggatcacaggtgcccacaccatgcctggctaattctttttttttgagacggagtctcactctgtcacccaggctggagtgcagtggtgcgatctcggctcactgcaagctccgcctcccgggttcatgccgttctcctgcctcagcctcccgagtagctgggactacaggcgcctgccaccatgcctggctaattttttgtatttttagtagagacggggtttcaccgtgttagccaggatggtctcgacctcctgacttcgtgatccatccgcctccgccttccaaagtgctgggattacaggcgtgagccaccacatccggcctaatttttgtatttttagtagagatggggtttcaccatgttggccagtctggtctcaaactcctgacctcaggtgatccacctgcctcagcctcctagagtgccgagccaccacgccaggctttttttttttttttttttttttttttgagacagagtctcactctgttgcccaggctggagtgcagtggcaccatctcagctcactgaaacctctgtctcccaggttcaagcaattctcttgcctcagcctcctgagtagctgggattacaggcatgtgtcaccatgcctggttaatttttgtatttttaggagagatggggtttctccatgttggccaggatagtctcgaactcttgatctcagatgatccgcccgcctcagccttccaaagtgctaggattatgggcgtgagccaccacacctggcctctctctttgttttaattctgtaatgtggagcttttctttttcattttatttatttattttttaagagatgaggtcttgctgtgttggccaggttggtcttgaactcctggcctcaagcagtcctcccacctcggcctcccaaagtgctaggattacaggcatgagccaccacacctaactgcagagccgttttttttaatgcatcactaaggtacagtaaaatatgtgcatcttaagtggagagccagtgactgtgaacctgtgtacactagtgtggccaccacccagatcaagatgtagggtgtggcagggaggaaattagataactacttcaaactcagagtggggctggggagaaaccagtgtaggtaacaaagctggtggtgatggcagaaagaacaggcaggcgaagccatcaagagttatggagaggttcaggcatggtggctcatgcctgtaatcccagcaatttgggagactgaggcaggaggatcacttgatcccagcctgagcaacatgacaaaaccccgtctctacagaaaaacacaaaaatgaagttgggcatggtggttcaggcctgtaatcccagcactttgggaggccgaggcgggtgcatcgtttgaggtcaggagtgtgagaccaggccagccaacatggtgaaacccagtgtctcctaaaaatacaaaaatcagccaggcatggtggtgcctgcctgtagccccagctacttgggaggctgaggaggagaatcccttaagcctgggaggcagaggttgtagtgagcggagattgcaccactgcacctcagcctgggtaacagtgagactctgtctcaaaaaaaaaaaaaaaaaaaaaaaaaaaaaggccgggcatggtgagtcacgcctgtaatcccagcactttgggaggccaaggccaacggagcacgaggtcaggagattgagaccatcctggctaacacggtgaaaccccgtctctactaaaaatacaaaatattatccgggtgtggtggcgggcgcctgtggtcccagctactcgggagggtgagaaatgtgtatggcgtgaacccaggaggcggagcttacagtgagctgagatcacgccactgcaacagtgagctgagatcacgccactgcactccagcctgggcgacagagcaagactctgacacacacagacacacacagacacacacacacacacacacacgaaaattagccacacacacacacacacacacacacacacacacacacacacacacacgaaaattagccggacatggtggtacgtgcttgtggtcccagctactgaggtggctgaggtggacccgaccttttggcttaggtgggaggatcacctgaacccagggaggttgagcctacaatgagctatgattgtaccagtctactccagcctgggtgacagagtgagaccctatctcaaaaaaaaaaaaaaaaaaagtactgcaggagggacctgcagagttggccctgggaacctgccggcctcagtgagtgccctggggaggcactagctaaggttatgagggttggttggtttttttggctcagccataatcaccattctgggttctccagctcaaccctaattttaaacatccgccatttccctccagttctagtcgttgcttgttttttgttgtttttttttcaatatacatatcagaaagatgttttatatcctaatctttggccacatttaattgccataggagaaggtaggatgttcatttgttttggtctaagacatcctccatgtacaaactcaggagcagagtgagcccttggaggagtgggaagctggcaagtttgtgactagcaccctttcacacccttccacatcctacatacctcttcacaaaggctgcttctggggctcttggaggcccctgcatccctgaacatagctatgaaagccatggaagtcctgtggctccaggggcagttttctttttttggagcatcatgaaaactcaggggcttcccagcaaaggcttccatcagtgaggcagccatagttatttcagtgaggtgggctttgtctcttgggaagtcctgtttgtccttgctgacagctttccaagctgcttgttctcatttccacttaaagctgatgcgttcccgtcaaggtccccaaagtcatgtaccctgcctggcctgcccctagattagccccaatcagttgtagcattcttgccatctcttagtaaattcaagaaagcaaaactttcacccacactctgcagttctgtgggagcagaagctgcaggaatgcagtctgtctgttggaagatatgggggaggcagacagtccacagggatgcagtggggacccagaggagagggaggttggccctgggaacagaggaaggctgcacaaaggacctgactttttgcagaaggtgaaggttttgagggaacccaccaattgaaggaggggttggtgcaggcacatggcagtaaaagcacaggggaagccgggatgaaggaagttgttggccatttcaagggcccagcagggccagacacagtggctcatgcctgttatcccaacattttataaggccaaggcaggacaatcacttggggccaggagttgaagatcagcctgggcaacatagcaagattctgtctctacaaacataaaaaatttttaaagctgggcatggtgatacaggcctgtagtcatatttacatggacgaccaaaaaaaaaaatgggggggcggctgggtgcagtggctcacgcctgtaatcccagcacttttgggaggctaaggtgggcggatcacgaggtcaggagatcgagaccatcctagctaacacggtgaaaccccgtctctactaaaaatacaaaaaattagccaggggtgatggtgggcacctgtagtcccagctgcttgggaggctgaggcaggagaatggcatgaacccgggaggtggaggttgcagtgagccaagatcaagccactgcagtccagcctgggcgacagagactccatctcaaaaaaaaaaaatgcaataaattgtgagtaaaatttttgtgatcctgtcaaaacctttaatccataaatgcaggaatactgtcacttaaaaactttgccttttttttttttttttttttaagacaatgtctcgctctgtcgcccaggctggagtgcagtggtgcagtctctgctcactgtatcctccacctcccaggatccagcaaccctcccacctctgcctcccaagtagctgggactacatgcatgggccaccatgcactgctaattttcgtattttttgtagaaacaaggtctcactttgtctcccaggctgatctcaaccacctgggctcaactgatcttcccgcctcagcctcccaaagtgctaggattgcaggcatgagccactgtgcctggcccacttaaaagctttttttttttttttttgagatggaatctcgctctgtcacccaggctggagtgcagtggcgtgatctcggctcactgcaagctccgtctcccacgttcacgccattctcctgcctcagcttcccaagcagctgggactacaggcacccgccaccacgcccggctaaattttttttgtatttttagtagagatggggtttcaccatgttagccaggatggtctcgatctcctgacctagtgatctgcccgcctcggcctcaaaagcttttaaaataagtttctcctatcaaacttctgttcagtcatgcatttcctgtgtacatcattatcacacaaacccttcggccttctctgaagttttgtctcttgggaagccctgtttgtccttgctgacagctttccaagctgcttgttctcatttccacttacagctcatgcgttcctgtcacatatgcacccttaatttgaaattctctaacttatttaagacttggtttctgaccaggaaccaccctctcttaaacctctactgtcttatcacttttctcagtctccctagaaattggctttcttggctgagcgtggtggctcacgcctataatcccagcactttggaggttgaggtgggcggatcacaaagtcaggtgttcaagaccagcctagccaacatgatgaaaccctgtctctactaaaaatacaaaaatcaggcctggcacggtggctcacgcctgtaatcccagcactttgggaggccaaggagggtggatcacctgaggtcaggagttcgagaccagcctcaccaacatggagaaaccctgtctctactaaaaatacaaaatgagccaagcaaggtggcacacacctgtaatctcagctacttgggaggctgaggcaggagaatcgcttgaaccagggaggcagaggttgcagtaagccaagatcgcaccattgtaccccagcctgggcaacaagagcagaactccctctaaaaaaaaaaattagccgggcgtagtggcgctcacctataatcccagctactcaggaggctgaagcaggagaatctcttgaaccagggaggtggaggttgcagtgagccgaggtcatgcccctgcactccagcctgggagacagagctagactccgtctcaaaaaaagaaaaagaaaaaaattggctttctttgtgggggagccatttttcacaaagaaaccattgttttcctcatttatgtattaccagtatatatgtgatggcacatagaaagaataaagccagcgttgagatgtgcaggctgaaaggtggccaggcagactcagaagccaagtgtctcttcctactcccagcatggcaatgcactgcccacagtggtgcttagaggagccagttctgtgttctagactttcagtcacagcttccgtggggtgaaatcctggagtgttaaatccttccattcaccaggctctgctgcattctacccatagctggagccctgggcctgcaaaacccttagcttgcgggagtctggacttgctcttgcaagttgggagtcattaaagactttaactgaagaggtgcttgccagtattgctttagaaagatgcgcagcacccatggggagtaaggattggaagggagggaattgaattgagaggcattgccataatccttgttaaaggtaaagaaaagcaaggcaggccgggcacggtggctcaagcctgtaatcccagcactttgggaggccgaggcgggcagatcatgaggtcaggagatcgagaccatcctggctaacacagtgaaaccctgtctctaaaatacaaaatacaaaataaaatacaaaaaccctgtactaaaaatacaaaaaattagccgggcgtggtggcgggcgcctgtagtcccagctacttgggaggctgaggcaggagaatggcgtgaacccaggaggcggagcttgcagtgcgtggagatcacgccactgcactccagcctgggtgacagagcgagactatgtctcaaaaaaaaaaggcaaggcagaaggagaggctgggtttctgggctacttagggggtgggagatcaagagggcgtttgttttgcctggattactgggagtagcgctgtgcagggggagggcaaaaattgcgagtaaccctgattcccagattggctggcgaagtggtcaggctgctgttgagatagaggagagcaggctgttggggaggcacagctcccagctggaggcacctgccataccttagggggctcagcaggatgtcggggatcagcagggcatcaggcatagtctaaatgactttgagttgcaagagctatccctgtctacagccagagtcagcaaactaggccacggagcaaaatcaaagatattttatagggacttacgtgatgagaaaaaaacatactttcacaactttttagtgacaaaatttaaaatataaaaacagtggccgggtgcagtggctcacgcctgtaatcccagcactttgggaggccaaggtgggcggatcacgaggtcaggagatcgagaccattccggctaacacggtgaaaccccgtctccactaaaaatacaaaaaattagccgggcgtggtagtgggcgcctgtagtcccagctactcaggaggctgagacaggagaatggtgtaaacctggtcagcagaggttgcagtgagccgagatcgtgccactgcactccagcctgggcaacagagtgagactccatctcaaaaaaaaaaaaaaaaagtaataggctggacacagtggctcatgcctgcatggctgtaatcctggcacttttggaggctgaggcagggggatcacttgagtaggcacctgtaatcccagctactcaggaggctgaggcagaagaatagcttgaacccgggagatggaggttgcagtaaatcgagatcacgccactgcactccagcctgggcaacagagcaagactctgtctcaaaaagaaaaaacaatttaagaattggccaagcatggtggcttatgcctgtaatcccagaactttgggaggctaaggcgggcggatcacctgaggtcaggagttcgtgaccagcctgcccaacatggtgaaactctgtctctactaaaaatacaaaaaatagccaggtgtggtgggggcctgtaatcccagctactcaggagcctgaggcaggagaatcacttgaacccgggaggcagaggctgcagtgagccaagattgcgccactgcactccagcctaggtgacagagcgagactctgtctgaaaaaatttaaaaaaaaaaaaaaaaaaaaaaaagccaggcagggtggtgagtgcctgtggtctcagttacccaggaggctgaggtgggaggatcacgagcctaggagttagagacttcagtgtttgcaccactatactccaaacttggtgacagagagagaccctatctcaaacaacaacaacaaaaacagtaatagttgagtacagtattctggtaatataagtgcactaatgagaggaatgaaactcttgaggttctaagtttgtcatctgaggtgcacatggtcatctctaaggccattctttgctcatggtcatataaaaacaggtgaaattttgttttgtgtattttaccataataaaaataacttggggccaggcgcagtggctcatgtctgtaatcccaacactttgggaggccgaggtgggtggatcacttgagatcaggagttagagaccagcctggccaacatggtgaaaccccatctctactgaaaatacagaaattagctggggatggtggcacctgcctataactgtaatatcccagctactcgggagactaaggcgggagaatcacttgaacccgagaggcagaggttgcagtgagccaagatcacgccactgcactccagcctgggtgacaaagcaagactccatctcaaaaaaaaaaaaaaagaacggggaaacagtacaaaaacaggaggtgagccagatgtgatcagcaggtcattgtttgctgactgtagtctaaagtaccggtttggttgttccatgtgcttttcatctgcctggtcctaggaatccaggtttccctgagagagggccacctaactcgatgctacactgctttttttttcttttttttcagtaaagacaaggtctcattatgtttcccagatctcacactcgtgggctcaggcaattctcccacctcagtttcccaaaatgctgggattacaggcatgagtcaccacacctggcttagctgccacacttctgaggcaggggtcttcataagcttactgcttggcccactgtgctcctgggagaagctgttgaaatccctactttggtcagaaggagtttggcacagaggaggcatttgatttttagcacacaggcattatgtgaaaagactgataacattgtcataggggtttttcctttttaaacgttttcttttttgtgaacttttatccaaagattgaaagaagctataagtacaagtaaagaacaggaagcaaagtaccaggccagccacccaaaccttagaaagctggatgatacaggtaagtggatacctgtgtgcacagccacatttgaattctggggggagacctctaggtttggcgttggtccttggggggcagtggcaacctctctggggaggtgggcaggggccccagctgctggcatcacccatgctagccaaagggccttagggaccccgcatgctcttgcggagctgggggtgtgcattatggtggggctcctccttctctccctccctccctccatggagaggagaacaaggaagtgagggcctgcattccattgaaaatgagcctgcccggccagcctggtgcagtaacacacgcctgtaatcccagcactttgggaggccaagctgggtgaatcacctgaggtcaggagtttgtgaccagccttactaataacgtggtgaaaccctgtctctactaaatacaaaaaaattagccaaatgtggtggcacatgcctctaatccaagctacttgggaggcttggacaggagaatcacttgtatctgggaggcggaggttgcagtgagctgagatcacgccactgcactatagcctgggcaacaagagtgaaactctgtctcaaaaaagaaaatgagcgtgcccatcattggttcctgcctgtgtcattctcaattgttccagcagtaaaaagccaactgcagaaaaaccccttggtaaatagaatactggcccctcaaagctgtccacgtcctaatccccagaccccgtgagtgtgttaggttatatggcaaaggtggaattacagttgcagatggagttacaattgctaatcagcaagatggggagattatcctgggttgtccagttgggtccagtgtcatcacaaaggtcccttttaagtggaaagagaagcaggagagagagcagcagagtcagagatctgaagatgctgctggccttgaagatagagaaaggggcccacctgccaaggtacacgggtgaactgtagaaactgcaaaaggcgaggaattagattcttcccaagagctccagaaggagtgcaaccctgaggacaccccgactcagcccagtgagacccatgttggacttctgacctccagaaccgtaagacaagtttgtggtcatttgtcacagcatcagtgagggactaatacagcctccagcccaagcagaaggagcagcagccacatggacaaggtgtgcaagacagtgttgatcgaatcattccacttctatcaagtgataggcccagaaacatcccttatctggaaaggaatttagggctcctggggcctcctccataggcccccacaatagccaggtacattgaaattggtgctagaaaccaaaggcttactgtgctgccttcaagaaaacgatacaccatggaagctctggaacccaccatggttgtggttgatgcagctgaggagagcccagatggaggaagagcggggagcaggagagactaacatcatcagcacagttcattctggaaaggcaagtggaggaagtgagtgtaaattgaaaggcaagggctgggaaaaccggcctcatcacaccctggagaaggggcacaggacactgcacccaagacacaattttaaggaattaaagagagtttttatttgtgcagtatatattaacttaaaagactgaagaaaaaatcgacacagtttgcagaatggtttcagttggttggtgctggaggaaatgtgctaagtctagaaagtgaagtttccctgaaagagataaaccgggatgacagggcttttccgtgtgcgtttagaaactgaagttcattcaagccaagaaagataattttaaaaaagaagaaactaaaagttcaaggaagatttcttgtggcaaatgtgcattatttaacatttcttttttttttttttgcgtatttgtttcaagtgcaaagatagtgtagaaataaatttcagaaagaaacgaaattacccataattccatttatgtaacgtaacaatttgtatttttatactttgtccacagactgtgtagttttgcattattgcagttccacttctgtattgtcacttgtgtgactctgtctttcctgagcttgtgcaccaggagttaggtgacccttaatttgagggtgtttgatctcccaagtactgagggaaagtgagaaccctctcctaccccgtggaagcgtctcttcttctggcccatgagcctgcgctgtgctcctccctcatccctctggatagcctcagaaccaaccccttcgttccttccacccattttccagatgaaattgttttgggtgtgtgaagcagcatttgaaggaatgtcaattaaccgctctcctggtgtttccttctaaacttagaccctgtccccagaggggctggttctgccatgagtactgatgcttacccaaagaacccacaccttcgagcctatcaccagaagatcgacagcaacctaggtaagactgagcaccacaccagcttctgtaagccactgtccttcaggcagcttacgccaagcatagcccctgcatgagcatcctccagcttcagttccctcaccacacatcacatcccacgccaagctgggtccatcttgccacctcactgtctctggaatctctccacttctcaccatttcctacttctagcccagccgagccctccccacctctcactttcatgaacagcaccagggacccaggagtccctgagaggccataaagtatagcctggacgtgaccgctcacttcatccttcccacctggccactcagagccctgttttcctccttgtgaaatgggctacctctgagaacagtggaaaggttacctgagccagaaagtgcctgggatggtaagagttagtgctcgtgttgcaattggcactttggccacacagcctccagcatgatgtttcaaaacggaagggtgtgcagggggccgggcgcagtggctcacgcctgcaatcccagcactttgggaggccaaggcgggtggatcacccgaggtcaggagttcaagaccagcctgaccaacatggtgaaaccctgtctctactaaaaatacaaaaattagccgggcgtggtggcaggcgcctgtaatcccagctatcgggtggctgaggcaggagaatcacttgaacccgggaggcagaggttgcagtgagccaagatcgcaccattgcactccaacctgggcaacaagagcgaaactccacctaaaaaaaaaaaaaaagaagaagtgaagggtatattcttccagaactctctcatggaaccccacacactcacagtgcagtccaggctctctttggctgccctagtcccttctgccctcatcacctgcaggctcgtgtgggatttctgatgtgagttctttctgcctcgtggcccctatctgcctggatgggctcccccgactctctgtaggctggctccttctctttctgtcagtcttgcattagtatggcctcctctccctgtctctcaggacccttgtgtttccagggggctgccctggccgtttgtgattgtgtatctgctggtttgcctgctgtcttcccaatcagactgtagattccaggacagcatgggagtgtttccattttgtcactactttgtatctggggcccagcaggcaagcacttagtgattatgttttgttttgttttgttttgttttgagacagagttttgcttttgttgcccaggctgcagtgcaatggtgcaatctcagctcactgcaaccgctgcctcctgggttcaagcgattctcctgcctcggcctcccgagtagctggaattacagacatgcaccaccatgctcagctaattttgtatttttagtagagatgaggtttctccttgttggtcaggctggtctcgaactcccgacctcaggtgacccgcctgtctcggcctcccaaagtgctgggattataggtgtgagccactgcgccctagccagtgattattttttgaatggaaaagtcagttacttgaaattcaagtaggtgttggcctgtgggcagttctgtgagtttattctaagtagtgtctcagacttgctgcctcctcctaccgctactccctgagcagaaatctcccccgtggtgacctgggtcaccctgtcagtctcccaccccctgttaggagttggcaaagtgtaggggacaaataataaaatcctcccctgctgtaaaggtatctagtggaaggcaaaactgaaacccatgaagatgcacatggagtgtctgtgcacgggttttctcctgcttgctgtctgggaagccccagacagctgccacctccttctatgccctggactctgtcctccagagccaaagacttatctgaggcagaaggtgtgtctgcccagatctaaccactccagagaagcccagagaggcgtgaaagccctttgtccttcactgcgagaaagggagaggttagggctagtggtatggttggtgcctgctggcagaagtgggagaagggactttgaggaaggatactgcattcagaggcaggaagaagtgctgagtactgcccgccactaggaggtgctgagggtgcacagttggcactgtggacgagcagctgggcagttaccggcaggacgcagtctagagtaggaggtgggcctgggcagaagggcgagtggctagttcagagctcagccctctggccctgctgacacaggccaggccggtccactctggtggggcagggagtgttgcctttgttcacactcttcccgtcttaacactatctccctgctatttcaggatctcaggcaagctctctggactccagcgccctggcctggtggttttacattatcacacattttatctcagcctctctgtttgcttatcctttgctgccctggctgccagtgagcttcctcctgaggcctgaggcaaccacaggctctgctctccatggagcacgaggccatgaattttagtaagcttaagaagcaaagagctgaagacttatcttttttttttttttaattttaattatactgtttttctctttcttttcttttcttttttagaaatggagtctcgctttgttgcccaggctagtctccaacttctgggctcaagtgatcctcccacctcagcctcccagagtgctgggattacaagcatgagccactgtgcctgacttgaagacaatctttttatttttatattttttaatttctttctgagagttttactctgtcgcccaggctagagtgcagtggcacaatctcagctcactgcagcctctgcctgctgggttcaagtgattctcatgcctcagcctcccgagtagctgggattacaaggtgtgcaccaccatgcccagctaatttttgtatttttagtagagacggggtttcaccatgttagccaggatggtctcgatctcctgacctcaagtgatccacccacctcggcctcccaaagtgctgggattacaggcatgagccaccacactcagcctatctttttatttcattttttgagacggagtcttgctctgtcgcccaggttggagtgcagtgcattgatctcagcttactgcaacctcctcctctcaggttcaagtgattctcttgcctcagcctcccgagtagcagggaatacaggcatgcaccaccacatctggctaatttttatattttttagtagagatggggtttcaccatgttggccaagctggcctcaaaatcccgacctcatacgatccacccacctcagcctctcaaagtgctgggattacaggcatgagccattgtacccggccaaaactacctttttaaaaaaactgattttggccgggcgcggtggctcacgcctgtaatcctagcactttgggaggccaagacgggcggatcacaaggtaaggagttcgagaccagcctggccaatatggtgaaaccctatctctactaaaaatacaaaaaaaattagtcgggtgtggtggcgtgtgcctgtagtcccagctactcaggaggctgaggcagaagaattgcttgaacccaggagacggaggttgcagtgagccgagatcatggcactgcactccagcctggacaaaagagcaaaatgctgtctcaaaaaaaaaaaaaacaaaaaactgattttgcttagatttgtggtaccagtgctaagcctttgtgtatcctgatcctttttctcttagtgttttatatttaatcttgcaagtaagaaggcttacaaagcaccacctcttctctctcctctctggctctttcctggctgctgttcctagtaaaaaggcagaaagcagccctgggcatatctccctacccccagcgtgcacaaacacacacacacatacacacacacacacacagtcacaaacctgggaaaaggctttactcttcaccctgacagaatcaattaagtcaagactcatctctgcagtgggtgcagtccccccaggcaacacagatccctgtctctcccacttacccacaccatcaagaagcatttgcaggtgccgtgactgtttgctcatgcctgcgtgtcatttcctcctcctgcagatgagctgtccatgggactgggtcgtctgaaggacatagccctggggatgcagacagaaattgaggagcaagatgacattcttgaccggctgacaaccaaagtggacaagttagatgtcaacataaaaagcacagaaagaaaagttcgacaactctgaagacagacggatttccactctattgtgatgaaaagatttgaaagatctttttttgaacttccaagaaatttcatttactattttagtatgtaaattaatgtgtgtttgcaaatgttataatagagtaggtcttaagacatttttgctgttataaggaagtgtttgtcccacattttcctagggttaacacctcaccaagttcttccagcaaaatgcttattagagtttttgtctgagcacagtagcctggccctgcatatcttgggcgtttgattaccatgctggaataagaagagttgcatttctcattttaatgagcatatggaaagatgggaacagaatttcagtcttgcagccatgagcctctatttctcattcctaagccttaccatgagtcagagtgttaagggggcctgtgaaccagtcgtttggtggaggagggtccttcccacacctttgtttaggagtcatcattcacacacacacacacacacacacacacacacacacacacacacactctctgagcacattatctgtgattctttcatcctcccagaaaggatcagtgttagaatgggaaatagagtgtgccatcttgctcttttgttggcagatgtccccgcttccctccagccccccatccttggcatgtatattagtaggagggcttcacaccagcactgctcactgcgactcctggaaatgtgtggggaattgggtgagcccctcttccccacgtgctcccatctgtaactctccatctgtgatttgcaacaggtcttccactggctcgaggctgcgaggctgaccgacaggggcgcccaatagagtttgtgggaatggagtattgcacagatgcagctgcacaatggtcttcctccacccctctgggaatcaccattaggcaggcctcagtagggcaaaatgtttatttggtaccgggggtctcctgacctgtctagcattcccacccactcttctgcacttcttgcaaggtaacttgaatcatcacttatttctctgccacctggttttaggactggcactctataaatgacgctgactttgtatagaaggattttgctaagggggcaaaaagcccagataccattttaactggcccagttcattttctcctttcattttacaaaagaaatcatgcagaagcatcaattaaaactgatttatttatgttggtacatccaacaaaatagttggagccacaaggcccttgtctttttaaaaaaacaaaatattttgaagatggtgaaagtgactgattttaataatgagataggtcacttaaaataacagtgcctttgaccttaaaacatggcactggcccatgtgacctttgccatttcccagtacttccctttacagtctgcagcctataaacagtggtgtctcaaagcaaaggaaacctccacaagtgctgcaacagtgcattagtttttatgtagcaatttgtttataaaaattcccatcccataatgcatgaccttcctaaaaatatccacagcctccataggcaaggtgagctttctgtgctacccacttgttagattccagccacctcagggattctgatccatgtcattaacgaccatcccagggtgtgagggcctgattaaagcttatcgaactagacatttgtttattagatgagctcggcattattattttctcaataactggtagaagggaaattttaaacataacactcaacccaaacaaaactacttcgtgaggctttcagcaaaaaggctgcttaaaagcatgaacccgggatgcagagcagcttttgtgcacggttccacttactgtaattgtttctggttctttcctctaacaccttccatgtatgtcaactttttatcaccgtcaggcatagactcgtggagattagtcattatagctcagacctaagctaattatttaaaataaatacatgtaaaggccactgccacattctcagcagacttccacttgcctaatgagattagtgattcaactgacttgaagcacagtaacatcttattttatgcacattccctgtcttttgctggactgatgaagccagtcacccgcccttctctgttttttggttttttttttcttaaccccaggtatatggaaggggagttgccttcacttttctggaaatttgtcttcgtctgacatattagagggcctcgttttgtcctgttcttgttcagaccctctcgttctacgtcctgtgctgaggggactgtccgtaagctacaggacagcgagctggtcctttctgccacttcttccccactcccatgcccaggaaggcctggttgctgatgctactttataaatgagttgcttgcattttcacagagaatgaaggaagacgtaacatggctccagaaacttttcacatgatgattgggatcgacaaaaaaatgctaccctctagactagacacatttcatggagacaagcaaaatggtgccagggctgggctgactgtgggatgggatttggtactgcagacagattttgatttccacagttgagctggaaacaaactgtgccttcaaaaaatgacttttctaacttaaggttggttatatgttaagtgtgctactaacttaaaaaatagtggctgggcgcggtggctcatgcctgtaatcccagtgctttgggaggccaaggcggggggatcacgaggtcaggagatcgagaccatcctggctaacacggtgaaaccccatctctactaaaaacacacaaaaaattagctgggcgtggtggtgggcgcctgtagtcccagctactcaggaggctgaggcaggagaatggcatgaacctgggaggcagagcttgcagtgagccgagacagcgccattgcactccagcctgggcaacagagcaagactccgtctcaaaaaaaaaaaaaaaaaaaaaatagtgcactctctggctggtcacggtggctcacgcctgtaatctcagcactttggaaggccaaggcaggcggatcacgaggtcagaagatcgagaccatcctggctaacacagtgaaaccccgtctctactaaaaatataaaaaattagtcgggcatggtggcgggcgcctgtagtcccaactactcgggagactgaggcagaagaatggcgtgaactcaggaggcggagcttgcagtgagccaaggcgacagagcaagactctgtctcaaaaaataaaaaatagtgcactgtccttcgagaaagttttctaacatctagtaatttgtaacttagaagtggagttgccttgtggatgtcttttttgcattctgtaggaaatgaaacgtgaatttaactcgggttgcaagaaataaaaatgtcagtgcatttaa

SEQ ID NO: 1995 - DNA, 122 bp, Homo sapiens
ccggagccattgtggctcaggccggttgcgcctgccctcgggccctcacggaggcgggggttccagggcacgagttcgaggccagcctggtccacatgggtcggaaaaaaggactttttttt

SEQ ID NO: 1996 - DNA, 121 bp, Homo sapiens
aaaaaaaatccttttttccgacccatgtggaccaggctggcctcgaactcgtgccctggaacccccgcctccgtgagggcccgagggcaggcgcaaccggcctgagccacaatggctccgg

SEQ ID NO: 1997 - DNA, 121 bp, Homo sapiens; identical to SEQ ID NO: 1996

SEQ ID NO: 1998 - DNA, 122 bp, Homo sapiens
ccggagccattgtggctcaggcaggttgcgcctgccctcgggccctcacggaggcgggggttccagggcacgagttcgaggccagcctggtccacatgggtcggaaaaaaggactttttttt

SEQ ID NO: 1999 - DNA, 122 bp, Homo sapiens; identical to SEQ ID NO: 1998

SEQ ID NO: 2000 - DNA, 121 bp, Homo sapiens; identical to SEQ ID NO: 1996

SEQ ID NO: 2001 - DNA, 122 bp, Homo sapiens; identical to SEQ ID NO: 1995

SEQ ID NO: 2002 - DNA, 121 bp, Homo sapiens
ccggagccattgtggctcaggccggttgcgcctgccctcgggccctcacggaggcgggggttccagggcacgagttcgaggccagcctggtccacatgggtcggaaaaaaggatttttttt

SEQ ID NO: 2003 - DNA, 121 bp, Homo sapiens; identical to SEQ ID NO: 1996

SEQ ID NO: 2004 - DNA, 121 bp, Homo sapiens; identical to SEQ ID NO: 1996

SEQ ID NO: 2005 - DNA, 121 bp, Homo sapiens; identical to SEQ ID NO: 1996

SEQ ID NO: 2006 - DNA, 121 bp, Homo sapiens; identical to SEQ ID NO: 1996

SEQ ID NO: 2007 - DNA, 121 bp, Homo sapiens; identical to SEQ ID NO: 1996

SEQ ID NO: 2008 - DNA, 121 bp, Homo sapiens; identical to SEQ ID NO: 1996

SEQ ID NO: 2009 - DNA, 120 bp, Homo sapiens
aaaaaaatttttttttcaacccatgtggaccaggttggcctcgaactcgtgccctcgaaccctcgcctaccctgagggtccgagggcccgcgcaaccggccggagccacaatggctccgg

SEQ ID NO: 2010 - DNA, 120 bp, Homo sapiens; identical to SEQ ID NO: 2009

SEQ ID NO: 2011 - DNA, 120 bp, Homo sapiens
ccggagctattgtggctccggccggttgcgcgggccctcggaccctcagagaggcgagggttcgagggctcgagttcgaggccaacctggtccacatgggttgaaaaaaaaatttttttt

SEQ ID NO: 2012 - DNA, 120 bp, Homo sapiens; identical to SEQ ID NO: 2011

SEQ ID NO: 2013 - DNA, 119 bp, Homo sapiens
ccggagccattgtggctccggccggttgcgcgggccctcggaccctcagagaggcgagggttcgagggcacgagttcgaggccaacctggtccacatgggttgaaaaaaaaattttttt

SEQ ID NO: 2014 - DNA, 120 bp, Homo sapiens
ccggagctattgtggctccggccggttgcgcgggccctcggaccctcagagaggcgagggttcgagggcacgagttcgaggccaacctggtccacatgggttgaaaaaaaaatttttttt

SEQ ID NO: 2015 - DNA, 120 bp, Homo sapiens; identical to SEQ ID NO: 2011

SEQ ID NO: 2016 - DNA, 119 bp, Homo sapiens
aaaaaaatttttttttcaacccatgtggaccaggttggccttgaactcgtaccctcgaacccctgcctccctgagggcccgagggcaggcgcatccagccggagccacagtggctccgg

SEQ ID NO: 2017 - DNA, 120 bp, Homo sapiens
aatttttttttttttttcaacccatgtggaccaggttggcctcgaactcgtgccctcgaaccctcgcctccctgagggtccgagggcccgcgcaaccggctggagccacaatggctccac

SEQ ID NO: 2018 - DNA, 123 bp, Homo sapiens
ccggagccattgtggctccggccgattgcgccggccctcgggccctcagggaggcgagggtgtgagggtacagagttcgaggccaacttggtccacattggtaggaaaaaaaaaatttttttt

SEQ ID NO: 2019 - DNA, 128 bp, Homo sapiens
ccggagccattgtggctccggccgattgagcctgccctcgggctctcaaggctaggcgagggtgtgagggactggagttcgaggtcaacctgggccccattggtaggaaaaaaaaaaaaaattttttt

SEQ ID NO: 2020 - DNA, 119 bp, Homo sapiens
aaaaaaatttttttctcaaccaatgtggacccggttggcctcgaactcgtaccctcgaaccctcccctccctgagggcccgagggcacgcgcaaccggtcggagccacaatagctcggg

SEQ ID NO: 2021 - DNA, 120 bp, Homo sapiens
aaaaaaattttttttttcaaccaatgtggaccaggttggcctcaaactcgtaccctcgcaccctcgcctccctgagggcccgagggccagcgcaaccggccggagccacagtggctccgg

SEQ ID NO: 2022 - DNA, 121 bp, Homo sapiens
aaaaaaaattttttttcaaccaatgtggaccaggtgttggcctcgaactcgcactctcgaaccctcgcctccctgaaggcccgagggcaggcgcaaccggccggagccacaatggctccgg

SEQ ID NO: 2023 - DNA, 113101 bp, Homo sapiens
tattttcatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatattaagggaagaaacactttaaaggagaatttgtatccacataaatccttaaattcatggtcacaactttcctaatctcaaattgttctaggtcactgctatcagtctagttctgtcctctatttcttaatttaataccaatacttttaaatttttaaaatatgctgctttaggtagatttaaaatatatcctaaccgccactttctaaccttcctgaaatatactgttcaataacaaatcctttccttgcttaaacataacttaaataaaacaagaaacttaccatttctctctagtgtaagatgacacatgcagcttagcactctgtagtagtctctcttcaattaggtaaaaaaggaagtttctatggtaaccatccttatagtcactcattcctccttccttcctcaccagcgcccaatatatatcacattactcatgaatacatataaactgctagcatgtctagaatattctgtcttgaaattatactttctactagtgacttttagaaatgactatgccccagaataattaaaaagagaaaccaaataatttttaaattaatttatacagagtttttcaccatcaagtttattttcagcacccatggggagttaatagatcttccctgaaagagaaaaacctttcctaaggaaaaatcctagaattcatatatttggcaacatttaaaggaggccatgaaatttttatcagtctagagaattgatctcctttaaggtgactctggtagttccaacgatgtttaaaggcatttcctgtaaaaaaaaaaaaaaaaagagagcgagagaaaaagagagagagagagagagaatttctgatgattaaaaaaaaaaagtgaggaatgctgagttaaacaaagttaaccacattctctcagagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacgtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgagatgggataaaaataaaatatttttgcaatgagataacgttttattttaattctcaccatttatatacaaacacaagtgaataaaacacatcgcaaaatggtaaaatttcatatttagtatttataggtgcatagtttcatgctcacatatttttaagtattatatatattaacaaatttcacaatacgtcattattcttagacagtatcattaaaagacacctaaaaatcttataatatatgatagcaaatcactaacaacttctgaacaacagcaacaaaaaaatagtgaggatttagaaataagtggtagtcacttaggtgtttttaatttgttttaacatcgtagattgaagccacaaaatccacagcacacaaagaccctgctaccatgtattcacttcagtgaaagggaagcaccgaaatgctgagtgggggcaggtacagatacttcaatcactgctgatggaagacttcgagatacactgtaaaaactttgagaaatgtcatgactgggcacattggaactgagcacttgtacaggatggaacatctgtcagcagatctcaagaaactgggagcaaagatatttcttaggcttcaggttcgtagtcttgatacccttcctaatattagaaaaatcaaaaagacagcacacactgttagtataagtttcaattacgcatcagcactgacagccaatgagataggaaatggctccccacttacactaaaatttacaatcaatgtttttgcaaatattctgcagcaaatattatcttatttttaatagttgtgtctttcttgtctgatataaaagtgaattacagtagtagtcagagttaaaatatctaggttctgatccggatgcaccatttaatgatcatatacctagtttggtaggacaaataagttggactgtctggttctcagtttcttcacctgtaaaatgtgagaacaaaatcaagctgtctataaagccttttccagactaagatgctctaattctcagaaggaaattaagatgtttgaaggcaagatacattttccctactttcactctcccagttgaaaatttcgtcttcatctatggcttcaattattacttgtatttcaaacctcaagctctccatacagtatctggatagcatccacaacacaaatattaatggatttaattaaagggatcagattattcctcctaaagagcaactctaataatatcaggattctgcttaaaaacaaacaaataagcataacttcaataactcaagttgttttctgaatagaatacaagctgaaatgacaagattatcctaatactctataacttgtctttgacccatagctgcaaattcaatctatcaccattttccttgttcctaagcttgagtcataattattcactgttctcagacatatccatttgcatgctcagacatacatgcctttgcttctgatattcccttgtgccagaatgtcctctgtttgttttgacctactatatctcttaccttttcccacccagatcaacattacctcctcaataaaacttctcctgattgattgaaacagatctttaaaatgttttactttttagtatgtcttatatatttttgctcctgtgatgcctggtacatcgaagacaatcaattatgtttgttaaaggaatcataatgaagaaatgaatgaatgaatttctattttttttcatcaaacctaccagactgtaaactccttatgtcctggtaatgtcaattactctatagttttccattgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctccaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattcctctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtcgcaaatcatgcatttatctttttattctataacttgtgtgggtaacttttattttactatgcgtcatcccattggacatgtatggcaaaaaataataaccttcctttggcattccattgatttccctaactttccatttagaaatttattttagaatgtaaagtttctaaaaatatattctctaatgcaggggttagtaaacttttcctgtaaagggtcaagtagtaagtatattaagctatgtggactacatatgatttcttttacatcctttcttcctcttcttcatcttcctcctcctctttttttttaaggaccctttaaaaatgtaaaaactattcttaacttgcaagttgtccacgtaatgagcatgtagagagcaaatgattctcactaagcactaatgaaagagaaatgtgacaatgacaggtttttggtactgtcttgttagaaagattcagcttggactcctacctcagaaggcatttcataagcctcattgtcaggatccacaggcatatcttccagaattccttcctgtggggctccttcttcattctaatatttaaagtaagaagcacaaaaagaacatgatgaagtagcatttttcacttttaaaaatcagaaccatgttttggaaaaatcttacatatagggatgttggccacggatcttgaaaatggcacaccttaatattactactggcattctaaactccacaatgcctccggggaaacattgcggcaacatgggttatcaaccctcaaagtatgtaaactttttgctcaagtaatttactatttaggaaataatccacagctatagtccaaagatatttttcacaagatcaatgacagcaggaaacaaaatttttagaattgttaactaaatgttcaatgaataatgaagagttaaaaaattattgctgggtgcagtggttcactcctgtgatttcagcactttgggaggctgaggcaggtggatcatttgagtccaggagttcaagaccagcctgggctgttacaatgaaaccccatctctactaaaaatacaaataaatagctgggcatggtggcacatgcctacagtcccagccacttgggaggctgaggcaggaggatcacttgagcctgggaggtagaggctacagtgagccatgtgcatgccactgcattctagcctgggtgacagagggagaccttgtcttaaaaaaaattatcattcaactactcagtagattatgataaagacctgtattactattacctgagaattatgtaacaactacctatttatggtataatatttagcaggctataaagtgttgtctatattatagatacaacctacacagaattcagacgcaaaggtaaaaagtttggaagaaaacacaataaaatatgaaagttattttgttggatagtatgtatgttattttgactttttttctaagtgtttaacttttataaccacttataatgtaaaagcatacatatttaacacattaattttaaatgacaatgaagaaacaaattcttttctgaaatttgaagactgagactatacatattgaaggaaaataatcaaatacatggtcagaaaatttttctaggtatctcttcctagacaaagaatactacaaaactcagcctgaaatggtcatggctttgttggtattcttcactaaataccttttgttgctttgcatttatttcagcaaagtaattataagaagataaaggtaagtgaaaattcaaagaacagagaggcaatgtgagcctaaagggacttggagaaagagatcaaataatccctcagccaacgcggctgattttcaacaacatgtctgatgtaaaaaagcttccccatgtcttcacatggaagtgactgacagggacgcagaagtataagaaaatggctaacagtaagaaaaggtcacactaaagatcatgcttatggtaggtgggcagagaagcttacagatcattctgcccttgccaatgccctttttataaactaaaaaaaatccaaataatatataaattaaataaaatatgaaccaccccaaactacctcactttaaaatgtggagtaaacatactgttttcgtagtgtttcacttcttggtagatacgcctctgctgcaggatggctaggcacaaggccttccatgtcacaggacttgagctcaagtcctagcttctctagatgacagagcttttgtgatgctgagaagtttcctatgctttttctgagtgtcaattagtcttagtgatcaaacgggacagcaaaaccttctttacaacagggagaaggaaacgacatcattaactttctcattaatatttagattactgttaggatatccaagtataagggaaataaggcaaatttttttccatgattttgaaactgacagagatttgattttctaatataatttgttagaaaattttgatatggaccagacaagtaaatatggcagacctaccctgtttgttgtttgatgatcaaaaaggagttgttatgacggaactaagactgatggatattactggatttgtttatatgttatttggctgaactttgaaggatgtacacagatgtgtaggttaggtgagtgtgtgtgtctgcatggttccagcctgggtgagtgggtgtgtacaagagcaccctgcagtaatggaacagcgtcctgtccggggtgggttcccatattgctccctgagctgccaggataggctccaaccacctgcggcctccaccgaaataattaggtaagttatttgacttgtttgtattaatctttcttaaacgtatatatagctcacattaatttcaatgtttaatgtcagaagtgatttatctttatttaggagtttgatggtgtttttgtgtccagaaatttgccataggacttaattcttgcttatatcaattagccaatggtaaaactggttttgttatatgttgttttgcttcaagtcacagtttccagaaactattgatgaagttaagtgaggatttactgtattatgtgccctctgatggaagtacatacacatcaccatcttaaactaagactgtactagtttaagtgggctattgttcactgatccaataacttcatcaagtgggaacaagctacactagggatgacagcacaatcctattctagagtccaaatcgacaatagggtttacgacctcgatgttggatcaggtcatcctaatggtgtaactgctattaaaggttcgtttgttcgacaattgaagtcctacatgatcggtgaggtcaggagatctatagcatcctggccaacatggtgaaaccccatctctactaaaatacaaaaagttagccgggcgtggtggttctcctatagtcccagctactcgggagactgagccaggggaatcacttgaacccgggaggtggagattgcagtgagcccagatcacaccattgcactccagcctggtgacggagtgagactccgtctcaaaataaataaataaatatataaatagaaaaagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccctacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttactgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcagacacaattttatccctatacctgtatatttactgtttcataaacctatttctaaaaacattgttatctataaagaaatattaaatttcaactccaatttacaactgtgcctaatatagtttggctgtaacaaaaaaagaacattaaaatttgcattttatgagtattcatgacttgttttcaaaatataatcatacttgaaggtgtgaagtgcaccttctatttatttttaccacaaacaagaaaaaaaactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatcttatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaagtgaaagtgaaggaaaagggaagtgatacaaggagaagtaggaaaaaatttcagctactgtctttaggaatacaactacagaatttacataatctttttaaatttcctgttttgaaccatattgtatttagatacctagtaatactttctgtaaggaaattatctttattcaattctatgacttataactttaattttaaatatatttaaaatgacacataataaaggcaaaaattgctttccaaaccacactcttctagaatcatctagggcccttgttaaaaatgcaggtttgtagggccttgtgagtgtcttgttaagtatgttccttggaaaccactgcccgacatcaccaattgtttgtaaaccctgtggtataatttaatatagagtataccaatgtacttgctgtcagtgtgaataattttttttaaaaaagatatgctcattttgaagtccatcaaatgttggcaaatgttgagggttatctgaagacactgggaagtaatccatggtgatcgttaaaatagcaaggtttcatcaattatctggtatctatgctttgtcaaagttagaaatgtagagatacatttctaaattaaaacttttatgtgggaagaaaaattgaaattcaaggctggttggtctttggtatacccaaagaacaaagaggaggttggaggtgttctgaaaaagagaaatgatacacgctgctctttgagaaagttcattggcactagaaaggttctggggagctagtaagcttcaattggtgagtgacagtggtgggcaaaattagtcctagagctgcagcaagttttttcagcagttacagaaaaaattggtcccaggttacaacaggcagcctcagcatgcggacttgtagaaaattacacttttggagcaatgtgatgtttcttgaatgcttttcctcccaggcttcttgattgttttagttgggtataacaagaatgacccaatttgtgtgatcaactttcacagccttaaacattcaaagcagcagaagcgcactttctcttttgcccactgcttttacacttgaagatattttgggtagaaccattgttttgctgcattattgaacaatgtcacttagcctcaaataatggaattaataccttcactcaacaactcacaccaggaggatgaaggagagagatagtagccaaaaagataaaagaagaaactaaaaaagaactttgacttaagaggaaaaaaaggttcaacttaagcacacacccgtgttccaaaatgaaatcaagcccagaactcgtatttaaataaaaatagcatagacgtttcaaaaatgtgaatattctctacttctctacctcagacaggggagtgtgtacatagtgtagatagtatatttcactaagagaattaccatgtattttattgatgcacttaaaaatgaaggcgatagacatgaataccttgttaaaaagcaaggtaaagatatatttcatatgttcaattttctattatcaattcctagtctgctcataatgccattttggggtggggagcaaagggcatctgattcaaaatcaaactaatctcaatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgcataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcatttaacattctataactttagaaatgcatcaaagtggcaagcccagcattaagagctatttgtcactaagggcctgtggttgaagtctgttggatccatctgttctttctgaggcaatatgcagacgaaaggtaaggggagttgcaacataatttgtaatatttgatacattataatacatgataaattataatatattagaaatataatttatagcattacatctagtaagatagatgtaaaagggaacaggtaagtgaaagggcaaggcataagtcttgtatagagtgacaggtctggtacagtcctactaccaaatctataactatagtattttgaatattttgcactatttcaatgtagcagtattttaggtttggttggcctgactttacaacaagataaaaaattccaagttttaacaatgtagtgacctactgtgttttagatgttgaaatctataattttctatcaacattttctactaacctgtaaaagacatgccttagaatgtgggaacacacacaaacacatacatactcacagacacatacacacgaagtacagtagaccactgatgatctctggtgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatatcttaaatacattatacataatccatacctacagattgagaatgcaaatctattttaattaaatgatacctttagagaacccagtcttacacataaataacatatatttagaagccatttatgctctactttgtttatcttttgtttagaggcagggtcttgccctattgcccaggctgtaatgcagtgatacaatcatagctcactgtagtctccaactcctgggcccaagtgatcctccagcctcagcctcccaaatagctgggactataggcttacaccaccatgctcggctatttaaattttttttttttatagagatgaagtttcattatgttgcccaggctggtctcaaactcctggactcaagtgatcctcctgcgtcagcctccgaaagtgctgggattacaggcatgagccactgcacctgagccgtgctctactttggataatctgttactatcttactgattttcttgtcttttgcccttctagctgtttctttagtcttggcaatcaccttagagagagagaaaaagagaaaagatgaaataaaaacaatttatttcagtttttaaaggtttggcagtggaggagagagtaaagctaatatattaaatatatttggggttattttggggagctatttactagttttatctctgaattcaggtttaaatacattcaaccataaattaaaaaataattggtggataaatcaggaattggtgcaaaatcatttttaagaagaaaatgtcattatatagcaaagaggtagtatgctgctttaaatccttattttccttggcaagcctaacaagcagggcagtgcctgctgtatttatggtagtgccatataattagctgactcacctaataagacttcacagcgcagcaacaactgccagctttttttgtcctgttacttggatagactcggttgaatatactaatgcacaaagggaaatctgggaataaactatttttacttttcatgtctaagggctgatcctcctcttctagaaataaaatttattatgtatgttaaactatattcaaatttgtttactattttaagctttcatggattagaatcttgaaggtcagccccttgggtagtgactgaataagacattaacgatgtgaagatgggtcaagctgagaaaggtttgctcttgtgctgagctcagaatcaataagtcatttcatgtttgcaaatacaatgatatttggaggcaggtctttttttttttttttttttttttttttttttgagacagagtctcgctctgtcgcccaggctggagtgcagtggcgcgatctcagctcactgcaagctctgcctcacgggatcacgccattctcctgcttcagcctcccgagtagctgggactacaggcgctcaccaccacgcctggctaatttttttgtaattttagtagagacagggtttcactgtgttagccaggatggtctcgatctcctgacctcgtgatccacctaccttggcctcccaaagtgctgggattacaggcgtgagccactgcgcccggccagaggcaggtcttaaaactagcaactgggtgagaaatcagtggggagggtaggctttgacaaagtaagagataaagagtctgctttcatattttagaaaaacccagggaatgctgaaaagcccataggaaagaagaaatatgctgtcaagatgttagtgagccaaggcccaggagtttgctctcaaaaacagatgagaaactggacttaaaatctgactgggagaaagtactttaggcaaaacaaactactcatatacaaaaggatgggctctgaagcagagagtgaaggcaatagcttcaagatcggtggatttaaaacctagaagtatcttctctaaaagataaaagattaagaaaggctttaagatagctagagcaggaataaagtagtcaagtgaatgtgataccacaaggttccagaagtttccatactaatagaaacagatactaagtgaagtttgaggggccctcacaatctggatagaaaactcttcaagtagatctcaaccttcaggctggaatatctttgcttagctatcccagccagaggaccatagtggttgatttcaaaaggagttgcaattattctatcttgtaaattctctcattgttaagttttgtcacagtttgttgttgctactttctttcagttacctagaaaatgttttctctgaaaacctctatccatgcctcaacagatcggagataaaaaaggaatcatcttacaagattatcaagaaagataatgggctaggtgtatccttaaaaggtcattcaaatgaaatattaaaattcttacttttctgtgttattcggacatggaataacaataacagttaatgtttatttggtgcttactctgtatttggtaccatttcaagagttttatatgcattatttgatcttaaaaaacaactctttgaggaagttactactgtctccattttatcagtgaatgaacagagataggaagtctggctccaaagcccacactcttaactattatgcaatattagttgtcaaatgtcttgaaaaaaaaatctgtgtaattactaaaatattacgctgggctacttattaaggtaaaattacgtttcaaaaaaattaatcctttccaaatgcaatgttaactattcatgatgaaatatcagaactatctctaataccaatatttttattggaataaaataggaggttaaaggaaatgtttatatatataaatgtgtgtatatatatgtatatacatatatatatactatgcacacacacacatacatatctatgtgtatatatatgattttttgcaagggcaaaaaccagattttttttaaacacataatcattaaatctgcaaatatcaagtttatcaattttttgttacaggaaaaaatagtttattataaattcaatgcatagcattttctggtttagacctttccattattgttctgacagaacaaagactatgaggttgtcagaaataaattgttcattttgtttcctaaatatgtggcaaagacattgtatgttttttgtttgtttgcttgtttgtttgttttagaatagtttgaaatgtcttcaaaccttttgaccaaccaagaaagcttttgcctgggcacaggctttatctttcttagcattacactagagatactaatccctcccaacaatttcattatgattatcgcaataaaatataacgatccattaagtccatggggcagatgtttatttatttataaccatgccttattccacagagaatttaaagaggaataaaagattatttcctcattgcatcaaatgaatatcttttattttgtctaatgttgtatttctttttctttaattggcactaaatgtttatttgcattcttttaattacttttaaggcatccattatttctggattacattactgaactctcaataaatcaatacatagttctgtatataattttttcaacattttttccttctttaatttggttcatttgtatctccctttgctgtttattgagtagaaattctgatttttgtagcaaagggagaacaaacaaacaacacacagaatattctgtatttaatgctgcaattgtctctatggttgcaatgtgtaggtggggtgcattcaagtgggcttgtggtatttgtgtgtgtgtgtgtgtgtatgtgtgtgtgtgtgttggaagaatatatattgaggatgattcctaattttatcactttgttgaggaactgaaattgtggctacacattcactctaaatattttgtctcacagtcccctcccttcaacaattatatacagtacactatttgttggaagctcaggagaaaaagggcatttaagagcatgagatttggtggcagactgacctaatagtagatggtaccagtgagatcttgagcaacgtaaatgtttcaactgaaaaacggtaacaataaaacatttttcagagtgatgttgtactaaatgaaatgatatacataaagtagcctataatgacccatgcacagtcataatatcaaatatttactgagcatctactatgtgctagattattttaagcacttttgaaaatataagtattttgataaatgtatatcatatattgtcttaataagattatattgttgttatatttcatcttattgctaattttatttttttaagaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaatagatgatagatgggtctgtcactaagcacatcctagtgacatagataagaagcaaatgctacaaaattataggtgcaaactacaagttgtgttttaattggttttaacaagtacttataagcagaagaactgtgaaaaatctaacattttgtcctacttgcaagcctgccagtcttttgagtgctgggcaaagacacaatagtgctgggtcagagacaattaactttactactcacattaatagcattagcaagagtatcatgattttcttgcactgattcctcaagccgcaattcccacagaaaagctcaggtgacacctacatgctcagtgggttgcattagaaaagaggaacgcagagctcaggaaacatggatattttataatggccagtaaagatgtccctttgctttagaaagaggcactacctctatccaaggctgcaagcacacctgccttttgttttagaaggagaaatgatttctatcttccaaggctgttcactatatgaaaagacagtcccaaacaaaaggcagttactgacttgcttgaaaaatgtgcagaaatgatacgctgcttgaatgtggacagctgacacagggacaaggagtaaaaatgattaggttttgagcttgaccaactaggaagataattattagcagtagagaaaaaaagaacaaagtagattttagggcagataagccattttttaggtaggttgagtctgagatgcctccataaatataagttgaaaatatgagattggagttgagacttcagaaatacatattttgagtagttacactacagaggtaagtcatcagagttcataaaattaaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcagaccattttgttgccaggtttctcctccagggtggctttccagctagtttgtaaacaaataactcaggtggccctgtcatgttacattaactaaaaaccaagtctaaagcacacatataataacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatctaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatgtaaacatattacattaaaaggtggcatgacataatggtatatcactgattaagaaatgtgaggcgactttcatgtgccactgataaatcattataatttgacatagtagataatgcccctatatttcatctgcatacctggaaaatgaggactttcaaaacatattcctgccagttacagtcaggtattgcaaaacaagcatttagtgagcatctaaactgaagcttagaacttcagttttgtggcggggcgcggtggctcacgcctgtaatcccagcaccttgggaggccaagacaggcggatcacttgaggtcaggagtttgggaccagcctggcccacatggtgaaaccccatctctactaaaaatacaaaaattagccaggcatggttgcacgcacctgtagtcccagttactcaggtggctgaggcagaagaatcgcttgaacctgggtggtggagattgcagtgagctgagatcctgccactgcactccagcctgggcaagagagtgagactccatctcaaaaaaataaagaactccaattttattttcttcatggcatagcataatagatgagttaacaaattaatgaaacagattgacatgtgttaattgcaatcatatacagaacagaaatcatttccataaaatatttaacctgcctgttacttcccctaaatctctctgtagctgatgccccaatttcactattagctcttcagacttggatgttaagcactgtgccttcccctggacctctctttaaatgtcacagctatttctggcaggtaagactattgctttggttagtgtgaacacacaccactgtggatcacaaggcacctgagagaaaaggctgccgaaagcaggaaaataactcagaaaaaagaaaaaaaaacacatggtgctgaaaaatacaacagatatgcatttgtatacttatgatctaatttatgtcagtcattaaaagaaaataaggtgtttagaaaatacagtgctgtctatggttatatttaatattgtgaccacttaatacaaagcaaagcattcttgcttgctctcatggagagtgcaatttagaattgagagctcaatttctaaggagggtttatgtactctatcttgaggcacaccaaggagattgagtttaccagtttagaaagcactgccataattcaagtcagggagagggctgatggaagatttttaaaagattttaaaagatcatgagggcaagctggcttttaacaaaacaaaatatttccatgtggcttctggctgactgaattaataaggcccagagactgatctgaaggcaaaagcctttattttttattgcaatggagaaaaactgaacattatttgactatcagttgtgaagtttagtaaaaagattttcactaatgggtggttttaatatttatgaatgtgatggttcagcaaattttctccaatgttttgcaagaccactaattaataatcatctttacaaatggaacatgtaattgtctgctactattttttctttgccaatgcttaatacttattttgaatacgttttattttttttctaaatttctctatttatttctacctgagcatttcttaatttttttattcagtcctgttattctcactgtaggatttttaaaagctggtatattatattaaaatccttcaactgtgaattcagcaatgttttgagttccagggattcatctggcattaggctgaccttgtcaagcataaacatcaacattaaagaaaatatttaagaaatgaaaggcctgaatcaaaataagaggtcaaattttccagggtgttttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttttttttaggccagtctgcatgtccactagaagaaaagggacctgggttcttcatcagcccatccttagatcttagtgcacatatgcacctagtaagtgccgagcaaatattcaatgaatgactgtacctttcctaagaattcttcgttgattatccttcaacagagctaacttctctccctatgtgctcagtcaaatgctctcccattggactgagttcagcataaactgccatgttttgagatgattggtgtaagcgaatgtcctctcctgagttgcgagaatctaagagcaggacaacatcacatgcttctctactttctatagttcttttgtccactgtctaacaaataatgccaagtgaaaaagggaaaaatgaatgaataaattttgtaagatgccaatggaaaaaaacagaaaatcaagagttactaaaaaaaaccactaactccatttaattgttttagactaagaatccctcagtgatacctagccaaaattaggattcagatccaaaataaaagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaatagtctgtatcatctctctgtatatttcagaagtacattttaagtgtaacagctaggggtaaactttcataactgtatgatttgaacacaagtacaagaaatattcaaggttttcttttcttttttttttttagatgaagtctcactcttatcgccgtagctatagtgcaatggcgctgtctcagctcactgcaacctccgcctcctaggttaaagcaattctcctgcctcagcctccgtagtagctgggattacaggatcctgccaccacacccactaatttttgtatttttggtagagaatgggtttcaccatgttggacaggctggtcatgaactcctgacctcagtcgatccacccgccttggcctcccaaagtgctggattacaggtgtccaccgcgcctggccaatattcaagtttacacaggaaaaagaatactttctctgcataacctttacttatttactcataagcctctagttctctctggatttgactgtaaatctcaacacatttcccagaaactaacatcttctggctgacttctattaaaaattcagacaaagaaaaaaactgaatacaatggagagagattataatactgctattctcccattctctctctctacagcatatcacctcctccaaaatcagttcatatctaactcctagcacatttttagttaaaaatatacatgcacaaaatatatgtgtaaatacacatgctgatatcacacatatgtgtgtgtgtgtgtgtatatatatatacacaaaagcagatatatatatatatatatatatacacaaaagcagatatatatatatgctttcttgcaggtgatagaatgcttttttggaggtggttttgtgggcctatgtaatgtctctattgttatattttaaaagtttcttttttgtttgtttgtttgtttgagatggagtctccctctgtagcccaggctggagtgcagtggcaggatctcggctcactgcaacctctgcctcccgggttcaagtgactctcgtgcctcagcctccagagtagccaggattacaggcgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccagattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgaataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggtcaaaagaacagcaaggacaatgtctatccacccaatctggtggcctccgaaggacaaaagccagagttaatctaaagcaatcaaggagtctgaccaccatggaagccctgaggaagtggctgctgtatttcccttttcaagagcttttcgtatacagcgtctatccactctcctatagagatgaagttaactccctagacaactatcacctgtccccaatccccacccctccacttgacatacaaacccaaagagattaattaacatttgttccaggaagagacacagacaaaaacatccgatattggaatattccttcgtgaataaatataaaacttatggagagggaggaagatattttgaaaggaaaaaaatcattggactttattgctcaaagccaaaagaaattgttttttgtggcaaaagtaaaacaaggtaattttgtactgtgtgctgtatttctggcaattatctgttatcttaagaggcttatatagaaagaacaattgtacctactttcacagcatgctctgaggatctaaggaccctcaacaaatagttttcatgctacaagcaggcacttatttaggcacaaataggatgggattctttttttaactgtagtataaataattttatataatacagttatataggcttttttaaacaaaatacagtcagattttaaatctctctattctaagatagacacttcacaatttaaattcaagactccttgtttcttgaagacatctatgaaagcaaatgtttttgagaacttggctgaatctgagtccattccgattagcagattccacattcacttttgagccatgacttagaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttattattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattggaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttacagatccatctctatgccaaaacagataacagcatccaggaattatccaaagtcacaaatcagtgtcagtgtcttgtcactcacccacgtagtgcttttcccttcctcctagttacttaatggataagggcacattgtcaaataaacaaacaagtgaggataaatgttgctccgaaatttaaggtgaatcattagtcagacttggtatcgtcatggaatttggtctgttttctaactagctttattttagcacagccataaatctggctgtaattgtctttaactccgatgactcatacatctaagcatttcatttaactttcaaccgtgaaaaattccaactgatttggcaatatgaatgtgctcttacatgcatatgatcatatgatgctgtcagtacaacatctgtttttgttcttgggatgttgatggactatcatgaaccatcttataactttcccagtcccctttaagtccaagaggatacaactgagaaggcaggtagagtttttggtcagtggctaggtttttcctgaatatcaaacaaattgcctggtatgagaatttaacagaatatgaccacaatttttttaacagatttatctacttgaaacatcgcctcagtcaatgaagaaacttatgttctataactaataataaaagatcatttgtaactgaaatatgacaaattgctgttttaatcatgaggattaccatttagaacagctaggtaaacatttactttttaatccggaaataagttaaagcaaataataaaaatttatatttaaatcacacaacatgttttatcatgaataataaatgtttttaaagtttaaaaatgtacttgttaccttgtgggtattcctgaacatgattaggatttttatttctccaagtatttttattcactcacagaatcaaaatgtcaaggctatataagttttcatcaagtgctaatttagcatctaagtttttattaattaatttgtaaaggaaataataatgagagtcaaaggaagaagcatctcctgtggtgagctccatttccagattccaacgaaaccattaaaatatttatggcactgaggctgaatcagacgggtcttgtgtactctcttgtgtggccatattgtgtagcaacagtgggtttcgaataataagattcagtcatccatttagactccaattggagctcaggcaacttcaatttgtgattataatgattaacttcaaaaagatgcactatttgtagacctatgttgaaacttatgcagtggaactaaaaagccacctatttttataataaaaaggcacaaatacgcaaatgcaaaagaaattcattggaaaatcttgaacgtttcaaatataattatcacaaatgcaaatataaaataacaatatgtttgttaatattatactttcatttaatcagttcttctaagtaaggcaaatatatgaattttttaatatacaaaaatacccccccaaaactccattaagtatatctatatgaccattgggtaagattttttatgattattagtatgggaaaattgtgactgtttagatatattaaatatattaagtaatatatttaatgatttaagattgttaaataatttatattaaaattgaaacctcattttgccagtattaaaaatttcaaaatttaaatacatatgacaccaatgcatacaatgttactttgtcctgaacataagttttaaaagaatttaagtttaaatattctcctaaatgctttgtgagacttaagataaaaaacagttcctcagaactcctgacaaaggggggcagtaaagaagcaaaaagatttttatggagttcagggaaagctgaaaggcctttgtgtacattccctattttctaaacagtaaatgatggattgcattttaggcagactacaaaattgctaaaattaaatgttgggatggaaatgtggaatgcagagtttgcaacccccttttaatttaatattttcaaagaattaagagaaattattatattttattttataaaatattatatttaaaattactcaattctaaatgaatgttattgcaaacctaggcttataagaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtcttgaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggtttattcaactaatagctactgtcatccttagaggttattaacaactcaaagtagtgaattacatccaactaaagggtgcttttgtatagacatttgttcttattgctggtcacttattcttcaaatatcttttaggcaccatttacaaagatgaccagaggtacaaaatctgcatatataatagaaagagccaggtagtcattcaataaaagaaggtatatagtaccaggaaaagatttttatcttagcctaaggcagtctgaattctcaagcccaaagcacataaatttgttggaattatttcaatttctagtcactaaaaatgtgacgcacatttacaccagtggttcggttgattacttctcttcagccctagtctcttaagcacaggtatacacacttacagcaatatctctgcatacaatatttttgacagaatgaaaaagttaaaaatattgatgtttatttcagcgattctgaaatggtttataaaaattctatgactataagaaattcatgaggaatgcaatatatcaggaaagaacaatgtcatctttacataaaaaggatgcgtgtcagtaatttgagaggctggaatctagtgacaaatgtgtcactttttaaggtgtgcttgattcacagctgacagctttgatttgaaattgcctttaaaacaatgtctatgtatcagtgcaatgaattctaaccaaaagcttgttggagctaaccacagtacctatatattcaagatgttcatgggaggaatggaagatttgatatttaggcactgaagggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaaggtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaagtaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagatttgtggtgaaaaacaggtgctgctcaattgcttagtctaaaattctccctcaattccttcccatcacctaatttgtttgacatctagtctttttacattataatatagtatattaaaaagttcttattatggtttttttttttgagatggggtctcgctctgtcgttcaggctggagagtaggctcagtgcaaactctgcctcctgggttcatgccattctcctgcctcagcctcccgagtagctgggactacaggatcccgccaccacgtctgggccaattttttgtatttttagtaaagactgggtttcatggtgttagctaggatggtctcgatctcctgacctcatgatttgcccaccttggcctcccaaaatgctgagattacaggtgtgagccaccgcgcctggcccttattatagaatttttgggcatacattgcacatttttctaattgtgcttcaataataccaaacaagtgggcaaatgcttcactgggctacatttgcatccctgagtacaatttcacattggttttggttttgtgaattttggaggaatttattttgagagatgcccctggaaataaataatgctgatgttttggtgtaattttatttattgcattaatggaatatgtaaatacaatctatcagcattaggcagaaaatatttaagagatatcaaattcttttgccgagaaaggtagtagtttgccaggaactacaagctttctaactgaacttttaaaaataaattttaatttttaattttgatagatcatcatagttgcacatatttaagggctatctgtgatattttcatacaatactgccatgtttactgccactattcacaatagccacgatatggaatcaacctttgttcatcaacagaagaggagacaaacctgactttggtctgtgctggctgcaggttctggagagctgtttgaagtgacaagatggcaaatgaaagggtcagttggttgcctggtggattattcgtcctcataacactttacctagaaattttgccttttctcacaaaaccataataatggacaaacagcatgaacctagatatgcacccccagtcactatcgtaaggtcaagttggtatgagtcacataagtagaggactagaagttttatctgaatagtattgtcatagtggctaggaatgagagtgaaaagtagactagatgtgtgctttgatatggcttggagcaaaaggtcaggtattggggcacttctgaaatgatatctattatttaggaactgggtcaggaaaatctataattacattcctactgtatttacataccattcattcctaagagagctcttccaaaaaaaaaaaaaaagagatgtcagtgcataaaaaataaactccatttctttctcaagcccaaagtacataaatcttgaaattttccagctaaaaaataggcatatgttctagcatcagctttaatttatcccacattcattctctgctacaataaagtgacaaagccattcatattttatgttacatctaattatctgtttttcagttagataaatatgctttatatcctaggtaccatcagaatttcaaagctcagaaaatcactaatgagaatggaaggaattaaccatcatgcaagcagaagcatgcggctaccatgctacattgctcagagttcatgtagcagtttaatcagggtagcagctgtgcaatgagctttgttggaactggagtctcgcatcctaaatgtgaaatatctactgtttgaaagggtgataactttatgccttgcaaagaaaacagtcctcaagtgttattttttaatgaattaaccctttatctttcctcacaccttttctcttctttttttttttttttttgccctcagaagtatttaaaggataatcccatatgataactcacactgcctagcttcagtacaatgtctcatacattgcaggcactcacaaacatttgtttaatgaatgaataagtgaaagtccaatggaaaattacactgttgaatttacaatggttttagaggtacatctctaaatttgttgatttatttaggattgtacattgtcacattttcactgctaaatttcatattattcattaaagaaaggcagtgttggagagttttatagttgacagatgaattatctataacttctaatatactcagacatcatgtttttctagcatgtaacttttaaaatataaactctccaacatttaaagttttaacactttttagtaattttttaagaaatgacagatcaatagtagctttccataaataaaagcctattaatttgtataacataacaaaattcagtgcaacataaattcatatagtactcctacaagaaatctataggagtaaaattatgattataaaaatcaacagacttaaacaaacaaataacagctttcaattaagtttatagataccaaagacattcaacctttaacatcccactgtgtaaaatcaaatgggaaaggataaaaggaccaaagctatggttagtaatataattgattgctgccctacctacaaactaatttgttttaatatctgtgctagaaccagtatgttaccccttttaactttagctaaataatgtttatacaaaccttactatgcagagctatctttaacaagagcatcccattgaggaaaaaagaaaatagaaagatatgaaaattttcacttttttctaataccaacagatatcactttattgatattgcatttctgtatataatgacatagaatatgagcattccctgtagttcagttttactgacagtaacattgcacaaatcattttagggctatgtgctatgcagagacattgtacagttaattggcatcattaagtaacattttgaaatgatgaggtgttcaaatgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatttctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagttgtggctttgatctggttcctgactttgaattattttgttcctatgaagtacaggactttgtaataaaaatccaccatacacaaaatcccctggacttaagaatatctccacaagttataagaattgaaactgcttagaaggaacaattgcttgtactcagccagtcatcctcagctgcatgagtctcaaaacgggggtggagagtgtctacctcctccagaaaaggtttttagagcgaaatcaaagagactgcctcttctccaccaaaattatttgtcttaagatggggacaagaaacctggcacccaggagtaaggacacagacgtgctctctcattttaagctgaagctgaactgtcttgtcctaaaaacatatgcccagactctagaaaagctctcttagacagactgctaatttctccatttctgtcacttaagaggattttagggacatataactttgagaattccattctgcagctttcagaggtaatacaatccaatactcatagtgggcttatggtgtacccggcacttttccaaacattctacttgttatagcttctttaattgaggtacgtattcttatcattctccatttgggagatttgagagagaggcaaagtatgtgccttaagatgacacagttggtaagtaggaaagcagaactttaacatcagcagtaaaaccctgagactattgttttaatgtgtttaataaatgccccactaagaaaccagagcaaattaaaagtatgctgtgttctattaatttgatacaggcagaagaaatctaaaaacagcaaagaatgatatttaagaagaactctattttaagtagttataggacatatgcttaaactgagtgaactttttatgaacttttcatcagagatttttttttaattgttgtttttctcctgtgtctgtgactgaataaatggcctctgttcactggaatgcttcacatgcttcctctctcagttgtaggtgtgtttatttctattcagacaccaaaggcctatgggtatctgcaaattaacagtttcatttgctattatgttccatcattgtgaagcagcacaggaaattaacatatctgtaaccacgcccttactatataatatgaaagtgtaaattaaaacatgccgtgttcattaaactgagataaaaccacattttgaaaataaagtttagtaagtggatacttagtatcacattggcgatactaagcttatgacttgcttttaatatttggattgcaaataaatttggaagctaatgtatggagtacaataatagcgaaaagcatgggctttgatattagacatggctatgcatccgaatatcttattattggatattcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttggggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaattttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatagtctcgatctcctgacctcatgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaagatgcttacaattgatgaaggaagaatgattttaaaacacagagcaaaatgttattttaaatacagaagtctattcttctcctccatgaataactggcattctgtttctattgtatattaggttgaaatatgtgtttttgtcattaccagtgtttccacaggataagactgaaggcacaagcatttaatatttgctgaaagcacttaaacagaaaaaatattggctagtgagattaagaatgaaataaggtagacaaatagctggctgcaaaagagaccttaaaaagtttctcagagcctggccaaaatggcaaaaccccatctctactaagaatacaaaaattagtggggtgtggtaccatgcacctgtaatctcagctactcaagaggctgaggcaggagaattgcttgaacccaggaggcagaggtaggttgcagtgagccaagatcatggcactgtattccagcctgggcaatagagcaagactctgtctcaaaaaaagaaagtttatcagtctattaagaatatacttgatttttacaagaagaatcaattgctttacaaagttatttatctaaaatgtatgaataaaaatgtataactataaacatatctataaaactagtaaagatcaaaagctcaggtatctttaactttctctgcttctactattcacaaaaatatttgctcagagacacagaaactcatcttcaagatttatttttatctgggtggagttacagagttgccttggtaacagcaactatcaccaaattaagtgttaagcacacgtttttaaacatttttaacattttaaaaatgcagatgccaaaggagagcaatgtcaggagagaatgttgtaaactccctttttcccacatctacttgacattacaaggtttgtactactttcagaaattctccagtgtttaaaaaatgcgtctataaacacacatatacacagagcacttcttattgaagtaatcaccttaaaaattatgtaatgcaatgaaaaccacaatggttttcctaccattgactaagaaagcaaaggacctttcttctgaaagtgaggaggacctcttgcctcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacactaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaacggtgcaggacaaatgaataaaatacattttgcctctgtcttaaacttagaacagatacgcaatctctttaacagtatgtaaaaattcagtcttttctttctttggtttccaaattacagtgaaatgaaacattttccttttatgtgtaattagtgcagtttaactaagagttatggagcatctttccacctcatggtgtatccatgtagctgaatttcttcagcatttgcttttttaatttgtataaggagtaactgttccatatcttagaaatctttgaaattagaagttgatctaatagcatctctaatgtagtctctccttgaattttaaatataatagatatgacctgttatttaaaagatatagtgtttactggcatataacagttgtgttgagaatttttcattgaataaaatatatttcccttgaaatttttgttttatggtcatatctcataatccacctctgaatcaatgaacacttgtattggtggagaaaacaaagatccttcagacagactttctgtgtggtatgttctttctgtttcttttctaataacattaacttacatttaaaattattataattcactctattttcacaaatcatcaaatcatactcagatatttaaaaataaattttattgtatatatttacagtaaacaacatgctgttataagatgaatgtatatggtgaaaaggttattatagtgacaaaaattaacacatccattgtctatctcacgtagttacccactttttcccctgtggcaagagcagctataatctactcaattagcaaaaatcctgaatacaatacactattactaactatagttgtcatcctgcatgtcagctttttagttcctcctacatatctgctactttgtatccttagatctacatctcccaatctcctccctgccacctcactcatggtaaccagtgtgtggactgtgttttttgtttttttattttgagacagagttttgctcttttgcccaggctggagtgaagtggcgccatctcggctcactgcaacctatgcctcctgagttcaagtgattctcctttctcaactgcctgagtagctgggattacaggcacctgccactatgcccggctaatttttgtacttttagtagaaacaggatttcaccatgttggtcaggctggtcttgaactcctgacctcaggtgattcacccacctcggcttcccaaagggctaggattacaggcgtgagctaccacatccggccggtaaccactgttttattctaactttatatttgaactttttctttttagattccacatataagtgagattatgcaattttgtgtgtggatgtgtgttggacttatttcccacagcttaatatcctccaggtccatgcatgttgtggcaaatgacagggtcttctccttttttaaggctgaataatattccattgtatatacatataccacagtttcttttatccattcatgcaccaacacatacctaggtggtttccatatcttggctactgtaaataatgctgcaatgaatatagcagtgcagatatctttatgaggtgatgattttatttcctttgggtacatccagaggagggattgctgggtcttaggtaattctaattttaatttctttaggaacctccgtactattgtccataatgactgcaccaatctatatttccaccaacaatgtacaagggttcccttttctctacacacttatcaacacttaaactgaacatgtagactttttcttttcattattctctaaacaatatagtataaaaactatttacatagaatttacattgtattgggcattatcagtaatctagagattatttaaagcagcagtccccaacctttctggcaccagggactggttttctggaagaaatgtttccacggacagggatggtgaggggaaggggaatggttttgggatgattcaagcacattacatttatcattagattctcataaggagcgcacaacctagatccctcacatgtgcagttcacaatagggttcgtgctcctatggcaatctaatgccaccactgagctgacaggaggaggagctcagctcttgctgtgcagcctggtatcgaacagcctaacaggctatggaccagtactggtcatggccctggggttggggacccctgattgaaagtatatgagaggatgtgcataggttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgactgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcattccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaaaggccaacttttagattgaggcaatgaaaactcagaaacttttttggaatgaccttcagatttgagatgaccactgtttcaacaatatttcagttataattctttctctatattcatttagggaaatttgattctgaaaaatacaaatagcttcctttctcctgagctaggactgtatttagaagggaataaattgtagattttattaaaatttgatcacattttctttttttgtgctacgacacagtagcaatgtagattgaaggcttttacatgtatttttaaaattgccatagagaattatttgtattaatcatagatttccaaggctgcaaaagctaaatagtaaagcatataataatggtagcgttaatttgaaaaaaaattccagctagcaaaacatgagtctagatgtagatatcatgttcaaaaatcacaaagcagattgccagcaaaaaattgaaccaagtttttccccttcagaaaactagctttatttaaaaaaatttcctaatatttaaattgattcacacgtttataactatacaagggtttccttgtttcatcaaagaaataagtatgaatgagcagaatgttttagtataaaagtttacaaagtttattcacactcggaacaaaggaataagtaggaaaaaaagagcaactaaaaacaaatgaattcttttccccatccctctcgtttgtctccaatcagttaaatccttttaatgatatatcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgtcttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtggcagctctcagacaatgggagacaggagctaatggctgtttcttcgttttgtccttcaggctgataatccagaaaaccaatctgcacaatgcttgagaaggtgcagagaattagagccctcattgccctcaatgcagtacctttatattggctttttctccttattcatcacatgctcctgtttcccgagattgccacccacatatactacttgcaccctacactatatttcaggctcttccttcaggataatgaaaccaagctaaaggcaaaatccaacttttgtttaactcatcctgcttctgagctcccaagatccctgaacctacttctcttatataatttattatagaaagttatttaagcatgagatttctctagtttatctttgaatctccactgtcaatatagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcaccttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctcccaagtagctgggaatacaggtgcctgtcaccacacctggctatttttttttttgtattttttttgtaatttttttttgtatttttagtagagacagggtttcactatgttggcctggctggtcttgaactcctaaccttgtgatccacccgccttggcctcccacaaagtgctgggattacaggcatgagccaccgggcccggcccatatttttattcttaaagaaccagaactatatgcatctagtgttccccaagttttcttctttgtcttttaacattccaggaaaacagatattgagtgttttgctggatcatgcatagttccatatccttttgaccctctgtttgctgtagccagctttgattctttggattcatggtcaccctataacatattcactaatccaccaatgaaaggttatgtaatgtataacaatcaactcagggttttctaatgacaatctttatcaatgttctataagcttgaaaattaatttaataatttataccattgtgcataaaatataataaaaactttaatttaataacgaaattcatgcatacttttacaaacttatcagtcattcagaagtaaatgtggacttcagttttgtgggcaggggtttacagaagtatgttttactaaagtttggagaaaagatcagtataaaaatatgaaattataccaatagcattattagaaatagttaaaagacaaagtttaagtattttcataatcatatcactttttaagtgactaaactactaaagaaacatttagttaactctaaaatattgttgtaaaatttctatgtgttttgaggaaaaatacttttattccatcataaaattttcaacttagagaaacaatttgtttacttgaaaaattataatattttcaagtaaaaatggttatactgacaatttattaaaacataaataaaagttcttcccacactttgacacatgattagaaaaaaaaaggcagtaagattttcatacagaattctggggttaagtagaattcacttgtgtttgctggtctaagatgcaatggaatttggaggcaatggggctggattctatcaaatcagacacacggaagaggttataacgtgagaatttatattttttcattttctcagcccacacttgaaataacaatttgcaagagttttgctttgctcaatattaggcctgattagctaaaatgctcaaatttccattcaatccttaaaaacagatccacacttagtcattcttcacacctctctccctcgccctttcacacccaaattgttaacttttttctctattctcacatttatagtctggttcagacttccgtgatctgtcacttgctcttgtggttaaatttctgaagtgaaattcctatctctaatctcttctcctatgtatgtcatcagacttgcaattttttctaaacccaaaatgtgttttcactagtcccctgttaaaaaactgtcaacacatccacattgcccactggctatagagttcaattcaaactagagtcattcactacttggacaaccagcttcccagctccacctctgggtattctttctcttgccttcagaatggtgttgaggatataaggtgaatgcaacagccattgctctcagtgagctcatagtctaagtgaggagacagatgagcagatcattataaaacaaattggcaagtgcaatgacagaagtgtgcataggtgctatgggaaccaagaggaaggatatataataagccagggaaggaagagaagattcagggagacttactggaggatgaattgccctcagaaagtattgaagtgtaggtaacagttggttaagagaagcagaaagaaggaaaaggagacagcagcacagggtgccaaaataagaaaagcctgggtaatactgccaagagaaatctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaacataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatgcctatctgagacagctttgtaatgggtctctgcccctgtttctctgtccacaagaggtactaattcacttctcttcagttgttagacctaggacacaatagacaccaagttacatttctgttaggtgcatcttggaagtgcctgagaactgaccactgggcacctacctttttacctaagtctctgttaatgttggtctgtttacctgttagtagtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacatcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaataacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagattgggccctatatttagcctcttaaacaaaataattatcagccaagaattttgtatccagtgaaactaagcttcataaatgaaagagagataaagtctttttcagacaaacaaatgctgaatttgccactaccaagccagcactgagaaatgctaaaaggagctctaaatcttgaaacagtaacttgaatacatcaaaatagaacctccttaaagcataaatttaacaggacccataaaataataacacaattaacaacagcaacaacaagaaggtattgaggcaacaactatcatgatgaatagaacagtacctcatacctcaatactaatgttgaatgtaaatggcctaaatgctccacttaaaagatacagaatggcagaatggataaaaatccatcaaccaagtatctgctgtcttcaagagactcacctaacacgtaaggactcacataaacttaaggtaaaggggtggaaaaagatattccatgcaaatggaaactcaaagtgagaaagaatagcaattcttatatcagacaaaaaagattttaaagcaacaacaattaaaaaagacaaagagagacattatataatgataaaataattagttcaacaggaaaaatttacaatcttaagtgtatatgcatctaacacttgggctcccaaatttataaagcaatcactactagacctaagacatgagatagacagcaacacaataatagtgggggacttcagtactccactgacagcactagacaggtcatcaagacagaaagtcaacaaagaaacatggacttaaactataccctagaacaaatggacttaacagatatttacaaaaaatcctacccaacaactacatccttttcatcaacacatggaatattctccaagacagaccatatgaacaagtctcaataaatttaagaaaatcaaaattatatcaagtattctctcagaccacagtggaataaaattaaaaattaactccaaaagaaaccctcaaaactatacaaatacatggaaatcgaataatctgctcctgaatgatctttgggtcaacaatgaaatcaagaaagatgaaaattttaaaaatatttgaattcaacaataataatgacaaaacctatcacaacctctgggatacagcaaaagccatgttaagagcaaagttcatagcattaaatatctacatcaaaaagtctgaaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcgggcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaactgataccacagaaataaaaaagattattcaagactactgtgaacacatttacgtacacaaactagaaaaccaagaagagatggacaaattcctgcatatatacaaacctcctagattaaaacaggaagaaatagaaattattaacagaccaataatgcatagtgagagtgaaacaataatagaaaaaatgtcaggaaacaaaaaaagtctaggaccagatggattcacaggtgaatgctatcagaaattcaaagaaaaattggtacaaattctattgaaactgttccaaaagatagagacagagggaatcctccctaaatcattctatgaagccagtattaccctaatatcaaaaccagaaaaggacataacaaaaaaagaaaactacagaccaatatccctgatgaacagagatgtaaaaatcctcaataaaatactagctaaatgaatccagcagcatatcaaaaagataatccaccatgatcaggtgggtttcataccggggatgcagggttgctttaacatatgcaagtcaataaatgtgatacaccatataagcaggagtaaaaacaaaaatcatatgataaactcaatagatgcagaaaaagcatttgacaaaattcagtattgctttatgattaaaaccctcagcaaaactggcatataagatacacaccttaaggtaataaaagccacttatgacaaacccacagccaacattatattgaacgggggaaaatttgaaagcatttcccccgagaactggaataagacaagaatgcctgctttcaccacttctattcaacatagtactggaaatcctagccagagcaatcagacaagagaaagaaataaagagcatccaaactgctaaagaggaagtcaaactgttgctctttgccgatgatatgtttgtatacctagaaaacctaaagactcatccaaaaagctcctagatctgataagttaattcagtaaagtttccagatacaaaatcaatgtacacaaatcagtaccagtgctatacaccaacagcaacaaaactgagaatcaaattaagaacttgagcctttttacaacagctgcaaaaaaaaaaaatgcttaggaatatacctaaccaaagaggtggaagatctctacaggaaaactacaaaatattgctgaaagaaatcacagacaacagaaactaatgaaaacacatcccttattcatggattggcagaatcaatattgtgaaaatgagcacactgccaaaaacaatctataaattcaatgcgactcccatcaaaatgccaccatcattcttcaaagaacaagaaaaaaaatcttaaaattcacatggaacaaaacaacagcccatacagccaaagcaagactaagcaaaaaataacaaatctggaggcactagattacccaacttcaaactatactacaagactatagttaggaaaacagcatggtactactataaaaatagacatgtagatcaatggagcagaatagaaaatccagaaataaagctaaatacttacagccaactgatcttcaacaaagcaaacaaaaacataaggtggggaaaggacatcctattcaacaaatggtgttgggataattggcaagccacatgtagaagaatgaagctggatcctcatctctcaacttatacaaaaatccactcaagatggatcaaagacttaaatctaagacccaaaaccttaaaaattatagaagataacattggtaaaactcttctagacactggcttaagcaaagagttcatgaccaagaaaccaaaagcaaatgcaacaacaacaaaaaagataaatagatgggacctaaaactataaagcttctgcacagcaaaagaaataatcatcagagtaaacagacaacccacagaatgggagaaatatctgcaaactatccatctgacaaaggactaatatccagaatctacaaggaactcaaacaaatcagtaagaaaaaacaaataatcctatcaaaaagtgggctaaggacatgaatagacaattctcaaaagaagatagacaaacagccaacaaacatatgaaaaaatgctcaacatctttaatgaccagggaaatgcaaatcaaaaccacaatgtgataccaccttactcctgcaagaattgccataattaaaaaataaaaaaataaacgttggcatggaagtggtaaaaagggaacatttttttacactgctggtaggaatgtaaactagtacaaccaccatggaaaagttatggagattccttaaagaactaaaagtagaacaatcatttgttccagcgatcccactcctaggtatctacccagaggaaaagaagtcattatatgaaaaagacacttgcacatgcatgtttatagctgcacaattcacaattgcaaaaatatggaaccagcctaaatacccatcaaccaatgagtggataaagaaaatgtgatatatttacatatatatataaagcataggggggtgtgtgtggatgctatggaatactactcagccataaaaaggaacaaaataatggcatttgtagctacgtagatagagttggagaccattattctaagtgaagtaactcaggagtggaaaaccaaacattacatgttctcatttataactgccacctaaactaaaggatgcaaaggcataagaatgatataatggactctggagacttgaggggaagggtgggaggaaggtgaggaatgaaagactacacattgggtgcagtgtatgctgctcaggttatgagtgtaccaaaatctcagaaatcatacctaaacaacttctccatataaccaaaaaccacctgctccccaaaagctattgaaataataataataaagttaatcagaaaattattgtctataacaccaatatattatttttattaatgcatttcttttaatgtattgttatttgtcattaattaaattagtagttacactattaagcgatctgttgttataattaattaattaacctccctttatcaattaaattataaagccctgaaggcaactgagtagaggcccaataagtgattgctgaattgaaatgctgaactgaattatacttcattatatagaaagcctcatatatagggcctcacatatacccttacacaaaatataagaatccactacaaatcacttcatcgattaatcaactggctgtactttgtaacaaggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcacatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataaatgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatgcacgggcaaacatgttttgttatactaatgtctgaagtacaaattgttgtagaatcattttattccatagacttccaagtctaattctaatactaacttccatcaatagttaaattattatttatcttctatccaaaggctacctgaaggtcctatcactttggtgtgagaagaatcgggtaagacaaaaagttaggcttgcaccagttatcaatagaatattaagaaagatttttaagaaggagaatagcagttccaggttccacatatttgatacttttcaccagaaaataggaaagacggattgggtctgcaatgtattttcaaagtcaaacttctattcctctatttaatgtatttttacagagatgacttgagaaaacacacatttcttttgaatcttgatgtatatatttttgacggatcagacactcttacttgagctaggtgatctcacatcattatctgttgctatgtgctattgtttctgtagccaaatgaatgggccattggcaatcaagccaaacaaattttgcttttacacccgattttagcattaatctacagacacggcttttcaatagtagaaaagatatctcccattttagtccaaatttaagtatagttaaagctacattttgggaaaaatgttttatcatttttttgttcacttgtgggatgaaaagtaggattaaacagtccattatctctaccttctctaactgcctttactaaaattttaaaatatttcttttgaagaaacaaaacataatatttgccattaaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacggtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggtggatggatgaatgcatggatgaatgtttgtgcctgggaacccttctgtcatcatgcataagcagcctgagtcttagataatactatatgacatgctttcttcatgtgaataaacagacctaaagacaggcactaggagaccctgggaccacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaaaggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatgttctctaagtacaacactgccatgtgtgtgaagagatatctttattaaaatttttcttaagttgttccttcctaaagtagtgaaagctgagcagatcttagaaattcatttagaattcatattactcaattacacttgactataacacttaagaatctagttattttccttttgtagtaaaaatatattttatttgaaatatgtgaatggttacttagtcattttaatctacatgaaaaatttaaccttaaagtaactctattttaaaaatatgaaatgagactatcaatcggtacttatgaagcaatgtttattcttctaatatagtgtgggaagagaaatgtaaaagtcttgcaacacaaaagggattgttctcacaaatcataggtttgtgagatggggtggcaaaatctcattgtttttaaagaaccaagctgttcttcatgagcaagaacactgaattccctggttttctttttctagtcactatacccctggcatcataacactactgtcaatcaactgcatccagaaggtagaataaaatgccaagtgatactttcggcagaattccagagattctcagatggttttttcttttccctcttaaaaactgtaccatatgagttaggtttattttgaaatgtccatgaaaaagaagtcagatatttcttaaaattggcccctcttagatatttctggggaagcttcatataattccatttgttcatgttattccttttcatcataaatcagtcctctataaagagcttcaaattttcactgcctgatgctactgtaaaaatatacctaatatgtttgatcgaaagacagtagtcaatatatttattaggagaaatactttattcactaatcttaagaaatactagaggaaatccagtacaatctgaagttaaaactaatgattattaaatgaatgttaccattttattaaaaattaataatagtaataaaaaactacaaagtactttcacatttccatttgactctcacaataactctgcttttacacataagcatatatacttacttacctgtatacatgtacacatattatgtataataaccctcttactatatgtaagattcagagagggtaaataacatgaataagaccacaggactcttaaattatgtgctagtgattataattcctacattatttctataggatcagctggcttcactgatatcaaaagattatatatagttatataattttataaagttctgctaacttagtgactttatatgcatttttcaggaaacttgcaaaaacaagaaggtgaataaacttcgaaatgagaagagttcactaagcataatgcatttattttgcatcaggatttttcaacgttttaatttttaattaaaaaattaaacatttttaatagccgacatacatctccaaaatttacttctccaatctttccaaaagaattgatgaaaatgtaaaccaagatttagatgtaaggatgatcattataacattataagaagcaaaaattacagaaaaacattgtattcaaaaacaggtgttgatgaaggtatttactttattcacaagtaaactgaaaccagagagatcacatgatttggtcacaggcacagcaacaggtaggagcagatctgggatccaaatccatgttagctatctccagacatagatctctctccaccaaaacacacttcagaccacactccaactatgggaccaatggtttgccccattgtttattgcctatggtaatgggtttatgtataatcgtgactaaaatcattatccttttaaattgaaagaaagatgggatgggtgggtaaatagattacagcagaaccaagcagtagattgctattttgccacacataccaaatattagataatgaacttcatattaaatatcttctctaggtctttatcttcatcatagctcacaatgttgtatgatgctctggcagaaactaaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaatgtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaacagtctttacttagcaagtataaatgttagcaagtataaatatgtttaaacataaaaaataagactaaacaagaataaaaactgtttttaactataattatcaagtctacaacccaaaagtctttttcccatccttgacacaataacattcaaacatgatttttaatgatctcgtagtacatttattgctaaattgtactcaaaataatgtttcattttacttaagtggcacaagccccctgtaggtatgattacattccgcatactaattcttcttgagctcactgacagaagtgactatgtcttcttataaaatttctatactcccatgatctagcttagtttcaaccaaataaacggcattcagtttatatttgctgaagggaagataatctccttctagttagcatctatccacacacagtgcttaataacagattgtatcagagtttgctagttgtccaccaaaatctgttctcccttctttgtcagggcatatggctatatactacaattttctgtctaccttgaataaattgtggctggtatccaaaggaatgagaaaggaaataatgtatgctacttcgaagtgggtatggatgcatcccctcagaagacggtggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattgttaacattttacctcatttgctccctctgcctaacacatggatgtatttgtgcgtgtgtgtgagagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttccctcctacttcctaggctgctgggcacactgccattgacctctgcttgacatctccttcctccccctgtcagcagccttgctcagacatcaaccaccagtgtttgcatgtccccatggcaagaacaagggggaagggagtaggagggaaaattagtaaggacaagggaaggtggatgaatgaattcatttttaatataatgctacgtgaaaagaaatgccagaaagtaacattctgaaaatcactggtaaaagcatccccaaagtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacactgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgccaaaaattctcacaaatgaataaagacagaactgattaactgtattaagtgtcctacttaatacaataataattcaggttttaaataatttcaacatcagttcattatattaattaatctcataaaaacctcccaattaatgtactatgtataaattttatcaagtactttgatgaattaagaggaaggtaaaggttttcatcaatatctgcaataatattattaaattgggctaaaaggaaccaagacaaatgaagatatataagaaaactaatcattattttagactaaaacaggaaaagaacatagttatctaggacactgtctccttagtttttaatgtttcttccccagatgggtttgcacatcttttgcctgaaaaaagaacttatttccaccacacaagttacattaaatacgtcttttagctcctagggagctgaaaggcaagtccaaaatgaacttttttattcgttatgtcatgaaactataacactgcattattaatacacctctaatcaataaagcctaaaaatccattcccaagagacccagatttctctaccagttctagttgtactagttattctcagcggtaagttttcctagttcttaatattaaaatgagaggtccagaggctctaggtggtggaggggttgctagctaaaaggagggtgtcctacagaaagggacagagtctccatgagcaatgctggatggtacctgtggtccagttcttggcacatggtgagtgctgcctaagtcttggtgccctagacctgcagcagcaatcggcggggaaaggaccatgactttggtgacaaaagtgatggcagaagagtggaaagaggtatgagtgatgactaaggacaaagaaacaagggtagaaggacaattccagcagcagcctatccgaataacaaaatccttatctcaggaaaaccatctctgctatgaatacatacacacacatatattcatcaggtatcaatttaattactgattggaacactgtaaacttgttcaaaatagaggttattattcagtatcttcagctgtccggattcaccattttatagcatgctctctgacattagtgagaatgaattgtactctacatatttaggtaatggtttggtatacagctgctattaacgatttgtgtgctatgcaatatttgtggtctcctgtcacccacctcaggagacacaactgatgtaagtgagacagctcagcatatcctatggaaaaatctcttattaaataaaggtcaatgattaagtagtatagtcattgaattaatttgttttccttaagaggagctctcctcaggtcaaaattaaagtcagggatagataagtctctcatatggttcccccagtgtgagaggagcaagctgttggtttcctttggtggcttttttcttgtctcagaagaataaattaataaattctgcatagctgtgattttgtgtgacaaaaatgaagaacctgtgcctctgtttacaaagcaatgcaatgggaatcacctcccctggtgtctcttccccatcaccaccactttgcccgctgaaatgttcttaaccccacccaccataaaaggtgatgataaattgttgcttcaaactcatgctgattgaaattttccagctatttttaaataacccccactactggatttcttgcttctatgttatatgacaatgcttctttcaggtgaaaatgtcctggaaacaagtaatttttacctggctacctttttttttttttttttttttataaagaaagaagtttaattgactcaccgttctgcatagctgaggaggcctcaggaaacttacaatcatagcagaaggggaaggggaagcaaggcacacctcacatggcaggagaaagagagagcaaaaggaagtgccatgattttaaaccattagatcttatgagaactcattcactatcatgagaacagcatggagaaactacccccatgatccaatcacctcccataaggtccctccctcaacacatgggggttacaattcaagatgagatttgggtggggacacaaagccaaaccgtatcactatggatggtagtatcagggtgcacatgcatctttttttttttctctctgattttctttttttatttaaattctttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattataggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttcttttctttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttgcaaggctctgattgagaacctctggacaggcgcttatctagaggttacagtgtgtgactaacacgacacagtttaggatttatgtaacaggaatatgctatagggagagaaagaacagaagacctcagttgacacggtggaattggagtgagagagatttccatgaagccaagtaaatagtattttggagagtgaaggaggagacatcatccttaacttcaatattattatcctgtgtagattcatactttgtgtattttttacttaagagaaaaaatagtaataatattcgctaggagaaacactttgaagaaagaaataagtccaggagccctgtaatgtacttttcctctatttatttcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttggaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctgtccaccttagcctcccaaagtgtgggattacaggcatgagccaccatgccaggcgagaatttgcttttaaatgagaaagacacaatacctgccttcggaaagttccctgtcaaattttagaaataaataattaaacaaagtttataggcataataagtcataatattcttgaaaagatatgcagagggttccaaaggagcaccaaccaaccagaggggaaaatatgggggcaacagagaggcaagaggtgatatgagagagaaagcctgagctagaacacagagccaggtcatgaatctgaaggcaggaacaactctgtcagctgtgagacatgaatttggaaggctgctgggagagaaaagcagagattagtcgtgcaattatctacttaagatattttgggctggaagcagtggctcacacctgtaattccagcactttgggaggctgacgcgggtggatcacctgaggtcaggagttcgagatcagcctggccaacatggcgaaaccccatctctactgaaaatacaaaaattaaccaggcgtggtggcagatgcctgtaatcccagctactcaggaggctgaactaggagaatcgcttgaacctgggtggcagaggctgctgtgagctgagattgcaccacggcactccagcctgggcaacagagcgagactccatctcaaaaaaaaaaatatatatatatatattttgaagtctagagatgaattccagaaataaggtatacagaaagtgaaactgtaggactttgtgattgactagaactgagggacaagggagagggaaagggaagagttgaagatgatggaaacaatagattacaggaagaggatcaaatttagggggaagaagatcagatcataatcaatacaacttaattccacatgttctgaaagttaaatatctcctctagccaaaagacccttcctattttacttctctggacctcttaatgtttctttgatgtttattcccctgcacaaataatttaacccctttacagatccaaaattttatagtaggcaaatattgtaacccccttgaaaatgtatgttatgaatagcctttgtaggtgatatttttgcagtttggtaacttaggacaaggtccattttcctgtcccttgttaaatgtcacaagacttcatcttctctacctatatatcacaaagtaccttctgctctgctgatcacaaggtaattaagttttggagtggaggagtgtcttaggtttatgttcatgcattaaatataaagaaatctatgatttttaaaaaattaactatattgaggtataattcacttacaatcatatgcactcattttaaatgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaaggaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttaccatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttaagttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatacaaattagttgagttaagcattcagataatttgggtccttctcaggtggcctagcaagttagtcaaaagataagacctgtaatcaagctgccctctctcattaccgtcgttaaactgcataggtagacataataatcgacttgaataatgtaccatcaaacaacattaaatagtctatcagatcacactgcttatagtacacattaactactcatatgctttactatctaaagcagggttgtccagtcttttggcttccctgggccatatttgaagaagaattaattgtcttgagccatgcataaaatacactaacactcatgatagctgatgagaaaaaaacaaaaacaaaacaaacaaaaaattcataatgttttaaggaagttcacacatttgtgttggatctcattcaaaaccatcctgggccgcttgtggcccatgggccacgggttagacaaacttgatctaaagcaataccatccattataattattctgtgagccaattatgtaattttaaattttctagccaccacatttaacaaattaaaaagaaccgggtgaattttatattttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagtttagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaaaaaatataaaatctttaaaatatcagtcaaacgacaaattccagcttcttatgaatgaagagccagttaaatacgtttgaatgaaaaatgacgtgtgaagtgatatatgtggcagttaaagttaaccaggagagaaagctaaactaccgctgcacaggctcagcatctattgcactaatctaggcatgagttgtgtcctatccaaaccttcataatggaagagatgggggagagaatgaaagagagattggaaaaaacaaggatcctaaaatcatcttatggctaaatttgagagggagggaactatggaggcatcagtgatttatatggtttatattgtaggtcatgggaagtcataagaaaaattctggtgccaatggtgataactgatatgaagggactccttgcttgaaggaaaaattaagttaaactgagacctgttgaaatcaaagtagtagtgtgatatctaaataaaaatgtgtagcgtgcaaagagaaatatgagagtgtgtatcaggcaagagatctggctagaaatgtaggcaaagggataaatagtcataagactataaggcattgcggagggaagaggaaaagcttggagaatgagtcagaaatccacacaatagattaaagatttaagttgtgagaaagtttttatggagagtgttctggggaataaattagagattaataaaagaataaaaaatcaaccaggtagaaagggcatgcatcctggtgtgtgcaaacatgtatagctgcatgaatgtcaagtttactatcttacgtggctatatcactatgcaaactatagcctttcatagtacgtaagtgaaagcattagaggattatctgtgtagtcctaaaatcctttgtgaatacatcacattgtcctattacattcttgcccatgttttacataaccagactgactgtaatatgagtattgtgtgtgccctttgttaataaatccttgtataaaccccacaaggatttctctaaagacaaacctggcttgctaaatattactcactccaggctaaattttaataaattccataaaacactatcagatatattcctgagacttttgtattttaagtgctgtcttttcctatttggtatttgcattggttacttttgtggggtgtgctggtttcttccttcttccccttcagacactccaccccactcctgcactgtgcctggagaagatgaattgtactgactacaccacggtttttcaaccttggcagtaatgacattttttaactggatactttgttgtggaaggatgtcctgtgcattgtagatgtttaaaaaaatccctcagtgaatcatagtagcactccactcctctcccttcctcccctgagctgtgataaccactaatgttccctgggagcacaattggccctggattagaaccactgctacatcaatgcactccttttgtctacgctgtgagtttggccagtggaaacaccacaaagaggaaacagggagggaggaaagtaaggtcaggtgatccattttccagatattgactattctcgccctgctaggccagtgcaggcaggtggtatcagtccaaagatcacacagctcaagtcaggcagccgtcttcacataggacttgcttggtcatctctccttcctttctccctctttttctgataaatggtaatctccctgttcatttagttcattttggcctagtggttataacggtgctcgctgttgccatcctaaagtattgcactattccgtgtgtttttcctaacccggtctaaaccttcgtaattagtccctttataaagtctcctccaactaccaaatttgtgtgcactgtttgttttcagcaggagttataattgatatgatgtaagtacatatcaaagtatttacagaaaagcaaaattccaaatattgagatgttttctctgtattggccccaatcattggaatgttttgtgcatacaactttataataatcactgacacctatattattttcatactttgatttgctcaatgaatgctagttataaaaaacaagatcatttaaaatacttccttgcctttattattctcaggtgaaatggagatatgaatttataataaagagtgacaagttagtggaattgtaaaataacattatactcaaaaaagaagaatagagattgtaaagaaatgagattgagtccgtaagtaatgtataactgtctcagtatttcattgtcataccttataagtaagcagggaagtacaaatagatgtgtacttattaatttagtctttcagtcactcattgagtcaatcaattcttgaggccaattgtttttgaaggcactgattgtgctagatactgtggatgttacaaaggtgaataaaatgtcttaatctgaggaagaatttacaatctacacaggcatgaaaaaacaaggaagagtgtaggtgaaagggaaatttgaatgtgaaatcaccaaggtcacaaagcatgtctcctcagtgctagcgaaggactatataataggctcacaaaaatatttgtttaaaatgtaattaaatgaaatttgaagaaagcagaaaatgtctcacaatgctatgtggaagttattagaataacacccccttcccagttcctaattgcattcctggcatatcttatgtacattaatctataattaaatgaaacattaactgctttattaatggctactttagaaggagtgcattcattaaggattattttgaaatacaaataatttccccataaatcttacattcacatatttggattctgagttttacccaagtggcacacaaccataatttgtaggacaggtgaaataaagttcctactattctggtactgtatctagactgagctttacatatttttaatagctttttttttttttttttgagacagagccttgctctgtcacccaggctggagtgcagtggcgtaatctcaccctactgcaacctccaccttctgagttcaggcgattctcatgcctcagtctcccgagtagttgtgattacaagcatgagcaaccgcatctgtctttcttttctttctttctttctttctttctttttctttctttctttctctctttctgtttctttctttccttctttctttctctctttctctttctttcttttcttctttctttctttcctttctttcttttatttcttctgttctttctttcttttctttctttctttttttttttttgtatttttagtagagacaggatttcaccatgttggccaggctggtctcgaactcctggcctcaagtgatctgagggtcttgacttcccaaagtgctgagattactggtataagccatcacacctgaccaatagcttgtatttttgaaagaagttttaggtttgtggaataattgtactgagattacagtgcattcccatatactccattacccttcccccaattcccctattattataattttgcattagtgtggtacattattaaaacttatgaaataacattgataccttattacaactaaagtccatagtttatattagaattcactctgtattgtaaaattctgagttttaacaaaggtataaggtcatgtatccaccatgacagtatcatagagaatagtttcactgtcctaaacatgccatgtgcttcacccattcatccctctgcactttctcagagccccaggcaatcactgatctttttactgtctccagaattttgtctctttcagaatgtcatatattggaatcatatagaatgcaacctttcaaactggcttacgtacctaagttttctccatgtgtttttgtggcttgatagctcatttctttttatcactgaataatattccattgagtacatgtgccagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatagcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttactgtaccattttgtattgccagcattagtgaatgaatgaaagttcttgttgctccacatctcaccagcatgctgtgctcttggtgttttggattttagtcattttaataagtgttttgtgagctttactgtttgatagctgagttacaaactggcaagtatccaagcaaagaacagagaactggaggtttgcttttctaccgaaggaaatatgttgagaatacaggaaagtttcacgctaaatgtaaataattttttacagttaaactaataatgagtgattgaaaaaagttgacttgtgacatacaaatgatacaaacctttcattgtcctctctttcatgggtattaatatttcatttgataaagatttaagtactaatgactatcagtatctgttgattgctagcaattttgagtagaacactttttctgatatgtatgaatatatagacaagaatcatatgatacacctggattgtgtaatagcctttatgatgcagtaaggcaaccactgaacttggaatcagtgaattacaatttgtttcttctgggtccctcactagccctgtgactttggtctatttgacttctgtgagcctcaaaagtgcatttgtaaaatggaaattaaatttttttctgcccatcttactgtgaagctgttgtaataataatattgacaatagcaataattatactaataaaaagcaatttactgtgtatttgaaattatgcaaacaatttgaaaatcatagcactatataaaatgtaacgtcacattagtgttggagtttacaatttggcagggaagctgtacaactaaccacggcacaatttgataagcaataaacttcctttagagtatacggagaaatggggaggattataaatattaagcccttttgtgccaggctctgggaccacaattatcccatgtgatctccatcacaccttgcagatgtaaattttcttattcttattttatacagatgatgcaactgaagaacgaagcaagttgtccatggtcacacagctaataatgatagtattttcctattcctcatagaaaactggagacggccacattatatatccttaactacagggaccatttctagaaatcaaatttctagaattcaagccacaccacatacaatatattaccccatagcttattgataatgctaaaatatgggatatctttgcatagagatccttaaattgtgctagaatatgagatctttttgcatagagatcctctcgcatagagaattcctgctactcaagaatcaatgttagacattcactctgtgctcacagtgttcttttctcttctgtcaaaaaaaaaaaaacaaacaaaaaacaaccaccttattttacttgtgaccttcagtaccaagtaagactggatagaatatcaagataaatttgcgacagatttagtgtcctttctgtcgcattatcatggttgcccagaagttaagaggtttggaatgattccagtctgataaggagaacaagacattgaagtaagtgtctggagtctaaaatagatctgggatagctattactttagcttttctgagatttaatatgggaatgaggtgtaaaagaagagttgaaataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttcaaaaaaaataaaaacaagggcctggcacaatggctcacacctgtatcccagcactgttgggaggccgaggcaggagaattgcttgagcccaggagttcgaggccagcctgggcaacatagagagacgctatctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatctctaacaagaaaaagttcaatgctgtgttaactggcaattccatttaaaatattttcaaacacattccctaaggtaacaaatataattattaaaagcctaataaatcttttaataatccagaaagaaacatttagaagacattaagaaagacatattcagaattcagacagaagctcataaaagctaacataaaaagcaggttaaaaatcaatttctacaagaaaaatatagacatataatcaaacaaaagggggaaatacataacaaacactagacgaatgcaaattttcaaagctatattttaccaaattttaaaagttaactttaaaagaagaattaaccttggtggcagcaaaatccatgtctgtgtgtctggctgatttgggttcaattaaaatcttgggtagagaacacttaagtgaaaatatagggcaaaaataattccatacaaaatataatgaataaatagagcaaaatttcgcatataaccaaattccaacattttaaggaaggtattaatttcaagctaatatccaaatttgtctggtaagaaaaaggtgagcatgatccctatgatagtggttgccattacttctacttttgtgaggcagaataggtgggacagctctagggctcttctgattttattctatcaattataagaggtctgagaacaggaaatgaaaaaagctatgaccctcaagccatctagctcaaacgatttcactggcatctaggatctgatatattttggattggggaagagtaaacacaggcaaaatttgcattggatgtgaagctaatggcccttccacataattttgctgtaggatatcaattgattccctgtttcagaggaaggattgttaagctaaaatggtttcaaccagatcaaacattaaagtaagcagagtttttcagtagatttgactagattcttcatttactataaagatctgccacacccgaaataccacctgaaattagttttctagttaaatcagtatagactatggataaaagaagttacgaagacaaccctcttaatcttgatcaatattcagagatgactactccccatcacaaaagctaattcgtttttcacatttttctctgctcctaatgaaatcttttttgctgaagtttctgaagaaataaataaagaagcctggtgcctctcagagttccacacagctgatgagtctaggcagtgacaaatgacactatattcctcagcgtgcaacctttctctccctctcatcttcttgcaatggaacactgctacattccttgcagaggaaacgtactgtacatttcatagctgtcaccttggcataaaaggcagagggagggggaaattcttcttttggtctgcctaaacattttactttattttttatatatcaataaccatgagaaactattgagtaagtttagatataaaacagagaactttgttttggaaggcattacttttcaaaggaaatgcatcgtggagagtgaggagtgaagggtcaatgttttcaagagcgatcggaagctccctgccttgatattcctaatcttctttctggcatcttatgctcaccaactgcctaatagtggatgcatgtggttctgcccatctgtccaattgccattctaaattatgtggtttactaagaaaatacttaacattatatgaataatgtataattaattataagtagtttttaaatcttcaagatttatctcatgagtgaaatggttgctttgttcttaaggagaaaattaatttatttcccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggtccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaaattattagcttaagggttagatataaaaggtatgaaaggaaaaggatcaaggatatgtatggtatatctgcaaatgctaggagaccaaagtgaaatttcacatagtgaaattactgtgtttcagcagttagggataactttttggagttctggaggcttgggctggacttttttgcatggataaaattcagacaggagacataaaagccttcttagtggtaagacagttattagataattgggaagtattttgaagatacttgtctacctagaatgaagaattttgttgagtatttgagagctatatggctgaaaagaaagaggccagataaaacaaggccctgagtaacaagagtaggccttgggccttgattctatagagagtgcaaaaccactggctaattttttgtaactaatctggctagaaatttccagatttccagcacactatattaaaggaagtactgccaaaaaacatttcatggattccaaaaatagagatcaatgtagatgaatttataagatgaatgaactctgggaagaccaagcagatttctgaaacaacactaccatatatttcattatatacacacacagctacacacacacacacacacacacacacacacacacaccataccctgaacataccctacaccctacataatacttatatatacacgttagtgctctgcagttaatttttataaaggcaccaattagtttctaataagaaaaagaaatgtgtaaagaagagaagaaatttcattctctccatgaagaataaaaaacacaaatatttgttagctgtaacaaatatacatttttttctcaaatcatttcatgatatttatcacatgaaaaatgggtactttggggagattttctcctaaagccttcattttttcatatatagtgagatctaaacaaccaatttctatttacagttgaattctacttccaaaaacatacaactatgactcaatccttgttacctttcaataaactgttaagcccaaagatataacttattttaaaatgtgaacctagacatttgggatgatcaggcatgctagttactattaagaatagcagtatgtactaataaaatggtattcagagattataagggaagcactaatgaataaaaatgacccaaactatatataaagtctttgttcatacacaaaataaacacatgcactatggatggggttctctaacgacagtagaagtaaacgggcagctaaagagtgtatcaaaaactgcacttttacagtttcctatatatcgtcagacaggttaacaaaagtatcgaaaagttggcatactgtggataaagtacattaaaatgagaaaggcaaagttttaaggatatatgaaaatgaaaggatggcaactagtatggtcgaaattcatgtgataaatcgtaataaccaacgtgatagtattaagtggtggggccttgcagaggtaataaagtcacgggggcagagccctgacaagtggaattggtaacattatgaaaggccttgagggagtgagttggccctttctatctctctaccatgtgagaacacagcatttggccctctggaggatacagtgacaagacaccatcttgggagtagagaaccggccctcgccagatactgaacctgaagacaaatgccttgatcttggagttcccagcctccagagctatgagaaataaatttctgttgtttgtaaattacccagtctcatgtattttgttataacagcacaaacagattaagacaacagctttctcagagcccaaaacatttataatagtaagaatttgcaaaatcaaacaatgagtaaggcctcaaatgatcagctgtacttgctaaaaatgaaagaacaactaaatcactcaattcacttgggcaagacaatccattattcgtctaaaatttttgttaataattttctgatttactatctaatagtactggataccatacaaccaattactcctacaaatttttttgttaatagttctctgttttgctttttaataatactggataccaatactggatatccaaaatggtttgatagttgggaacaaaggggataaaggaaagaaatgtactataaccagagatttttgaaaaataatgagactgtatgtactatgatacttcactcagaaaacctcacttcaaacttaatgggaagagaaaaagattggggaagaagtcttcaagcacagtccataatattgatagatagactcctacacatattaatggttgacagctagatgtcaatgcctagagcacaacaaataggtcttatatatcactatattttttatgatgcttggcattgtattttttttgtttgtttttgagacggagtcttgctctgtcacccaggctggagtgtattggcatgatctcagctcactgcaaactccatctcctgggttcgagcgattctcctggttcagcctcctaagtagctgggattagagtcgtctgccaccatgcctggctaatttttgtatttttagtagagacagggtttttccacgttggccaggctggtctcaaacacctgacttcaggtgatccacccgccttggcctcccaaagtcctggaattacaggcgtgagccaccgcaccaggctggtgtagtattttatacacagcatgcatcaacaaaatggatcagatggatgggtggacaaatggataattgaaagaataaatagcagaaatgataactctaacttttaagagtctatcaagctaaaatgacttttgaatcagtcgaatgaatgtacgtgggaactgggaacttaagaaagagaaggagcataaattgcaattgtggctaaagcagcagaatgcttatttacataagttttaaccagtgcggaatattgtaattaccatttatgttgtttttttatgaatccagtacatgcttattaaagggaattggagaaaataaaaataagaaaggaacgcaataatccagactgtaatctaggacccagtaatagttacttagttgcaaaatttcctcaagggcaatatgagagagaccattttgtgcttgttgccatgctgggggtgcctactggcgttaaagaggtaaggcccagggcttgtaaacatcctacaatgaatgagagttctccacagcgaagaattacccagcccaaaatgcaaaatgggcttcactgagaaaaactgagtaccttgtgcatttattccacgtctttatatgtacataagccacatacaggtttttaaaaaataaaaatattatgctgcacaaactgctttgtaatttgttcttttcacatactgcaacaatagcatccttccacaccattaataattattctacaacattttaatggctgttcagcaaaccactgcatggatcaaccataatgcatttaatgaggtccctatgatcaaacttctagcactatttttttcaattttgttttataatcaattctgtgataaacatcttcatatttaaacttatgatcatatttaaattcttagacatgcgactggtcagagcatgcataatttcaatgcttttgatagacttccaacatgtcctcaaaaatgacttttattagtttattctctaaccatattgttctgattgatggacatctctaacataaagttgctgaaaatatgaaacatcagctgaggcactgtgaccctgggaactggctggtcccttcctagcccacatcttagtagaagatgcaagggttattgtggaatacgtccgcgggttaaaaaccatgtatcaattctaaattccaagtgccagaccctttcattacctttcattagcgaagtataaaaagaaagagggagaagggattttcaaggaaagtaataagaagggaagtattagtggaacattagagtttgtctctggtccttcctctgagtggggactcatgaggcttggtgttgtctgaaagcaggaaggacttgggtcttactccctggtaggatgcagcctgaggagcaaggccggcagtcacagtgtgagcaaacattcatacagacgtgggggctgacatatcaagttggagaatgtatgctcacttcctgtcacccccatacaccctgattcccaagagttgaggcagttgtggtaggggttcttaggtttcccatgggctcagattaggcctcggacggaagtgaaggcagtggctggctgggtgaaatatggcggacagagtcggtgagtaacaggagagcatgttatcccttttagacccctgaagtattagagaggatcagccaggcacgtttagaccatatgatgtatcatattgtagattcaccccaaggcatttgtggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaggattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatagtgattacattttatttagctaaataaaacggcatgttcagtgatgcttttccctctttgtgttatacaatttacttacttaatatcatcaaactacaaaggaatatggaaaagattttctgtgatcatgtatcgacacacttcttagagaaaatgtaagttcttggcaaaatattacaactgtataatgcactacaatttttaaaaatcttttgtctgcattatcttatttcattcacactccaaccctgggcagttggctggccagttacagatgagtagctatggtttagaaaggttacatgagttgccagggatctggcaacgcataattgaatacattgtcttaagattcaagctattaaacacagactgaaagcattttgaactcatttaattcaacatttttatttcacagataagaaaactcatgcttagagaggggagatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattagtatttagtggagattaacttttaaaggtgcctactttagatatgtcataatattagaaattaaggatgaagtatttctatctatctatgctttgtaggacaattatattaatcccaaagttacctgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatactttgaatagtttgagaaccaaaagacctcttttgacaatttcctcttgataaagcaaatagcatcatcaatgtctccctaaaacttaaaagctaacagcctatgcttgaaggggcagaaaagtcaagttatttcttactttttagggacaaacaggttgtttatcattgtagttggagacaagatatatggaataatatataaacacatcttatcctatttatgcccgtcacctaaacatataagtgctatttttccaagtttattatcaaattacaaagtggaaatatggctcagatggtagtagaggtaaaaacaaacctaagtcatgtaagatgagtaagtctaaagatctaatgtacaacatgaagattattgttaataatattgtagtgcatactggtaatttttcaagaaagtagattttaggcactgatagtaaaaaagcaaagataaccatatgatgatgggtatgttaatttgcttcaatgtaggaatcacttttatatacgtgtgtatattatatatatatataaataaagataagtatctcaaaacatcatgctgtacaacttaaatgtatacaattaaaaataattttacaatacaactaagtttgaagtcatcctacatttaacagtatctcattaatgaaaccagcaaaattatcatgccatctttgcaagtgaaggaatactaacaatagacgttagcacatgcacagtaaaaatgggttcacagaagtgtggtcattgctctcacgttgcagtccacagaattttaagctatgttaaacatttatgaaggaacaagggaagtgcacaaatatgatttaaacctatttgttggtgtaacgtgatgcagttctatcccactcatcctataatacatttctttgacaaacaaaactatcatcgcaatcagttctttgaatattaaaattggatgtatagtcatgcatatgttgtgggattgtaatgcttacagactattaaccactgatcctaagatttgggtggaagtatttgtctctatatctaagcagctaaaatatcatggctactatctgtgcgtgtatgtgaggtaatttcagtctactgacaaaaacacaatttaatgtatgatatttattgagagcatcagcctctctcatttctaagataaatctctttttttccatgatggatatatacttgtaacaaaccatattgttctcagagaccacagctgctccctttttcccagggtaaatatgtcagtctcccggcctgaactgcccatttcttgaaggcaggagccacccatatgttactcagttttgtatttctcatggtgcccagctgagtgtctggcacatattaagtactcagttaatgatttttaatgaaaacatagcagtaagcctattttccttataattttatacataattacagagtactttcccacctagaaccttacaggattaagggtcattagaattcactattcatccatcttgaacccagtgaaattttgtcagatacaaagaaaggccataataattgtgtttctaagtggggacagtttatgtaccattagtgggctctcatatgagtgagaaataccaacttttacataccacattgcaaaatgtcactgttacatacctttagaaacaaatcaatcttaaatttttctttaataatcacagtatgctttaatctaagattatagtgccagtaatagtatatgccactcgaaacacaaatacaaatcaggcaattcattgtgtctcaaagcttttaatttaggtctaaatatacctaatagtcatctggttatcttctgaagtcaagcacaaggacaagaaccaaacttttaattatttgaggcaatgtattatattaacaattattagacacttaaggggaaagcttactataaattaaaatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctgggatagaccaagtgttctagtggctactccacactgcacgcatagtagcattacagaataacgctgattcaagtcactttctttgtacaatattcttagaacaagcagatctttcttcttcaatagaagtaggaaatataaattttctctatataacatcactgttgctttgcacttaaaatttctgcctgtgcacttttaacctgtttctactctgccaatgaaaggtatgaacttcaagaaatgaattgtatgactgataacttcttatgtgcacatgagtaaaaatatggatcaaaagatctattattctaatgtactaaacacaagagttaatattgttctgtaaaacaaaatcttataattcaagataactcatttgtcctttaactagtcttatacttagaaattattactaagggcagctacattcatatgatcaaattaacaaaacaggtatctgctttgatttactctcgatttattggttgttcagaattatgtcatttaatttccacctatttgtgaagggagagggaactttccctccctcatcaactagagggtgatggaccagataccctcaaagggcatgaaaggtgaaaaccggtgccattactccctttcagtgttcctgatcttaaaagcagagccattaatccacttctacaagctagacatccagtacccctacttgtcacatccctcttcctccaagtttctggcacagtgtgagcaaacattctttcttgaatgatgaatgagtgtctcaatgcagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcgaaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatattgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaaggaagggagaaaggaaggaaggaagggaaaagaaagaaaggaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagttataatatctttggtataatcttattcgtgtcccatgtttgtcaaaaaaattcagtcaaaattcttctcagaattttaaaatctacctcaaaactatatctctggttggtatgtattttaagtctctcatttcccacaaatatgtatttggcaatgaactgttatgtaatatgcagatatgccatttaataagagatgatgtcactataaagaaataagtaaaagaactttattttggaaattaggaaattaggcacaaagggatttgttactccaaggaagagaaattccaagacttacaattaacatgaaagccctcattctttctgaaatgtcactgttcctttggcattttactacattttttgtttcattaactttcttccagaaattgaaacaatcataataattataaaatttgcatggcatttatctgggttaatgcctgaaacaagcaagaccaatataaaggtagcactttttcacaaggggagggtcaggtagccgttccccacagtaagtatcttgctcctgcctccaggcctcacatgaaaatgaaccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacatgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcctcagtctcccgagtagctgggattacaggtgcccacaaccacacctggctaattattattattattattatttgtatttttagtagaaacagggtttcatcatgttggccaggccggtctcgaactcctaacctcaggtgatccacccgccttagcctcccaaagtgctaggattataggcatgatccaccgcacccagcccctacttattatctacgtgttcagacgtggtattatcacatatgtacgaataacagcataagaaacggttgtgaaggaacttggatctttttatagaacttcaggtagtgaaacaaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaagaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaatgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttgaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctgaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgtaaatattgcacatgctgaaatcaccatgtccttactgcctagcaacatttcccatagttttctgtggaacactagtttcattcaaccctagtaactaatgaagaaagttttcaataatcaaaaagtttgaataaccctgattttaactatgtaatgcaaatttctttactgtaggacatctcagattccttaatacgctaaagagaaaataaagtatacaaagtctcccaacattgtacaatgttagaaacttaagattgtgagccactgtccttcagaaaacattttataaaatgtctaattgtacaaacttcagtctctctctctctctcacacacacgcacacacacacacacacacacacacacacagatatgtgtttacattttggcattctggaaaagactaaaaaaatgcagcccatctccacagtctccattagatcatcaggtgacagtaatagttgggttctttaatttttaccactgactccagaacttgccacatgcttgtctgctttctaaacctcatgggttcttcctcaactactaaatggaacaccattcatctaggttgaccgtcttcagatagtggagtctccacctgtctgttatctagttcttattataatcatgcttcacaatatcatatttataggaggtccctagaaggcatcatagtccacttacttaactacttctctgttggattgcaacagagcccattaaaggtgcacaattaacttctaacagaactagtttcaaaggagtctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgattatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacattttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcaacacttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtctcagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaaatgacagattgagaccctatctcagaaaaaaagaaaaaaaaaagaatgccactaaaccacaccattagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttcttttttttagacagggtatcactctgccacccaggctggagtgcagtggctcgatctcagctcactgcaacctctgcagtgagctgtatggctcaagccatcctcctacctcagcctcctgggtagctggcaatacacatgcatgctaccatacccggctaatttttgcgttgtttgtagacacagggtttcaccatgtggcccaggctggtctcaaacccctgggctcaagtgatccaccagcctcgggctctcaaagtgctgggattaaagacctgagccacggcacctggccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagatattgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacggagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactctatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaaaagcaaacagtcgcattttttactattagctcaaatacacacgttcacattcacctacctacacatacctctgactcagtccacctttttgacaagcaatgatgcaaaaatgaatcaagagagagaactaccagcatttagagtattgattatcctaacccatcactcatgaacaagcaccaaactgacatttggggtttacctacctacatagagaacaccctcttttgtctttcctgctgcttctgccacaccctgtttggttttctcagcagcagccacaactccctccttggcctttgaaagtcctttcatgaatacatccatggctaatgaattcctttacaccacactggaaaacataaaatacactttgaatgagaactttcggggaaaaataaacaaaaaacactgaaaaatcatgagaaaccctccaaagtgtgagactcttttaagtgtacactcatttaaccattggacaaagcagacatttttagctctggcattaaaaatttagcatctcccatccatcttggctagtaaaagtctagccacctaaccacggattaggatgaatcctctgagttgttattactgcatttcagaagtggagttgcatgaaaagattaaccccttttttaaattcccggggtctaaagggtaacagtatgagttagaagcatggaagctggaggcttagggtcaggggtatccttaacatgaatcccagaagaaggctaacaggttgatggtggaaaggcgtaggcaacagaactaactgctcactcggggtgtggttcaaactcaggcaaacagcaggcccaagtgtgatggttctaatccatccaacatccacccccgccctcagctatctaccctgagcaggcgccgctcacactcgcgggccgtctccaaccccgcgccagccacccgagggggcgttctcagcctccaccctagcggaccccgcgccagcacttgttaacccgttaccacctgttgacttggcctccttgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcct

SEQ ID NO: 2024 - DNA, 112878 bp, Homo sapiens
tattttcatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatattaagggaagaaacactttaaaggagaatttgtatccacataaatccttaaattcatggtcacaactttcctaatctcaaattgttctaggtcactgctatcagtctagttctgtcctctatttcttaatttaataccaatacttttaaatttttaaaatatgctgctttaggtagatttaaaatatatcctaaccgccactttctaaccttcctgaaatatactgttcaataacaaatcctttccttgcttaaacataacttaaataaaacaagaaacttaccatttctctctagtgtaagatgacacatgcagcttagcactctgtagtagtctctcttcaattaggtaaaaaaggaagtttctatggtaaccatccttatagtcactcattcctccttccttcctcaccagcgcccaatatatatcacattactcatgaatacatataaactgctagcatgtctagaatattctgtcttgaaattatactttctactagtgacttttagaaatgactatgccccagaataattaaaaagagaaaccaaataatttttaaattaatttatacagagtttttcaccatcaagtttattttcagcacccatggggagttaatagatcttccctgaaagagaaaaacctttcctaaggaaaaatcctagaattcatatatttggcaacatttaaaggaggccatgaaatttttatcagtctagagaattgatctcctttaaggtgactctggtagttccaacgatgtttaaaggcatttcctgtaaaaaaaaaaaaaaaaagagagcgagagaaaaagagagagagagagagagaatttctgatgattaaaaaaaaaaagtgaggaatgctgagttaaacaaagttaaccacattctctcagagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacgtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgagatgggataaaaataaaatatttttgcaatgagataacgttttattttaattctcaccatttatatacaaacacaagtgaataaaacacatcgcaaaatggtaaaatttcatatttagtatttataggtgcatagtttcatgctcacatatttttaagtattatatatattaacaaatttcacaatacgtcattattcttagacagtatcattaaaagacacctaaaaatcttataatatatgatagcaaatcactaacaacttctgaacaacagcaacaaaaaaatagtgaggatttagaaataagtggtagtcacttaggtgtttttaatttgttttaacatcgtagattgaagccacaaaatccacagcacacaaagaccctgctaccatgtattcacttcagtgaaagggaagcaccgaaatgctgagtgggggcaggtacagatacttcaatcactgctgatggaagacttcgagatacactgtaaaaactttgagaaatgtcatgactgggcacattggaactgagcacttgtacaggatggaacatctgtcagcagatctcaagaaactgggagcaaagatatttcttaggcttcaggttcgtagtcttgatacccttcctaatattagaaaaatcaaaaagacagcacacactgttagtataagtttcaattacgcatcagcactgacagccaatgagataggaaatggctccccacttacactaaaatttacaatcaatgtttttgcaaatattctgcagcaaatattatcttatttttaatagttgtgtctttcttgtctgatataaaagtgaattacagtagtagtcagagttaaaatatctaggttctgatccggatgcaccatttaatgatcatatacctagtttggtaggacaaataagttggactgtctggttctcagtttcttcacctgtaaaatgtgagaacaaaatcaagctgtctataaagccttttccagactaagatgctctaattctcagaaggaaattaagatgtttgaaggcaagatacattttccctactttcactctcccagttgaaaatttcgtcttcatctatggcttcaattattacttgtatttcaaacctcaagctctccatacagtatctggatagcatccacaacacaaatattaatggatttaattaaagggatcagattattcctcctaaagagcaactctaataatatcaggattctgcttaaaaacaaacaaataagcataacttcaataactcaagttgttttctgaatagaatacaagctgaaatgacaagattatcctaatactctataacttgtctttgacccatagctgcaaattcaatctatcaccattttccttgttcctaagcttgagtcataattattcactgttctcagacatatccatttgcatgctcagacatacatgcctttgcttctgatattcccttgtgccagaatgtcctctgtttgttttgacctactatatctcttaccttttcccacccagatcaacattacctcctcaataaaacttctcctgattgattgaaacagatctttaaaatgttttactttttagtatgtcttatatatttttgctcctgtgatgcctggtacatcgaagacaatcaattatgtttgttaaaggaatcataatgaagaaatgaatgaatgaatttctattttttttcatcaaacctaccagactgtaaactccttatgtcctggtaatgtcaattactctatagttttccattgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctccaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattcctctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtcgcaaatcatgcatttatctttttattctataacttgtgtgggtaacttttattttactatgcgtcatcccattggacatgtatggcaaaaaataataaccttcctttggcattccattgatttccctaactttccatttagaaatttattttagaatgtaaagtttctaaaaatatattctctaatgcaggggttagtaaacttttcctgtaaagggtcaagtagtaagtatattaagctatgtggactacatatgatttcttttacatcctttcttcctcttcttcatcttcctcctcctctttttttttaaggaccctttaaaaatgtaaaaactattcttaacttgcaagttgtccacgtaatgagcatgtagagagcaaatgattctcactaagcactaatgaaagagaaatgtgacaatgacaggtttttggtactgtcttgttagaaagattcagcttggactcctacctcagaaggcatttcataagcctcattgtcaggatccacaggcatatcttccagaattccttcctgtggggctccttcttcattctaatatttaaagtaagaagcacaaaaagaacatgatgaagtagcatttttcacttttaaaaatcagaaccatgttttggaaaaatcttacatatagggatgttggccacggatcttgaaaatggcacaccttaatattactactggcattctaaactccacaatgcctccggggaaacattgcggcaacatgggttatcaaccctcaaagtatgtaaactttttgctcaagtaatttactatttaggaaataatccacagctatagtccaaagatatttttcacaagatcaatgacagcaggaaacaaaatttttagaattgttaactaaatgttcaatgaataatgaagagttaaaaaattattgctgggtgcagtggttcactcctgtgatttcagcactttgggaggctgaggcaggtggatcatttgagtccaggagttcaagaccagcctgggctgttacaatgaaaccccatctctactaaaaatacaaataaatagctgggcatggtggcacatgcctacagtcccagccacttgggaggctgaggcaggaggatcacttgagcctgggaggtagaggctacagtgagccatgtgcatgccactgcattctagcctgggtgacagagggagaccttgtcttaaaaaaaattatcattcaactactcagtagattatgataaagacctgtattactattacctgagaattatgtaacaactacctatttatggtataatatttagcaggctataaagtgttgtctatattatagatacaacctacacagaattcagacgcaaaggtaaaaagtttggaagaaaacacaataaaatatgaaagttattttgttggatagtatgtatgttattttgactttttttctaagtgtttaacttttataaccacttataatgtaaaagcatacatatttaacacattaattttaaatgacaatgaagaaacaaattcttttctgaaatttgaagactgagactatacatattgaaggaaaataatcaaatacatggtcagaaaatttttctaggtatctcttcctagacaaagaatactacaaaactcagcctgaaatggtcatggctttgttggtattcttcactaaataccttttgttgctttgcatttatttcagcaaagtaattataagaagataaaggtaagtgaaaattcaaagaacagagaggcaatgtgagcctaaagggacttggagaaagagatcaaataatccctcagccaacgcggctgattttcaacaacatgtctgatgtaaaaaagcttccccatgtcttcacatggaagtgactgacagggacgcagaagtataagaaaatggctaacagtaagaaaaggtcacactaaagatcatgcttatggtaggtgggcagagaagcttacagatcattctgcccttgccaatgccctttttataaactaaaaaaaatccaaataatatataaattaaataaaatatgaaccaccccaaactacctcactttaaaatgtggagtaaacatactgttttcgtagtgtttcacttcttggtagatacgcctctgctgcaggatggctaggcacaaggccttccatgtcacaggacttgagctcaagtcctagcttctctagatgacagagcttttgtgatgctgagaagtttcctatgctttttctgagtgtcaattagtcttagtgatcaaacgggacagcaaaaccttctttacaacagggagaaggaaacgacatcattaactttctcattaatatttagattactgttaggatatccaagtataagggaaataaggcaaatttttttccatgattttgaaactgacagagatttgattttctaatataatttgttagaaaattttgatatggaccagacaagtaaatatggcagacctaccctgtttgttgtttgatgatcaaaaaggagttgttatgacggaactaagactgatggatattactggatttgtttatatgttatttggctgaactttgaaggatgtacacagatgtgtaggttaggtgagtgtgtgtgtctgcatggttccagcctgggtgagtgggtgtgtacaagagcaccctgcagtaatggaacagcgtcctgtccggggtgggttcccatattgctccctgagctgccaggataggctccaaccacctgcggcctccaccgaaataattaggtaagttatttgacttgtttgtattaatctttcttaaacgtatatatagctcacattaatttcaatgtttaatgtcagaagtgatttatctttatttaggagtttgatggtgtttttgtgtccagaaatttgccataggacttaattcttgcttatatcaattagccaatggtaaaactggttttgttatatgttgttttgcttcaagtcacagtttccagaaactattgatgaagttaagtgaggatttactgtattatgtgccctctgatggaagtacatacacatcaccatcttaaactaagactgtactagtttaagtgggctattgttcactgatccaataacttcatcaagtgggaacaagctacactagggatgacagcacaatcctattctagagtccaaatcgacaatagggtttacgacctcgatgttggatcaggtcatcctaatggtgtaactgctattaaaggttcgtttgttcgacaattgaagtcctacatgatcggtgaggtcaggagatctatagcatcctggccaacatggtgaaaccccatctctactaaaatacaaaaagttagccgggcgtggtggttctcctatagtcccagctactcgggagactgagccaggggaatcacttgaacccgggaggtggagattgcagtgagcccagatcacaccattgcactccagcctggtgacggagtgagactccgtctcaaaataaataaataaatatataaatagaaaaagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccctacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttactgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcagacacaattttatccctatacctgtatatttactgtttcataaacctatttctaaaaacattgttatctataaagaaatattaaatttcaactccaatttacaactgtgcctaatatagtttggctgtaacaaaaaaagaacattaaaatttgcattttatgagtattcatgacttgttttcaaaatataatcatacttgaaggtgtgaagtgcaccttctatttatttttaccacaaacaagaaaaaaaactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatcttatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaagtgaaagtgaaggaaaagggaagtgatacaaggagaagtaggaaaaaatttcagctactgtctttaggaatacaactacagaatttacataatctttttaaatttcctgttttgaaccatattgtatttagatacctagtaatactttctgtaaggaaattatctttattcaattctatgacttataactttaattttaaatatatttaaaatgacacataataaaggcaaaaattgctttccaaaccacactcttctagaatcatctagggcccttgttaaaaatgcaggtttgtagggccttgtgagtgtcttgttaagtatgttccttggaaaccactgcccgacatcaccaattgtttgtaaaccctgtggtataatttaatatagagtataccaatgtacttgctgtcagtgtgaataattttttttaaaaaagatatgctcattttgaagtccatcaaatgttggcaaatgttgagggttatctgaagacactgggaagtaatccatggtgatcgttaaaatagcaaggtttcatcaattatctggtatctatgctttgtcaaagttagaaatgtagagatacatttctaaattaaaacttttatgtgggaagaaaaattgaaattcaaggctggttggtctttggtatacccaaagaacaaagaggaggttggaggtgttctgaaaaagagaaatgatacacgctgctctttgagaaagttcattggcactagaaaggttctggggagctagtaagcttcaattggtgagtgacagtggtgggcaaaattagtcctagagctgcagcaagttttttcagcagttacagaaaaaattggtcccaggttacaacaggcagcctcagcatgcggacttgtagaaaattacacttttggagcaatgtgatgtttcttgaatgcttttcctcccaggcttcttgattgttttagttgggtataacaagaatgacccaatttgtgtgatcaactttcacagccttaaacattcaaagcagcagaagcgcactttctcttttgcccactgcttttacacttgaagatattttgggtagaaccattgttttgctgcattattgaacaatgtcacttagcctcaaataatggaattaataccttcactcaacaactcacaccaggaggatgaaggagagagatagtagccaaaaagataaaagaagaaactaaaaaagaactttgacttaagaggaaaaaaaggttcaacttaagcacacacccgtgttccaaaatgaaatcaagcccagaactcgtatttaaataaaaatagcatagacgtttcaaaaatgtgaatattctctacttctctacctcagacaggggagtgtgtacatagtgtagatagtatatttcactaagagaattaccatgtattttattgatgcacttaaaaatgaaggcgatagacatgaataccttgttaaaaagcaaggtaaagatatatttcatatgttcaattttctattatcaattcctagtctgctcataatgccattttggggtggggagcaaagggcatctgattcaaaatcaaactaatctcaatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgcataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcatttaacattctataactttagaaatgcatcaaagtggcaagcccagcattaagagctatttgtcactaagggcctgtggttgaagtctgttggatccatctgttctttctgaggcaatatgcagacgaaaggtaaggggagttgcaacataatttgtaatatttgatacattataatacatgataaattataatatattagaaatataatttatagcattacatctagtaagatagatgtaaaagggaacaggtaagtgaaagggcaaggcataagtcttgtatagagtgacaggtctggtacagtcctactaccaaatctataactatagtattttgaatattttgcactatttcaatgtagcagtattttaggtttggttggcctgactttacaacaagataaaaaattccaagttttaacaatgtagtgacctactgtgttttagatgttgaaatctataattttctatcaacattttctactaacctgtaaaagacatgccttagaatgtgggaacacacacaaacacatacatactcacagacacatacacacgaagtacagtagaccactgatgatctctggtgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatatcttaaatacattatacataatccatacctacagattgagaatgcaaatctattttaattaaatgatacctttagagaacccagtcttacacataaataacatatatttagaagccatttatgctctactttgtttatcttttgtttagaggcagggtcttgccctattgcccaggctgtaatgcagtgatacaatcatagctcactgtagtctccaactcctgggcccaagtgatcctccagcctcagcctcccaaatagctgggactataggcttacaccaccatgctcggctatttaaattttttttttttatagagatgaagtttcattatgttgcccaggctggtctcaaactcctggactcaagtgatcctcctgcgtcagcctccgaaagtgctgggattacaggcatgagccactgcacctgagccgtgctctactttggataatctgttactatcttactgattttcttgtcttttgcccttctagctgtttctttagtcttggcaatcaccttagagagagagaaaaagagaaaagatgaaataaaaacaatttatttcagtttttaaaggtttggcagtggaggagagagtaaagctaatatattaaatatatttggggttattttggggagctatttactagttttatctctgaattcaggtttaaatacattcaaccataaattaaaaaataattggtggataaatcaggaattggtgcaaaatcatttttaagaagaaaatgtcattatatagcaaagaggtagtatgctgctttaaatccttattttccttggcaagcctaacaagcagggcagtgcctgctgtatttatggtagtgccatataattagctgactcacctaataagacttcacagcgcagcaacaactgccagctttttttgtcctgttacttggatagactcggttgaatatactaatgcacaaagggaaatctgggaataaactatttttacttttcatgtctaagggctgatcctcctcttctagaaataaaatttattatgtatgttaaactatattcaaatttgtttactattttaagctttcatggattagaatcttgaaggtcagccccttgggtagtgactgaataagacattaacgatgtgaagatgggtcaagctgagaaaggtttgctcttgtgctgagctcagaatcaataagtcatttcatgtttgcaaatacaatgatatttggaggcaggtctttttttttttttttttttttttttttttttgagacagagtctcgctctgtcgcccaggctggagtgcagtggcgcgatctcagctcactgcaagctctgcctcacgggatcacgccattctcctgcttcagcctcccgagtagctgggactacaggcgctcaccaccacgcctggctaatttttttgtaattttagtagagacagggtttcactgtgttagccaggatggtctcgatctcctgacctcgtgatccacctaccttggcctcccaaagtgctgggattacaggcgtgagccactgcgcccggccagaggcaggtcttaaaactagcaactgggtgagaaatcagtggggagggtaggctttgacaaagtaagagataaagagtctgctttcatattttagaaaaacccagggaatgctgaaaagcccataggaaagaagaaatatgctgtcaagatgttagtgagccaaggcccaggagtttgctctcaaaaacagatgagaaactggacttaaaatctgactgggagaaagtactttaggcaaaacaaactactcatatacaaaaggatgggctctgaagcagagagtgaaggcaatagcttcaagatcggtggatttaaaacctagaagtatcttctctaaaagataaaagattaagaaaggctttaagatagctagagcaggaataaagtagtcaagtgaatgtgataccacaaggttccagaagtttccatactaatagaaacagatactaagtgaagtttgaggggccctcacaatctggatagaaaactcttcaagtagatctcaaccttcaggctggaatatctttgcttagctatcccagccagaggaccatagtggttgatttcaaaaggagttgcaattattctatcttgtaaattctctcattgttaagttttgtcacagtttgttgttgctactttctttcagttacctagaaaatgttttctctgaaaacctctatccatgcctcaacagatcggagataaaaaaggaatcatcttacaagattatcaagaaagataatgggctaggtgtatccttaaaaggtcattcaaatgaaatattaaaattcttacttttctgtgttattcggacatggaataacaataacagttaatgtttatttggtgcttactctgtatttggtaccatttcaagagttttatatgcattatttgatcttaaaaaacaactctttgaggaagttactactgtctccattttatcagtgaatgaacagagataggaagtctggctccaaagcccacactcttaactattatgcaatattagttgtcaaatgtcttgaaaaaaaaatctgtgtaattactaaaatattacgctgggctacttattaaggtaaaattacgtttcaaaaaaattaatcctttccaaatgcaatgttaactattcatgatgaaatatcagaactatctctaataccaatatttttattggaataaaataggaggttaaaggaaatgtttatatatataaatgtgtgtatatatatgtatatacatatatatatactatgcacacacacacatacatatctatgtgtatatatatgattttttgcaagggcaaaaaccagattttttttaaacacataatcattaaatctgcaaatatcaagtttatcaattttttgttacaggaaaaaatagtttattataaattcaatgcatagcattttctggtttagacctttccattattgttctgacagaacaaagactatgaggttgtcagaaataaattgttcattttgtttcctaaatatgtggcaaagacattgtatgttttttgtttgtttgcttgtttgtttgttttagaatagtttgaaatgtcttcaaaccttttgaccaaccaagaaagcttttgcctgggcacaggctttatctttcttagcattacactagagatactaatccctcccaacaatttcattatgattatcgcaataaaatataacgatccattaagtccatggggcagatgtttatttatttataaccatgccttattccacagagaatttaaagaggaataaaagattatttcctcattgcatcaaatgaatatcttttattttgtctaatgttgtatttctttttctttaattggcactaaatgtttatttgcattcttttaattacttttaaggcatccattatttctggattacattactgaactctcaataaatcaatacatagttctgtatataattttttcaacattttttccttctttaatttggttcatttgtatctccctttgctgtttattgagtagaaattctgatttttgtagcaaagggagaacaaacaaacaacacacagaatattctgtatttaatgctgcaattgtctctatggttgcaatgtgtaggtggggtgcattcaagtgggcttgtggtatttgtgtgtgtgtgtgtgtgtatgtgtgtgtgtgtgttggaagaatatatattgaggatgattcctaattttatcactttgttgaggaactgaaattgtggctacacattcactctaaatattttgtctcacagtcccctcccttcaacaattatatacagtacactatttgttggaagctcaggagaaaaagggcatttaagagcatgagatttggtggcagactgacctaatagtagatggtaccagtgagatcttgagcaacgtaaatgtttcaactgaaaaacggtaacaataaaacatttttcagagtgatgttgtactaaatgaaatgatatacataaagtagcctataatgacccatgcacagtcataatatcaaatatttactgagcatctactatgtgctagattattttaagcacttttgaaaatataagtattttgataaatgtatatcatatattgtcttaataagattatattgttgttatatttcatcttattgctaattttatttttttaagaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaatagatgatagatgggtctgtcactaagcacatcctagtgacatagataagaagcaaatgctacaaaattataggtgcaaactacaagttgtgttttaattggttttaacaagtacttataagcagaagaactgtgaaaaatctaacattttgtcctacttgcaagcctgccagtcttttgagtgctgggcaaagacacaatagtgctgggtcagagacaattaactttactactcacattaatagcattagcaagagtatcatgattttcttgcactgattcctcaagccgcaattcccacagaaaagctcaggtgacacctacatgctcagtgggttgcattagaaaagaggaacgcagagctcaggaaacatggatattttataatggccagtaaagatgtccctttgctttagaaagaggcactacctctatccaaggctgcaagcacacctgccttttgttttagaaggagaaatgatttctatcttccaaggctgttcactatatgaaaagacagtcccaaacaaaaggcagttactgacttgcttgaaaaatgtgcagaaatgatacgctgcttgaatgtggacagctgacacagggacaaggagtaaaaatgattaggttttgagcttgaccaactaggaagataattattagcagtagagaaaaaaagaacaaagtagattttagggcagataagccattttttaggtaggttgagtctgagatgcctccataaatataagttgaaaatatgagattggagttgagacttcagaaatacatattttgagtagttacactacagaggtaagtcatcagagttcataaaattaaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcagaccattttgttgccaggtttctcctccagggtggctttccagctagtttgtaaacaaataactcaggtggccctgtcatgttacattaactaaaaaccaagtctaaagcacacatataataacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatctaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatgtaaacatattacattaaaaggtggcatgacataatggtatatcactgattaagaaatgtgaggcgactttcatgtgccactgataaatcattataatttgacatagtagataatgcccctatatttcatctgcatacctggaaaatgaggactttcaaaacatattcctgccagttacagtcaggtattgcaaaacaagcatttagtgagcatctaaactgaagcttagaacttcagttttgtggcggggcgcggtggctcacgcctgtaatcccagcaccttgggaggccaagacaggcggatcacttgaggtcaggagtttgggaccagcctggcccacatggtgaaaccccatctctactaaaaatacaaaaattagccaggcatggttgcacgcacctgtagtcccagttactcaggtggctgaggcagaagaatcgcttgaacctgggtggtggagattgcagtgagctgagatcctgccactgcactccagcctgggcaagagagtgagactccatctcaaaaaaataaagaactccaattttattttcttcatggcatagcataatagatgagttaacaaattaatgaaacagattgacatgtgttaattgcaatcatatacagaacagaaatcatttccataaaatatttaacctgcctgttacttcccctaaatctctctgtagctgatgccccaatttcactattagctcttcagacttggatgttaagcactgtgccttcccctggacctctctttaaatgtcacagctatttctggcaggtaagactattgctttggttagtgtgaacacacaccactgtggatcacaaggcacctgagagaaaaggctgccgaaagcaggaaaataactcagaaaaaagaaaaaaaaacacatggtgctgaaaaatacaacagatatgcatttgtatacttatgatctaatttatgtcagtcattaaaagaaaataaggtgtttagaaaatacagtgctgtctatggttatatttaatattgtgaccacttaatacaaagcaaagcattcttgcttgctctcatggagagtgcaatttagaattgagagctcaatttctaaggagggtttatgtactctatcttgaggcacaccaaggagattgagtttaccagtttagaaagcactgccataattcaagtcagggagagggctgatggaagatttttaaaagattttaaaagatcatgagggcaagctggcttttaacaaaacaaaatatttccatgtggcttctggctgactgaattaataaggcccagagactgatctgaaggcaaaagcctttattttttattgcaatggagaaaaactgaacattatttgactatcagttgtgaagtttagtaaaaagattttcactaatgggtggttttaatatttatgaatgtgatggttcagcaaattttctccaatgttttgcaagaccactaattaataatcatctttacaaatggaacatgtaattgtctgctactattttttctttgccaatgcttaatacttattttgaatacgttttattttttttctaaatttctctatttatttctacctgagcatttcttaatttttttattcagtcctgttattctcactgtaggatttttaaaagctggtatattatattaaaatccttcaactgtgaattcagcaatgttttgagttccagggattcatctggcattaggctgaccttgtcaagcataaacatcaacattaaagaaaatatttaagaaatgaaaggcctgaatcaaaataagaggtcaaattttccagggtgttttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttttttttaggccagtctgcatgtccactagaagaaaagggacctgggttcttcatcagcccatccttagatcttagtgcacatatgcacctagtaagtgccgagcaaatattcaatgaatgactgtacctttcctaagaattcttcgttgattatccttcaacagagctaacttctctccctatgtgctcagtcaaatgctctcccattggactgagttcagcataaactgccatgttttgagatgattggtgtaagcgaatgtcctctcctgagttgcgagaatctaagagcaggacaacatcacatgcttctctactttctatagttcttttgtccactgtctaacaaataatgccaagtgaaaaagggaaaaatgaatgaataaattttgtaagatgccaatggaaaaaaacagaaaatcaagagttactaaaaaaaaccactaactccatttaattgttttagactaagaatccctcagtgatacctagccaaaattaggattcagatccaaaataaaagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaatagtctgtatcatctctctgtatatttcagaagtacattttaagtgtaacagctaggggtaaactttcataactgtatgatttgaacacaagtacaagaaatattcaaggttttcttttcttttttttttttagatgaagtctcactcttatcgccgtagctatagtgcaatggcgctgtctcagctcactgcaacctccgcctcctaggttaaagcaattctcctgcctcagcctccgtagtagctgggattacaggatcctgccaccacacccactaatttttgtatttttggtagagaatgggtttcaccatgttggacaggctggtcatgaactcctgacctcagtcgatccacccgccttggcctcccaaagtgctggattacaggtgtccaccgcgcctggccaatattcaagtttacacaggaaaaagaatactttctctgcataacctttacttatttactcataagcctctagttctctctggatttgactgtaaatctcaacacatttcccagaaactaacatcttctggctgacttctattaaaaattcagacaaagaaaaaaactgaatacaatggagagagattataatactgctattctcccattctctctctctacagcatatcacctcctccaaaatcagttcatatctaactcctagcacatttttagttaaaaatatacatgcacaaaatatatgtgtaaatacacatgctgatatcacacatatgtgtgtgtgtgtgtgtatatatatatacacaaaagcagatatatatatatatatatatatacacaaaagcagatatatatatatgctttcttgcaggtgatagaatgcttttttggaggtggttttgtgggcctatgtaatgtctctattgttatattttaaaagtttcttttttgtttgtttgtttgtttgagatggagtctccctctgtagcccaggctggagtgcagtggcaggatctcggctcactgcaacctctgcctcccgggttcaagtgactctcgtgcctcagcctccagagtagccaggattacaggcgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccagattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgaataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggtcaaaagaacagcaaggacaatgtctatccacccaatctggtggcctccgaaggacaaaagccagagttaatctaaagcaatcaaggagtctgaccaccatggaagccctgaggaagtggctgctgtatttcccttttcaagagcttttcgtatacagcgtctatccactctcctatagagatgaagttaactccctagacaactatcacctgtccccaatccccacccctccacttgacatacaaacccaaagagattaattaacatttgttccaggaagagacacagacaaaaacatccgatattggaatattccttcgtgaataaatataaaacttatggagagggaggaagatattttgaaaggaaaaaaatcattggactttattgctcaaagccaaaagaaattgttttttgtggcaaaagtaaaacaaggtaattttgtactgtgtgctgtatttctggcaattatctgttatcttaagaggcttatatagaaagaacaattgtacctactttcacagcatgctctgaggatctaaggaccctcaacaaatagttttcatgctacaagcaggcacttatttaggcacaaataggatgggattctttttttaactgtagtataaataattttatataatacagttatataggcttttttaaacaaaatacagtcagattttaaatctctctattctaagatagacacttcacaatttaaattcaagactccttgtttcttgaagacatctatgaaagcaaatgtttttgagaacttggctgaatctgagtccattccgattagcagattccacattcacttttgagccatgacttagaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttattattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattggaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttacagatccatctctatgccaaaacagataacagcatccaggaattatccaaagtcacaaatcagtgtcagtgtcttgtcactcacccacgtagtgcttttcccttcctcctagttacttaatggataagggcacattgtcaaataaacaaacaagtgaggataaatgttgctccgaaatttaaggtgaatcattagtcagacttggtatcgtcatggaatttggtctgttttctaactagctttattttagcacagccataaatctggctgtaattgtctttaactccgatgactcatacatctaagcatttcatttaactttcaaccgtgaaaaattccaactgatttggcaatatgaatgtgctcttacatgcatatgatcatatgatgctgtcagtacaacatctgtttttgttcttgggatgttgatggactatcatgaaccatcttataactttcccagtcccctttaagtccaagaggatacaactgagaaggcaggtagagtttttggtcagtggctaggtttttcctgaatatcaaacaaattgcctggtatgagaatttaacagaatatgaccacaatttttttaacagatttatctacttgaaacatcgcctcagtcaatgaagaaacttatgttctataactaataataaaagatcatttgtaactgaaatatgacaaattgctgttttaatcatgaggattaccatttagaacagctaggtaaacatttactttttaatccggaaataagttaaagcaaataataaaaatttatatttaaatcacacaacatgttttatcatgaataataaatgtttttaaagtttaaaaatgtacttgttaccttgtgggtattcctgaacatgattaggatttttatttctccaagtatttttattcactcacagaatcaaaatgtcaaggctatataagttttcatcaagtgctaatttagcatctaagtttttattaattaatttgtaaaggaaataataatgagagtcaaaggaagaagcatctcctgtggtgagctccatttccagattccaacgaaaccattaaaatatttatggcactgaggctgaatcagacgggtcttgtgtactctcttgtgtggccatattgtgtagcaacagtgggtttcgaataataagattcagtcatccatttagactccaattggagctcaggcaacttcaatttgtgattataatgattaacttcaaaaagatgcactatttgtagacctatgttgaaacttatgcagtggaactaaaaagccacctatttttataataaaaaggcacaaatacgcaaatgcaaaagaaattcattggaaaatcttgaacgtttcaaatataattatcacaaatgcaaatataaaataacaatatgtttgttaatattatactttcatttaatcagttcttctaagtaaggcaaatatatgaattttttaatatacaaaaatacccccccaaaactccattaagtatatctatatgaccattgggtaagattttttatgattattagtatgggaaaattgtgactgtttagatatattaaatatattaagtaatatatttaatgatttaagattgttaaataatttatattaaaattgaaacctcattttgccagtattaaaaatttcaaaatttaaatacatatgacaccaatgcatacaatgttactttgtcctgaacataagttttaaaagaatttaagtttaaatattctcctaaatgctttgtgagacttaagataaaaaacagttcctcagaactcctgacaaaggggggcagtaaagaagcaaaaagatttttatggagttcagggaaagctgaaaggcctttgtgtacattccctattttctaaacagtaaatgatggattgcattttaggcagactacaaaattgctaaaattaaatgttgggatggaaatgtggaatgcagagtttgcaacccccttttaatttaatattttcaaagaattaagagaaattattatattttattttataaaatattatatttaaaattactcaattctaaatgaatgttattgcaaacctaggcttataagaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtcttgaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggtttattcaactaatagctactgtcatccttagaggttattaacaactcaaagtagtgaattacatccaactaaagggtgcttttgtatagacatttgttcttattgctggtcacttattcttcaaatatcttttaggcaccatttacaaagatgaccagaggtacaaaatctgcatatataatagaaagagccaggtagtcattcaataaaagaaggtatatagtaccaggaaaagatttttatcttagcctaaggcagtctgaattctcaagcccaaagcacataaatttgttggaattatttcaatttctagtcactaaaaatgtgacgcacatttacaccagtggttcggttgattacttctcttcagccctagtctcttaagcacaggtatacacacttacagcaatatctctgcatacaatatttttgacagaatgaaaaagttaaaaatattgatgtttatttcagcgattctgaaatggtttataaaaattctatgactataagaaattcatgaggaatgcaatatatcaggaaagaacaatgtcatctttacataaaaaggatgcgtgtcagtaatttgagaggctggaatctagtgacaaatgtgtcactttttaaggtgtgcttgattcacagctgacagctttgatttgaaattgcctttaaaacaatgtctatgtatcagtgcaatgaattctaaccaaaagcttgttggagctaaccacagtacctatatattcaagatgttcatgggaggaatggaagatttgatatttaggcactgaagggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaaggtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaagtaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagatttgtggtgaaaaacaggtgctgctcaattgcttagtctaaaattctccctcaattccttcccatcacctaatttgtttgacatctagtctttttacattataatatagtatattaaaaagttcttattatggtttttttttttgagatggggtctcgctctgtcgttcaggctggagagtaggctcagtgcaaactctgcctcctgggttcatgccattctcctgcctcagcctcccgagtagctgggactacaggatcccgccaccacgtctgggccaattttttgtatttttagtaaagactgggtttcatggtgttagctaggatggtctcgatctcctgacctcatgatttgcccaccttggcctcccaaaatgctgagattacaggtgtgagccaccgcgcctggcccttattatagaatttttgggcatacattgcacatttttctaattgtgcttcaataataccaaacaagtgggcaaatgcttcactgggctacatttgcatccctgagtacaatttcacattggttttggttttgtgaattttggaggaatttattttgagagatgcccctggaaataaataatgctgatgttttggtgtaattttatttattgcattaatggaatatgtaaatacaatctatcagcattaggcagaaaatatttaagagatatcaaattcttttgccgagaaaggtagtagtttgccaggaactacaagctttctaactgaacttttaaaaataaattttaatttttaattttgatagatcatcatagttgcacatatttaagggctatctgtgatattttcatacaatactgccatgtttactgccactattcacaatagccacgatatggaatcaacctttgttcatcaacagaagaggagacaaacctgactttggtctgtgctggctgcaggttctggagagctgtttgaagtgacaagatggcaaatgaaagggtcagttggttgcctggtggattattcgtcctcataacactttacctagaaattttgccttttctcacaaaaccataataatggacaaacagcatgaacctagatatgcacccccagtcactatcgtaaggtcaagttggtatgagtcacataagtagaggactagaagttttatctgaatagtattgtcatagtggctaggaatgagagtgaaaagtagactagatgtgtgctttgatatggcttggagcaaaaggtcaggtattggggcacttctgaaatgatatctattatttaggaactgggtcaggaaaatctataattacattcctactgtatttacataccattcattcctaagagagctcttccaaaaaaaaaaaaaaagagatgtcagtgcataaaaaataaactccatttctttctcaagcccaaagtacataaatcttgaaattttccagctaaaaaataggcatatgttctagcatcagctttaatttatcccacattcattctctgctacaataaagtgacaaagccattcatattttatgttacatctaattatctgtttttcagttagataaatatgctttatatcctaggtaccatcagaatttcaaagctcagaaaatcactaatgagaatggaaggaattaaccatcatgcaagcagaagcatgcggctaccatgctacattgctcagagttcatgtagcagtttaatcagggtagcagctgtgcaatgagctttgttggaactggagtctcgcatcctaaatgtgaaatatctactgtttgaaagggtgataactttatgccttgcaaagaaaacagtcctcaagtgttattttttaatgaattaaccctttatctttcctcacaccttttctcttctttttttttttttttttgccctcagaagtatttaaaggataatcccatatgataactcacactgcctagcttcagtacaatgtctcatacattgcaggcactcacaaacatttgtttaatgaatgaataagtgaaagtccaatggaaaattacactgttgaatttacaatggttttagaggtacatctctaaatttgttgatttatttaggattgtacattgtcacattttcactgctaaatttcatattattcattaaagaaaggcagtgttggagagttttatagttgacagatgaattatctataacttctaatatactcagacatcatgtttttctagcatgtaacttttaaaatataaactctccaacatttaaagttttaacactttttagtaattttttaagaaatgacagatcaatagtagctttccataaataaaagcctattaatttgtataacataacaaaattcagtgcaacataaattcatatagtactcctacaagaaatctataggagtaaaattatgattataaaaatcaacagacttaaacaaacaaataacagctttcaattaagtttatagataccaaagacattcaacctttaacatcccactgtgtaaaatcaaatgggaaaggataaaaggaccaaagctatggttagtaatataattgattgctgccctacctacaaactaatttgttttaatatctgtgctagaaccagtatgttaccccttttaactttagctaaataatgtttatacaaaccttactatgcagagctatctttaacaagagcatcccattgaggaaaaaagaaaatagaaagatatgaaaattttcacttttttctaataccaacagatatcactttattgatattgcatttctgtatataatgacatagaatatgagcattccctgtagttcagttttactgacagtaacattgcacaaatcattttagggctatgtgctatgcagagacattgtacagttaattggcatcattaagtaacattttgaaatgatgaggtgttcaaatgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatttctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagttgtggctttgatctggttcctgactttgaattattttgttcctatgaagtacaggactttgtaataaaaatccaccatacacaaaatcccctggacttaagaatatctccacaagttataagaattgaaactgcttagaaggaacaattgcttgtactcagccagtcatcctcagctgcatgagtctcaaaacgggggtggagagtgtctacctcctccagaaaaggtttttagagcgaaatcaaagagactgcctcttctccaccaaaattatttgtcttaagatggggacaagaaacctggcacccaggagtaaggacacagacgtgctctctcattttaagctgaagctgaactgtcttgtcctaaaaacatatgcccagactctagaaaagctctcttagacagactgctaatttctccatttctgtcacttaagaggattttagggacatataactttgagaattccattctgcagctttcagaggtaatacaatccaatactcatagtgggcttatggtgtacccggcacttttccaaacattctacttgttatagcttctttaattgaggtacgtattcttatcattctccatttgggagatttgagagagaggcaaagtatgtgccttaagatgacacagttggtaagtaggaaagcagaactttaacatcagcagtaaaaccctgagactattgttttaatgtgtttaataaatgccccactaagaaaccagagcaaattaaaagtatgctgtgttctattaatttgatacaggcagaagaaatctaaaaacagcaaagaatgatatttaagaagaactctattttaagtagttataggacatatgcttaaactgagtgaactttttatgaacttttcatcagagatttttttttaattgttgtttttctcctgtgtctgtgactgaataaatggcctctgttcactggaatgcttcacatgcttcctctctcagttgtaggtgtgtttatttctattcagacaccaaaggcctatgggtatctgcaaattaacagtttcatttgctattatgttccatcattgtgaagcagcacaggaaattaacatatctgtaaccacgcccttactatataatatgaaagtgtaaattaaaacatgccgtgttcattaaactgagataaaaccacattttgaaaataaagtttagtaagtggatacttagtatcacattggcgatactaagcttatgacttgcttttaatatttggattgcaaataaatttggaagctaatgtatggagtacaataatagcgaaaagcatgggctttgatattagacatggctatgcatccgaatatcttattattggatattcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttggggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaattttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatagtctcgatctcctgacctcatgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaagatgcttacaattgatgaaggaagaatgattttaaaacacagagcaaaatgttattttaaatacagaagtctattcttctcctccatgaataactggcattctgtttctattgtatattaggttgaaatatgtgtttttgtcattaccagtgtttccacaggataagactgaaggcacaagcatttaatatttgctgaaagcacttaaacagaaaaaatattggctagtgagattaagaatgaaataaggtagacaaatagctggctgcaaaagagaccttaaaaagtttctcagagcctggccaaaatggcaaaaccccatctctactaagaatacaaaaattagtggggtgtggtaccatgcacctgtaatctcagctactcaagaggctgaggcaggagaattgcttgaacccaggaggcagaggtaggttgcagtgagccaagatcatggcactgtattccagcctgggcaatagagcaagactctgtctcaaaaaaagaaagtttatcagtctattaagaatatacttgatttttacaagaagaatcaattgctttacaaagttatttatctaaaatgtatgaataaaaatgtataactataaacatatctataaaactagtaaagatcaaaagctcaggtatctttaactttctctgcttctactattcacaaaaatatttgctcagagacacagaaactcatcttcaagatttatttttatctgggtggagttacagagttgccttggtaacagcaactatcaccaaattaagtgttaagcacacgtttttaaacatttttaacattttaaaaatgcagatgccaaaggagagcaatgtcaggagagaatgttgtaaactccctttttcccacatctacttgacattacaaggtttgtactactttcagaaattctccagtgtttaaaaaatgcgtctataaacacacatatacacagagcacttcttattgaagtaatcaccttaaaaattatgtaatgcaatgaaaaccacaatggttttcctaccattgactaagaaagcaaaggacctttcttctgaaagtgaggaggacctcttgcctcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacactaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaacggtgcaggacaaatgaataaaatacattttgcctctgtcttaaacttagaacagatacgcaatctctttaacagtatgtaaaaattcagtcttttctttctttggtttccaaattacagtgaaatgaaacattttccttttatgtgtaattagtgcagtttaactaagagttatggagcatctttccacctcatggtgtatccatgtagctgaatttcttcagcatttgcttttttaatttgtataaggagtaactgttccatatcttagaaatctttgaaattagaagttgatctaatagcatctctaatgtagtctctccttgaattttaaatataatagatatgacctgttatttaaaagatatagtgtttactggcatataacagttgtgttgagaatttttcattgaataaaatatatttcccttgaaatttttgttttatggtcatatctcataatccacctctgaatcaatgaacacttgtattggtggagaaaacaaagatccttcagacagactttctgtgtggtatgttctttctgtttcttttctaataacattaacttacatttaaaattattataattcactctattttcacaaatcatcaaatcatactcagatatttaaaaataaattttattgtatatatttacagtaaacaacatgctgttataagatgaatgtatatggtgaaaaggttattatagtgacaaaaattaacacatccattgtctatctcacgtagttacccactttttcccctgtggcaagagcagctataatctactcaattagcaaaaatcctgaatacaatacactattactaactatagttgtcatcctgcatgtcagctttttagttcctcctacatatctgctactttgtatccttagatctacatctcccaatctcctccctgccacctcactcatggtaaccagtgtgtggactgtgttttttgtttttttattttgagacagagttttgctcttttgcccaggctggagtgaagtggcgccatctcggctcactgcaacctatgcctcctgagttcaagtgattctcctttctcaactgcctgagtagctgggattacaggcacctgccactatgcccggctaatttttgtacttttagtagaaacaggatttcaccatgttggtcaggctggtcttgaactcctgacctcaggtgattcacccacctcggcttcccaaagggctaggattacaggcgtgagctaccacatccggccggtaaccactgttttattctaactttatatttgaactttttctttttagattccacatataagtgagattatgcaattttgtgtgtggatgtgtgttggacttatttcccacagcttaatatcctccaggtccatgcatgttgtggcaaatgacagggtcttctccttttttaaggctgaataatattccattgtatatacatataccacagtttcttttatccattcatgcaccaacacatacctaggtggtttccatatcttggctactgtaaataatgctgcaatgaatatagcagtgcagatatctttatgaggtgatgattttatttcctttgggtacatccagaggagggattgctgggtcttaggtaattctaattttaatttctttaggaacctccgtactattgtccataatgactgcaccaatctatatttccaccaacaatgtacaagggttcccttttctctacacacttatcaacacttaaactgaacatgtagactttttcttttcattattctctaaacaatatagtataaaaactatttacatagaatttacattgtattgggcattatcagtaatctagagattatttaaagcagcagtccccaacctttctggcaccagggactggttttctggaagaaatgtttccacggacagggatggtgaggggaaggggaatggttttgggatgattcaagcacattacatttatcattagattctcataaggagcgcacaacctagatccctcacatgtgcagttcacaatagggttcgtgctcctatggcaatctaatgccaccactgagctgacaggaggaggagctcagctcttgctgtgcagcctggtatcgaacagcctaacaggctatggaccagtactggtcatggccctggggttggggacccctgattgaaagtatatgagaggatgtgcataggttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgactgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcattccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaaaggccaacttttagattgaggcaatgaaaactcagaaacttttttggaatgaccttcagatttgagatgaccactgtttcaacaatatttcagttataattctttctctatattcatttagggaaatttgattctgaaaaatacaaatagcttcctttctcctgagctaggactgtatttagaagggaataaattgtagattttattaaaatttgatcacattttctttttttgtgctacgacacagtagcaatgtagattgaaggcttttacatgtatttttaaaattgccatagagaattatttgtattaatcatagatttccaaggctgcaaaagctaaatagtaaagcatataataatggtagcgttaatttgaaaaaaaattccagctagcaaaacatgagtctagatgtagatatcatgttcaaaaatcacaaagcagattgccagcaaaaaattgaaccaagtttttccccttcagaaaactagctttatttaaaaaaatttcctaatatttaaattgattcacacgtttataactatacaagggtttccttgtttcatcaaagaaataagtatgaatgagcagaatgttttagtataaaagtttacaaagtttattcacactcggaacaaaggaataagtaggaaaaaaagagcaactaaaaacaaatgaattcttttccccatccctctcgtttgtctccaatcagttaaatccttttaatgatatatcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgtcttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtggcagctctcagacaatgggagacaggagctaatggctgtttcttcgttttgtccttcaggctgataatccagaaaaccaatctgcacaatgcttgagaaggtgcagagaattagagccctcattgccctcaatgcagtacctttatattggctttttctccttattcatcacatgctcctgtttcccgagattgccacccacatatactacttgcaccctacactatatttcaggctcttccttcaggataatgaaaccaagctaaaggcaaaatccaacttttgtttaactcatcctgcttctgagctcccaagatccctgaacctacttctcttatataatttattatagaaagttatttaagcatgagatttctctagtttatctttgaatctccactgtcaatatagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcaccttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctcccaagtagctgggaatacaggtgcctgtcaccacacctggctatttttttttttgtattttttttgtaatttttttttgtatttttagtagagacagggtttcactatgttggcctggctggtcttgaactcctaaccttgtgatccacccgccttggcctcccacaaagtgctgggattacaggcatgagccaccgggcccggcccatatttttattcttaaagaaccagaactatatgcatctagtgttccccaagttttcttctttgtcttttaacattccaggaaaacagatattgagtgttttgctggatcatgcatagttccatatccttttgaccctctgtttgctgtagccagctttgattctttggattcatggtcaccctataacatattcactaatccaccaatgaaaggttatgtaatgtataacaatcaactcagggttttctaatgacaatctttatcaatgttctataagcttgaaaattaatttaataatttataccattgtgcataaaatataataaaaactttaatttaataacgaaattcatgcatacttttacaaacttatcagtcattcagaagtaaatgtggacttcagttttgtgggcaggggtttacagaagtatgttttactaaagtttggagaaaagatcagtataaaaatatgaaattataccaatagcattattagaaatagttaaaagacaaagtttaagtattttcataatcatatcactttttaagtgactaaactactaaagaaacatttagttaactctaaaatattgttgtaaaatttctatgtgttttgaggaaaaatacttttattccatcataaaattttcaacttagagaaacaatttgtttacttgaaaaattataatattttcaagtaaaaatggttatactgacaatttattaaaacataaataaaagttcttcccacactttgacacatgattagaaaaaaaaaggcagtaagattttcatacagaattctggggttaagtagaattcacttgtgtttgctggtctaagatgcaatggaatttggaggcaatggggctggattctatcaaatcagacacacggaagaggttataacgtgagaatttatattttttcattttctcagcccacacttgaaataacaatttgcaagagttttgctttgctcaatattaggcctgattagctaaaatgctcaaatttccattcaatccttaaaaacagatccacacttagtcattcttcacacctctctccctcgccctttcacacccaaattgttaacttttttctctattctcacatttatagtctggttcagacttccgtgatctgtcacttgctcttgtggttaaatttctgaagtgaaattcctatctctaatctcttctcctatgtatgtcatcagacttgcaattttttctaaacccaaaatgtgttttcactagtcccctgttaaaaaactgtcaacacatccacattgcccactggctatagagttcaattcaaactagagtcattcactacttggacaaccagcttcccagctccacctctgggtattctttctcttgccttcagaatggtgttgaggatataaggtgaatgcaacagccattgctctcagtgagctcatagtctaagtgaggagacagatgagcagatcattataaaacaaattggcaagtgcaatgacagaagtgtgcataggtgctatgggaaccaagaggaaggatatataataagccagggaaggaagagaagattcagggagacttactggaggatgaattgccctcagaaagtattgaagtgtaggtaacagttggttaagagaagcagaaagaaggaaaaggagacagcagcacagggtgccaaaataagaaaagcctgggtaatactgccaagagaaatctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaacataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatgcctatctgagacagctttgtaatgggtctctgcccctgtttctctgtccacaagaggtactaattcacttctcttcagttgttagacctaggacacaatagacaccaagttacatttctgttaggtgcatcttggaagtgcctgagaactgaccactgggcacctacctttttacctaagtctctgttaatgttggtctgtttacctgttagtagtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacatcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaataacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagattgggccctatatttagcctcttaaacaaaataattatcagccaagaattttgtatccagtgaaactaagcttcataaatgaaagagagataaagtctttttcagacaaacaaatgctgaatttgccactaccaagccagcactgagaaatgctaaaaggagctctaaatcttgaaacagtaacttgaatacatcaaaatagaacctccttaaagcataaatttaacaggacccataaaataataacacaattaacaacagcaacaacaagaaggtattgaggcaacaactatcatgatgaatagaacagtacctcatacctcaatactaatgttgaatgtaaatggcctaaatgctccacttaaaagatacagaatggcagaatggataaaaatccatcaaccaagtatctgctgtcttcaagagactcacctaacacgtaaggactcacataaacttaaggtaaaggggtggaaaaagatattccatgcaaatggaaactcaaagtgagaaagaatagcaattcttatatcagacaaaaaagattttaaagcaacaacaattaaaaaagacaaagagagacattatataatgataaaataattagttcaacaggaaaaatttacaatcttaagtgtatatgcatctaacacttgggctcccaaatttataaagcaatcactactagacctaagacatgagatagacagcaacacaataatagtgggggacttcagtactccactgacagcactagacaggtcatcaagacagaaagtcaacaaagaaacatggacttaaactataccctagaacaaatggacttaacagatatttacaaaaaatcctacccaacaactacatccttttcatcaacacatggaatattctccaagacagaccatatgaacaagtctcaataaatttaagaaaatcaaaattatatcaagtattctctcagaccacagtggaataaaattaaaaattaactccaaaagaaaccctcaaaactatacaaatacatggaaatcgaataatctgctcctgaatgatctttgggtcaacaatgaaatcaagaaagatgaaaattttaaaaatatttgaattcaacaataataatgacaaaacctatcacaacctctgggatacagcaaaagccatgttaagagcaaagttcatagcattaaatatctacatcaaaaagtctgaaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcgggcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaactgataccacagaaataaaaaagattattcaagactactgtgaacacatttacgtacacaaactagaaaaccaagaagagatggacaaattcctgcatatatacaaacctcctagattaaaacaggaagaaatagaaattattaacagaccaataatgcatagtgagagtgaaacaataatagaaaaaatgtcaggaaacaaaaaaagtctaggaccagatggattcacaggtgaatgctatcagaaattcaaagaaaaattggtacaaattctattgaaactgttccaaaagatagagacagagggaatcctccctaaatcattctatgaagccagtattaccctaatatcaaaaccagaaaaggacataacaaaaaaagaaaactacagaccaatatccctgatgaacagagatgtaaaaatcctcaataaaatactagctaaatgaatccagcagcatatcaaaaagataatccaccatgatcaggtgggtttcataccggggatgcagggttgctttaacatatgcaagtcaataaatgtgatacaccatataagcaggagtaaaaacaaaaatcatatgataaactcaatagatgcagaaaaagcatttgacaaaattcagtattgctttatgattaaaaccctcagcaaaactggcatataagatacacaccttaaggtaataaaagccacttatgacaaacccacagccaacattatattgaacgggggaaaatttgaaagcatttcccccgagaactggaataagacaagaatgcctgctttcaccacttctattcaacatagtactggaaatcctagccagagcaatcagacaagagaaagaaataaagagcatccaaactgctaaagaggaagtcaaactgttgctctttgccgatgatatgtttgtatacctagaaaacctaaagactcatccaaaaagctcctagatctgataagttaattcagtaaagtttccagatacaaaatcaatgtacacaaatcagtaccagtgctatacaccaacagcaacaaaactgagaatcaaattaagaacttgagcctttttacaacagctgcaaaaaaaaaaaatgcttaggaatatacctaaccaaagaggtggaagatctctacaggaaaactacaaaatattgctgaaagaaatcacagacaacagaaactaatgaaaacacatcccttattcatggattggcagaatcaatattgtgaaaatgagcacactgccaaaaacaatctataaattcaatgcgactcccatcaaaatgccaccatcattcttcaaagaacaagaaaaaaaatcttaaaattcacatggaacaaaacaacagcccatacagccaaagcaagactaagcaaaaaataacaaatctggaggcactagattacccaacttcaaactatactacaagactatagttaggaaaacagcatggtactactataaaaatagacatgtagatcaatggagcagaatagaaaatccagaaataaagctaaatacttacagccaactgatcttcaacaaagcaaacaaaaacataaggtggggaaaggacatcctattcaacaaatggtgttgggataattggcaagccacatgtagaagaatgaagctggatcctcatctctcaacttatacaaaaatccactcaagatggatcaaagacttaaatctaagacccaaaaccttaaaaattatagaagataacattggtaaaactcttctagacactggcttaagcaaagagttcatgaccaagaaaccaaaagcaaatgcaacaacaacaaaaaagataaatagatgggacctaaaactataaagcttctgcacagcaaaagaaataatcatcagagtaaacagacaacccacagaatgggagaaatatctgcaaactatccatctgacaaaggactaatatccagaatctacaaggaactcaaacaaatcagtaagaaaaaacaaataatcctatcaaaaagtgggctaaggacatgaatagacaattctcaaaagaagatagacaaacagccaacaaacatatgaaaaaatgctcaacatctttaatgaccagggaaatgcaaatcaaaaccacaatgtgataccaccttactcctgcaagaattgccataattaaaaaataaaaaaataaacgttggcatggaagtggtaaaaagggaacatttttttacactgctggtaggaatgtaaactagtacaaccaccatggaaaagttatggagattccttaaagaactaaaagtagaacaatcatttgttccagcgatcccactcctaggtatctacccagaggaaaagaagtcattatatgaaaaagacacttgcacatgcatgtttatagctgcacaattcacaattgcaaaaatatggaaccagcctaaatacccatcaaccaatgagtggataaagaaaatgtgatatatttacatatatatataaagcataggggggtgtgtgtggatgctatggaatactactcagccataaaaaggaacaaaataatggcatttgtagctacgtagatagagttggagaccattattctaagtgaagtaactcaggagtggaaaaccaaacattacatgttctcatttataactgccacctaaactaaaggatgcaaaggcataagaatgatataatggactctggagacttgaggggaagggtgggaggaaggtgaggaatgaaagactacacattgggtgcagtgtatgctgctcaggttatgagtgtaccaaaatctcagaaatcatacctaaacaacttctccatataaccaaaaaccacctgctccccaaaagctattgaaataataataataaagttaatcagaaaattattgtctataacaccaatatattatttttattaatgcatttcttttaatgtattgttatttgtcattaattaaattagtagttacactattaagcgatctgttgttataattaattaattaacctccctttatcaattaaattataaagccctgaaggcaactgagtagaggcccaataagtgattgctgaattgaaatgctgaactgaattatacttcattatatagaaagcctcatatatagggcctcacatatacccttacacaaaatataagaatccactacaaatcacttcatcgattaatcaactggctgtactttgtaacaaggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcacatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataaatgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatgcacgggcaaacatgttttgttatactaatgtctgaagtacaaattgttgtagaatcattttattccatagacttccaagtctaattctaatactaacttccatcaatagttaaattattatttatcttctatccaaaggctacctgaaggtcctatcactttggtgtgagaagaatcgggtaagacaaaaagttaggcttgcaccagttatcaatagaatattaagaaagatttttaagaaggagaatagcagttccaggttccacatatttgatacttttcaccagaaaataggaaagacggattgggtctgcaatgtattttcaaagtcaaacttctattcctctatttaatgtatttttacagagatgacttgagaaaacacacatttcttttgaatcttgatgtatatatttttgacggatcagacactcttacttgagctaggtgatctcacatcattatctgttgctatgtgctattgtttctgtagccaaatgaatgggccattggcaatcaagccaaacaaattttgcttttacacccgattttagcattaatctacagacacggcttttcaatagtagaaaagatatctcccattttagtccaaatttaagtatagttaaagctacattttgggaaaaatgttttatcatttttttgttcacttgtgggatgaaaagtaggattaaacagtccattatctctaccttctctaactgcctttactaaaattttaaaatatttcttttgaagaaacaaaacataatatttgccattaaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacggtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggtggatggatgaatgcatggatgaatgtttgtgcctgggaacccttctgtcatcatgcataagcagcctgagtcttagataatactatatgacatgctttcttcatgtgaataaacagacctaaagacaggcactaggagaccctgggaccacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaaaggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatgttctctaagtacaacactgccatgtgtgtgaagagatatctttattaaaatttttcttaagttgttccttcctaaagtagtgaaagctgagcagatcttagaaattcatttagaattcatattactcaattacacttgactataacacttaagaatctagttattttccttttgtagtaaaaatatattttatttgaaatatgtgaatggttacttagtcattttaatctacatgaaaaatttaaccttaaagtaactctattttaaaaatatgaaatgagactatcaatcggtacttatgaagcaatgtttattcttctaatatagtgtgggaagagaaatgtaaaagtcttgcaacacaaaagggattgttctcacaaatcataggtttgtgagatggggtggcaaaatctcattgtttttaaagaaccaagctgttcttcatgagcaagaacactgaattccctggttttctttttctagtcactatacccctggcatcataacactactgtcaatcaactgcatccagaaggtagaataaaatgccaagtgatactttcggcagaattccagagattctcagatggttttttcttttccctcttaaaaactgtaccatatgagttaggtttattttgaaatgtccatgaaaaagaagtcagatatttcttaaaattggcccctcttagatatttctggggaagcttcatataattccatttgttcatgttattccttttcatcataaatcagtcctctataaagagcttcaaattttcactgcctgatgctactgtaaaaatatacctaatatgtttgatcgaaagacagtagtcaatatatttattaggagaaatactttattcactaatcttaagaaatactagaggaaatccagtacaatctgaagttaaaactaatgattattaaatgaatgttaccattttattaaaaattaataatagtaataaaaaactacaaagtactttcacatttccatttgactctcacaataactctgcttttacacataagcatatatacttacttacctgtatacatgtacacatattatgtataataaccctcttactatatgtaagattcagagagggtaaataacatgaataagaccacaggactcttaaattatgtgctagtgattataattcctacattatttctataggatcagctggcttcactgatatcaaaagattatatatagttatataattttataaagttctgctaacttagtgactttatatgcatttttcaggaaacttgcaaaaacaagaaggtgaataaacttcgaaatgagaagagttcactaagcataatgcatttattttgcatcaggatttttcaacgttttaatttttaattaaaaaattaaacatttttaatagccgacatacatctccaaaatttacttctccaatctttccaaaagaattgatgaaaatgtaaaccaagatttagatgtaaggatgatcattataacattataagaagcaaaaattacagaaaaacattgtattcaaaaacaggtgttgatgaaggtatttactttattcacaagtaaactgaaaccagagagatcacatgatttggtcacaggcacagcaacaggtaggagcagatctgggatccaaatccatgttagctatctccagacatagatctctctccaccaaaacacacttcagaccacactccaactatgggaccaatggtttgccccattgtttattgcctatggtaatgggtttatgtataatcgtgactaaaatcattatccttttaaattgaaagaaagatgggatgggtgggtaaatagattacagcagaaccaagcagtagattgctattttgccacacataccaaatattagataatgaacttcatattaaatatcttctctaggtctttatcttcatcatagctcacaatgttgtatgatgctctggcagaaactaaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaatgtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaacagtctttacttagcaagtataaatgttagcaagtataaatatgtttaaacataaaaaataagactaaacaagaataaaaactgtttttaactataattatcaagtctacaacccaaaagtctttttcccatccttgacacaataacattcaaacatgatttttaatgatctcgtagtacatttattgctaaattgtactcaaaataatgtttcattttacttaagtggcacaagccccctgtaggtatgattacattccgcatactaattcttcttgagctcactgacagaagtgactatgtcttcttataaaatttctatactcccatgatctagcttagtttcaaccaaataaacggcattcagtttatatttgctgaagggaagataatctccttctagttagcatctatccacacacagtgcttaataacagattgtatcagagtttgctagttgtccaccaaaatctgttctcccttctttgtcagggcatatggctatatactacaattttctgtctaccttgaataaattgtggctggtatccaaaggaatgagaaaggaaataatgtatgctacttcgaagtgggtatggatgcatcccctcagaagacggtggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattgttaacattttacctcatttgctccctctgcctaacacatggatgtatttgtgcgtgtgtgtgagagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttccctcctacttcctaggctgctgggcacactgccattgacctctgcttgacatctccttcctccccctgtcagcagccttgctcagacatcaaccaccagtgtttgcatgtccccatggcaagaacaagggggaagggagtaggagggaaaattagtaaggacaagggaaggtggatgaatgaattcatttttaatataatgctacgtgaaaagaaatgccagaaagtaacattctgaaaatcactggtaaaagcatccccaaagtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacactgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgccaaaaattctcacaaatgaataaagacagaactgattaactgtattaagtgtcctacttaatacaataataattcaggttttaaataatttcaacatcagttcattatattaattaatctcataaaaacctcccaattaatgtactatgtataaattttatcaagtactttgatgaattaagaggaaggtaaaggttttcatcaatatctgcaataatattattaaattgggctaaaaggaaccaagacaaatgaagatatataagaaaactaatcattattttagactaaaacaggaaaagaacatagttatctaggacactgtctccttagtttttaatgtttcttccccagatgggtttgcacatcttttgcctgaaaaaagaacttatttccaccacacaagttacattaaatacgtcttttagctcctagggagctgaaaggcaagtccaaaatgaacttttttattcgttatgtcatgaaactataacactgcattattaatacacctctaatcaataaagcctaaaaatccattcccaagagacccagatttctctaccagttctagttgtactagttattctcagcggtaagttttcctagttcttaatattaaaatgagaggtccagaggctctaggtggtggaggggttgctagctaaaaggagggtgtcctacagaaagggacagagtctccatgagcaatgctggatggtacctgtggtccagttcttggcacatggtgagtgctgcctaagtcttggtgccctagacctgcagcagcaatcggcggggaaaggaccatgactttggtgacaaaagtgatggcagaagagtggaaagaggtatgagtgatgactaaggacaaagaaacaagggtagaaggacaattccagcagcagcctatccgaataacaaaatccttatctcaggaaaaccatctctgctatgaatacatacacacacatatattcatcaggtatcaatttaattactgattggaacactgtaaacttgttcaaaatagaggttattattcagtatcttcagctgtccggattcaccattttatagcatgctctctgacattagtgagaatgaattgtactctacatatttaggtaatggtttggtatacagctgctattaacgatttgtgtgctatgcaatatttgtggtctcctgtcacccacctcaggagacacaactgatgtaagtgagacagctcagcatatcctatggaaaaatctcttattaaataaaggtcaatgattaagtagtatagtcattgaattaatttgttttccttaagaggagctctcctcaggtcaaaattaaagtcagggatagataagtctctcatatggttcccccagtgtgagaggagcaagctgttggtttcctttggtggcttttttcttgtctcagaagaataaattaataaattctgcatagctgtgattttgtgtgacaaaaatgaagaacctgtgcctctgtttacaaagcaatgcaatgggaatcacctcccctggtgtctcttccccatcaccaccactttgcccgctgaaatgttcttaaccccacccaccataaaaggtgatgataaattgttgcttcaaactcatgctgattgaaattttccagctatttttaaataacccccactactggatttcttgcttctatgttatatgacaatgcttctttcaggtgaaaatgtcctggaaacaagtaatttttacctggctacctttttttttttttttttttttataaagaaagaagtttaattgactcaccgttctgcatagctgaggaggcctcaggaaacttacaatcatagcagaaggggaaggggaagcaaggcacacctcacatggcaggagaaagagagagcaaaaggaagtgccatgattttaaaccattagatcttatgagaactcattcactatcatgagaacagcatggagaaactacccccatgatccaatcacctcccataaggtccctccctcaacacatgggggttacaattcaagatgagatttgggtggggacacaaagccaaaccgtatcactatggatggtagtatcagggtgcacatgcatctttttttttttctctctgattttctttttttatttaaattctttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattataggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttcttttctttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttgcaaggctctgattgagaacctctggacaggcgcttatctagaggttacagtgtgtgactaacacgacacagtttaggatttatgtaacaggaatatgctatagggagagaaagaacagaagacctcagttgacacggtggaattggagtgagagagatttccatgaagccaagtaaatagtattttggagagtgaaggaggagacatcatccttaacttcaatattattatcctgtgtagattcatactttgtgtattttttacttaagagaaaaaatagtaataatattcgctaggagaaacactttgaagaaagaaataagtccaggagccctgtaatgtacttttcctctatttatttcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttggaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctgtccaccttagcctcccaaagtgtgggattacaggcatgagccaccatgccaggcgagaatttgcttttaaatgagaaagacacaatacctgccttcggaaagttccctgtcaaattttagaaataaataattaaacaaagtttataggcataataagtcataatattcttgaaaagatatgcagagggttccaaaggagcaccaaccaaccagaggggaaaatatgggggcaacagagaggcaagaggtgatatgagagagaaagcctgagctagaacacagagccaggtcatgaatctgaaggcaggaacaactctgtcagctgtgagacatgaatttggaaggctgctgggagagaaaagcagagattagtcgtgcaattatctacttaagatattttgggctggaagcagtggctcacacctgtaattccagcactttgggaggctgacgcgggtggatcacctgaggtcaggagttcgagatcagcctggccaacatggcgaaaccccatctctactgaaaatacaaaaattaaccaggcgtggtggcagatgcctgtaatcccagctactcaggaggctgaactaggagaatcgcttgaacctgggtggcagaggctgctgtgagctgagattgcaccacggcactccagcctgggcaacagagcgagactccatctcaaaaaaaaaaatatatatatatatattttgaagtctagagatgaattccagaaataaggtatacagaaagtgaaactgtaggactttgtgattgactagaactgagggacaagggagagggaaagggaagagttgaagatgatggaaacaatagattacaggaagaggatcaaatttagggggaagaagatcagatcataatcaatacaacttaattccacatgttctgaaagttaaatatctcctctagccaaaagacccttcctattttacttctctggacctcttaatgtttctttgatgtttattcccctgcacaaataatttaacccctttacagatccaaaattttatagtaggcaaatattgtaacccccttgaaaatgtatgttatgaatagcctttgtaggtgatatttttgcagtttggtaacttaggacaaggtccattttcctgtcccttgttaaatgtcacaagacttcatcttctctacctatatatcacaaagtaccttctgctctgctgatcacaaggtaattaagttttggagtggaggagtgtcttaggtttatgttcatgcattaaatataaagaaatctatgatttttaaaaaattaactatattgaggtataattcacttacaatcatatgcactcattttaaatgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaaggaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttaccatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttaagttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatacaaattagttgagttaagcattcagataatttgggtccttctcaggtggcctagcaagttagtcaaaagataagacctgtaatcaagctgccctctctcattaccgtcgttaaactgcataggtagacataataatcgacttgaataatgtaccatcaaacaacattaaatagtctatcagatcacactgcttatagtacacattaactactcatatgctttactatctaaagcagggttgtccagtcttttggcttccctgggccatatttgaagaagaattaattgtcttgagccatgcataaaatacactaacactcatgatagctgatgagaaaaaaacaaaaacaaaacaaacaaaaaattcataatgttttaaggaagttcacacatttgtgttggatctcattcaaaaccatcctgggccgcttgtggcccatgggccacgggttagacaaacttgatctaaagcaataccatccattataattattctgtgagccaattatgtaattttaaattttctagccaccacatttaacaaattaaaaagaaccgggtgaattttatattttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagtttagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaaaaaatataaaatctttaaaatatcagtcaaacgacaaattccagcttcttatgaatgaagagccagttaaatacgtttgaatgaaaaatgacgtgtgaagtgatatatgtggcagttaaagttaaccaggagagaaagctaaactaccgctgcacaggctcagcatctattgcactaatctaggcatgagttgtgtcctatccaaaccttcataatggaagagatgggggagagaatgaaagagagattggaaaaaacaaggatcctaaaatcatcttatggctaaatttgagagggagggaactatggaggcatcagtgatttatatggtttatattgtaggtcatgggaagtcataagaaaaattctggtgccaatggtgataactgatatgaagggactccttgcttgaaggaaaaattaagttaaactgagacctgttgaaatcaaagtagtagtgtgatatctaaataaaaatgtgtagcgtgcaaagagaaatatgagagtgtgtatcaggcaagagatctggctagaaatgtaggcaaagggataaatagtcataagactataaggcattgcggagggaagaggaaaagcttggagaatgagtcagaaatccacacaatagattaaagatttaagttgtgagaaagtttttatggagagtgttctggggaataaattagagattaataaaagaataaaaaatcaaccaggtagaaagggcatgcatcctggtgtgtgcaaacatgtatagctgcatgaatgtcaagtttactatcttacgtggctatatcactatgcaaactatagcctttcatagtacgtaagtgaaagcattagaggattatctgtgtagtcctaaaatcctttgtgaatacatcacattgtcctattacattcttgcccatgttttacataaccagactgactgtaatatgagtattgtgtgtgccctttgttaataaatccttgtataaaccccacaaggatttctctaaagacaaacctggcttgctaaatattactcactccaggctaaattttaataaattccataaaacactatcagatatattcctgagacttttgtattttaagtgctgtcttttcctatttggtatttgcattggttacttttgtggggtgtgctggtttcttccttcttccccttcagacactccaccccactcctgcactgtgcctggagaagatgaattgtactgactacaccacggtttttcaaccttggcagtaatgacattttttaactggatactttgttgtggaaggatgtcctgtgcattgtagatgtttaaaaaaatccctcagtgaatcatagtagcactccactcctctcccttcctcccctgagctgtgataaccactaatgttccctgggagcacaattggccctggattagaaccactgctacatcaatgcactccttttgtctacgctgtgagtttggccagtggaaacaccacaaagaggaaacagggagggaggaaagtaaggtcaggtgatccattttccagatattgactattctcgccctgctaggccagtgcaggcaggtggtatcagtccaaagatcacacagctcaagtcaggcagccgtcttcacataggacttgcttggtcatctctccttcctttctccctctttttctgataaatggtaatctccctgttcatttagttcattttggcctagtggttataacggtgctcgctgttgccatcctaaagtattgcactattccgtgtgtttttcctaacccggtctaaaccttcgtaattagtccctttataaagtctcctccaactaccaaatttgtgtgcactgtttgttttcagcaggagttataattgatatgatgtaagtacatatcaaagtatttacagaaaagcaaaattccaaatattgagatgttttctctgtattggccccaatcattggaatgttttgtgcatacaactttataataatcactgacacctatattattttcatactttgatttgctcaatgaatgctagttataaaaaacaagatcatttaaaatacttccttgcctttattattctcaggtgaaatggagatatgaatttataataaagagtgacaagttagtggaattgtaaaataacattatactcaaaaaagaagaatagagattgtaaagaaatgagattgagtccgtaagtaatgtataactgtctcagtatttcattgtcataccttataagtaagcagggaagtacaaatagatgtgtacttattaatttagtctttcagtcactcattgagtcaatcaattcttgaggccaattgtttttgaaggcactgattgtgctagatactgtggatgttacaaaggtgaataaaatgtcttaatctgaggaagaatttacaatctacacaggcatgaaaaaacaaggaagagtgtaggtgaaagggaaatttgaatgtgaaatcaccaaggtcacaaagcatgtctcctcagtgctagcgaaggactatataataggctcacaaaaatatttgtttaaaatgtaattaaatgaaatttgaagaaagcagaaaatgtctcacaatgctatgtggaagttattagaataacacccccttcccagttcctaattgcattcctggcatatcttatgtacattaatctataattaaatgaaacattaactgctttattaatggctactttagaaggagtgcattcattaaggattattttgaaatacaaataatttccccataaatcttacattcacatatttggattctgagttttacccaagtggcacacaaccataatttgtaggacaggtgaaataaagttcctactattctggtactgtatctagactgagctttacatatttttaatagctttttttttttttttttgagacagagccttgctctgtcacccaggctggagtgcagtggcgtaatctcaccctactgcaacctccaccttctgagttcaggcgattctcatgcctcagtctcccgagtagttgtgattacaagcatgagcaaccgcatctgtctttcttttctttctttctttctttctttctttttctttctttctttctctctttctgtttctttctttccttctttctttctctctttctctttctttcttttcttctttctttctttcctttctttcttttatttcttctgttctttctttcttttctttctttctttttttttttttgtatttttagtagagacaggatttcaccatgttggccaggctggtctcgaactcctggcctcaagtgatctgagggtcttgacttcccaaagtgctgagattactggtataagccatcacacctgaccaatagcttgtatttttgaaagaagttttaggtttgtggaataattgtactgagattacagtgcattcccatatactccattacccttcccccaattcccctattattataattttgcattagtgtggtacattattaaaacttatgaaataacattgataccttattacaactaaagtccatagtttatattagaattcactctgtattgtaaaattctgagttttaacaaaggtataaggtcatgtatccaccatgacagtatcatagagaatagtttcactgtcctaaacatgccatgtgcttcacccattcatccctctgcactttctcagagccccaggcaatcactgatctttttactgtctccagaattttgtctctttcagaatgtcatatattggaatcatatagaatgcaacctttcaaactggcttacgtacctaagttttctccatgtgtttttgtggcttgatagctcatttctttttatcactgaataatattccattgagtacatgtgccagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatagcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttactgtaccattttgtattgccagcattagtgaatgaatgaaagttcttgttgctccacatctcaccagcatgctgtgctcttggtgttttggattttagtcattttaataagtgttttgtgagctttactgtttgatagctgagttacaaactggcaagtatccaagcaaagaacagagaactggaggtttgcttttctaccgaaggaaatatgttgagaatacaggaaagtttcacgctaaatgtaaataattttttacagttaaactaataatgagtgattgaaaaaagttgacttgtgacatacaaatgatacaaacctttcattgtcctctctttcatgggtattaatatttcatttgataaagatttaagtactaatgactatcagtatctgttgattgctagcaattttgagtagaacactttttctgatatgtatgaatatatagacaagaatcatatgatacacctggattgtgtaatagcctttatgatgcagtaaggcaaccactgaacttggaatcagtgaattacaatttgtttcttctgggtccctcactagccctgtgactttggtctatttgacttctgtgagcctcaaaagtgcatttgtaaaatggaaattaaatttttttctgcccatcttactgtgaagctgttgtaataataatattgacaatagcaataattatactaataaaaagcaatttactgtgtatttgaaattatgcaaacaatttgaaaatcatagcactatataaaatgtaacgtcacattagtgttggagtttacaatttggcagggaagctgtacaactaaccacggcacaatttgataagcaataaacttcctttagagtatacggagaaatggggaggattataaatattaagcccttttgtgccaggctctgggaccacaattatcccatgtgatctccatcacaccttgcagatgtaaattttcttattcttattttatacagatgatgcaactgaagaacgaagcaagttgtccatggtcacacagctaataatgatagtattttcctattcctcatagaaaactggagacggccacattatatatccttaactacagggaccatttctagaaatcaaatttctagaattcaagccacaccacatacaatatattaccccatagcttattgataatgctaaaatatgggatatctttgcatagagatccttaaattgtgctagaatatgagatctttttgcatagagatcctctcgcatagagaattcctgctactcaagaatcaatgttagacattcactctgtgctcacagtgttcttttctcttctgtcaaaaaaaaaaaaacaaacaaaaaacaaccaccttattttacttgtgaccttcagtaccaagtaagactggatagaatatcaagataaatttgcgacagatttagtgtcctttctgtcgcattatcatggttgcccagaagttaagaggtttggaatgattccagtctgataaggagaacaagacattgaagtaagtgtctggagtctaaaatagatctgggatagctattactttagcttttctgagatttaatatgggaatgaggtgtaaaagaagagttgaaataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttcaaaaaaaataaaaacaagggcctggcacaatggctcacacctgtatcccagcactgttgggaggccgaggcaggagaattgcttgagcccaggagttcgaggccagcctgggcaacatagagagacgctatctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatctctaacaagaaaaagttcaatgctgtgttaactggcaattccatttaaaatattttcaaacacattccctaaggtaacaaatataattattaaaagcctaataaatcttttaataatccagaaagaaacatttagaagacattaagaaagacatattcagaattcagacagaagctcataaaagctaacataaaaagcaggttaaaaatcaatttctacaagaaaaatatagacatataatcaaacaaaagggggaaatacataacaaacactagacgaatgcaaattttcaaagctatattttaccaaattttaaaagttaactttaaaagaagaattaaccttggtggcagcaaaatccatgtctgtgtgtctggctgatttgggttcaattaaaatcttgggtagagaacacttaagtgaaaatatagggcaaaaataattccatacaaaatataatgaataaatagagcaaaatttcgcatataaccaaattccaacattttaaggaaggtattaatttcaagctaatatccaaatttgtctggtaagaaaaaggtgagcatgatccctatgatagtggttgccattacttctacttttgtgaggcagaataggtgggacagctctagggctcttctgattttattctatcaattataagaggtctgagaacaggaaatgaaaaaagctatgaccctcaagccatctagctcaaacgatttcactggcatctaggatctgatatattttggattggggaagagtaaacacaggcaaaatttgcattggatgtgaagctaatggcccttccacataattttgctgtaggatatcaattgattccctgtttcagaggaaggattgttaagctaaaatggtttcaaccagatcaaacattaaagtaagcagagtttttcagtagatttgactagattcttcatttactataaagatctgccacacccgaaataccacctgaaattagttttctagttaaatcagtatagactatggataaaagaagttacgaagacaaccctcttaatcttgatcaatattcagagatgactactccccatcacaaaagctaattcgtttttcacatttttctctgctcctaatgaaatcttttttgctgaagtttctgaagaaataaataaagaagcctggtgcctctcagagttccacacagctgatgagtctaggcagtgacaaatgacactatattcctcagcgtgcaacctttctctccctctcatcttcttgcaatggaacactgctacattccttgcagaggaaacgtactgtacatttcatagctgtcaccttggcataaaaggcagagggagggggaaattcttcttttggtctgcctaaacattttactttattttttatatatcaataaccatgagaaactattgagtaagtttagatataaaacagagaactttgttttggaaggcattacttttcaaaggaaatgcatcgtggagagtgaggagtgaagggtcaatgttttcaagagcgatcggaagctccctgccttgatattcctaatcttctttctggcatcttatgctcaccaactgcctaatagtggatgcatgtggttctgcccatctgtccaattgccattctaaattatgtggtttactaagaaaatacttaacattatatgaataatgtataattaattataagtagtttttaaatcttcaagatttatctcatgagtgaaatggttgctttgttcttaaggagaaaattaatttatttcccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggtccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaaattattagcttaagggttagatataaaaggtatgaaaggaaaaggatcaaggatatgtatggtatatctgcaaatgctaggagaccaaagtgaaatttcacatagtgaaattactgtgtttcagcagttagggataactttttggagttctggaggcttgggctggacttttttgcatggataaaattcagacaggagacataaaagccttcttagtggtaagacagttattagataattgggaagtattttgaagatacttgtctacctagaatgaagaattttgttgagtatttgagagctatatggctgaaaagaaagaggccagataaaacaaggccctgagtaacaagagtaggccttgggccttgattctatagagagtgcaaaaccactggctaattttttgtaactaatctggctagaaatttccagatttccagcacactatattaaaggaagtactgccaaaaaacatttcatggattccaaaaatagagatcaatgtagatgaatttataagatgaatgaactctgggaagaccaagcagatttctgaaacaacactaccatatatttcattatatacacacacagctacacacacacacacacacacacacacacacacacaccataccctgaacataccctacaccctacataatacttatatatacacgttagtgctctgcagttaatttttataaaggcaccaattagtttctaataagaaaaagaaatgtgtaaagaagagaagaaatttcattctctccatgaagaataaaaaacacaaatatttgttagctgtaacaaatatacatttttttctcaaatcatttcatgatatttatcacatgaaaaatgggtactttggggagattttctcctaaagccttcattttttcatatatagtgagatctaaacaaccaatttctatttacagttgaattctacttccaaaaacatacaactatgactcaatccttgttacctttcaataaactgttaagcccaaagatataacttattttaaaatgtgaacctagacatttgggatgatcaggcatgctagttactattaagaatagcagtatgtactaataaaatggtattcagagattataagggaagcactaatgaataaaaatgacccaaactatatataaagtctttgttcatacacaaaataaacacatgcactatggatggggttctctaacgacagtagaagtaaacgggcagctaaagagtgtatcaaaaactgcacttttacagtttcctatatatcgtcagacaggttaacaaaagtatcgaaaagttggcatactgtggataaagtacattaaaatgagaaaggcaaagttttaaggatatatgaaaatgaaaggatggcaactagtatggtcgaaattcatgtgataaatcgtaataaccaacgtgatagtattaagtggtggggccttgcagaggtaataaagtcacgggggcagagccctgacaagtggaattggtaacattatgaaaggccttgagggagtgagttggccctttctatctctctaccatgtgagaacacagcatttggccctctggaggatacagtgacaagacaccatcttgggagtagagaaccggccctcgccagatactgaacctgaagacaaatgccttgatcttggagttcccagcctccagagctatgagaaataaatttctgttgtttgtaaattacccagtctcatgtattttgttataacagcacaaacagattaagacaacagctttctcagagcccaaaacatttataatagtaagaatttgcaaaatcaaacaatgagtaaggcctcaaatgatcagctgtacttgctaaaaatgaaagaacaactaaatcactcaattcacttgggcaagacaatccattattcgtctaaaatttttgttaataattttctgatttactatctaatagtactggataccatacaaccaattactcctacaaatttttttgttaatagttctctgttttgctttttaataatactggataccaatactggatatccaaaatggtttgatagttgggaacaaaggggataaaggaaagaaatgtactataaccagagatttttgaaaaataatgagactgtatgtactatgatacttcactcagaaaacctcacttcaaacttaatgggaagagaaaaagattggggaagaagtcttcaagcacagtccataatattgatagatagactcctacacatattaatggttgacagctagatgtcaatgcctagagcacaacaaataggtcttatatatcactatattttttatgatgcttggcattgtattttttttgtttgtttttgagacggagtcttgctctgtcacccaggctggagtgtattggcatgatctcagctcactgcaaactccatctcctgggttcgagcgattctcctggttcagcctcctaagtagctgggattagagtcgtctgccaccatgcctggctaatttttgtatttttagtagagacagggtttttccacgttggccaggctggtctcaaacacctgacttcaggtgatccacccgccttggcctcccaaagtcctggaattacaggcgtgagccaccgcaccaggctggtgtagtattttatacacagcatgcatcaacaaaatggatcagatggatgggtggacaaatggataattgaaagaataaatagcagaaatgataactctaacttttaagagtctatcaagctaaaatgacttttgaatcagtcgaatgaatgtacgtgggaactgggaacttaagaaagagaaggagcataaattgcaattgtggctaaagcagcagaatgcttatttacataagttttaaccagtgcggaatattgtaattaccatttatgttgtttttttatgaatccagtacatgcttattaaagggaattggagaaaataaaaataagaaaggaacgcaataatccagactgtaatctaggacccagtaatagttacttagttgcaaaatttcctcaagggcaatatgagagagaccattttgtgcttgttgccatgctgggggtgcctactggcgttaaagaggtaaggcccagggcttgtaaacatcctacaatgaatgagagttctccacagcgaagaattacccagcccaaaatgcaaaatgggcttcactgagaaaaactgagtaccttgtgcatttattccacgtctttatatgtacataagccacatacaggtttttaaaaaataaaaatattatgctgcacaaactgctttgtaatttgttcttttcacatactgcaacaatagcatccttccacaccattaataattattctacaacattttaatggctgttcagcaaaccactgcatggatcaaccataatgcatttaatgaggtccctatgatcaaacttctagcactatttttttcaattttgttttataatcaattctgtgataaacatcttcatatttaaacttatgatcatatttaaattcttagacatgcgactggtcagagcatgcataatttcaatgcttttgatagacttccaacatgtcctcaaaaatgacttttattagtttattctctaaccatattgttctgattgatggacatctctaacataaagttgctgaaaatatgaaacatcagctgaggcactgtgaccctgggaactggctggtcccttcctagcccacatcttagtagaagatgcaagggttattgtggaatacgtccgcgggttaaaaaccatgtatcaattctaaattccaagtgccagaccctttcattacctttcattagcgaagtataaaaagaaagagggagaagggattttcaaggaaagtaataagaagggaagtattagtggaacattagagtttgtctctggtccttcctctgagtggggactcatgaggcttggtgttgtctgaaagcaggaaggacttgggtcttactccctggtaggatgcagcctgaggagcaaggccggcagtcacagtgtgagcaaacattcatacagacgtgggggctgacatatcaagttggagaatgtatgctcacttcctgtcacccccatacaccctgattcccaagagttgaggcagttgtggtaggggttcttaggtttcccatgggctcagattaggcctcggacggaagtgaaggcagtggctggctgggtgaaatatggcggacagagtcggtgagtaacaggagagcatgttatcccttttagacccctgaagtattagagaggatcagccaggcacgtttagaccatatgatgtatcatattgtagattcaccccaaggcatttgtggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaggattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatagtgattacattttatttagctaaataaaacggcatgttcagtgatgcttttccctctttgtgttatacaatttacttacttaatatcatcaaactacaaaggaatatggaaaagattttctgtgatcatgtatcgacacacttcttagagaaaatgtaagttcttggcaaaatattacaactgtataatgcactacaatttttaaaaatcttttgtctgcattatcttatttcattcacactccaaccctgggcagttggctggccagttacagatgagtagctatggtttagaaaggttacatgagttgccagggatctggcaacgcataattgaatacattgtcttaagattcaagctattaaacacagactgaaagcattttgaactcatttaattcaacatttttatttcacagataagaaaactcatgcttagagaggggagatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattagtatttagtggagattaacttttaaaggtgcctactttagatatgtcataatattagaaattaaggatgaagtatttctatctatctatgctttgtaggacaattatattaatcccaaagttacctgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatactttgaatagtttgagaaccaaaagacctcttttgacaatttcctcttgataaagcaaatagcatcatcaatgtctccctaaaacttaaaagctaacagcctatgcttgaaggggcagaaaagtcaagttatttcttactttttagggacaaacaggttgtttatcattgtagttggagacaagatatatggaataatatataaacacatcttatcctatttatgcccgtcacctaaacatataagtgctatttttccaagtttattatcaaattacaaagtggaaatatggctcagatggtagtagaggtaaaaacaaacctaagtcatgtaagatgagtaagtctaaagatctaatgtacaacatgaagattattgttaataatattgtagtgcatactggtaatttttcaagaaagtagattttaggcactgatagtaaaaaagcaaagataaccatatgatgatgggtatgttaatttgcttcaatgtaggaatcacttttatatacgtgtgtatattatatatatatataaataaagataagtatctcaaaacatcatgctgtacaacttaaatgtatacaattaaaaataattttacaatacaactaagtttgaagtcatcctacatttaacagtatctcattaatgaaaccagcaaaattatcatgccatctttgcaagtgaaggaatactaacaatagacgttagcacatgcacagtaaaaatgggttcacagaagtgtggtcattgctctcacgttgcagtccacagaattttaagctatgttaaacatttatgaaggaacaagggaagtgcacaaatatgatttaaacctatttgttggtgtaacgtgatgcagttctatcccactcatcctataatacatttctttgacaaacaaaactatcatcgcaatcagttctttgaatattaaaattggatgtatagtcatgcatatgttgtgggattgtaatgcttacagactattaaccactgatcctaagatttgggtggaagtatttgtctctatatctaagcagctaaaatatcatggctactatctgtgcgtgtatgtgaggtaatttcagtctactgacaaaaacacaatttaatgtatgatatttattgagagcatcagcctctctcatttctaagataaatctctttttttccatgatggatatatacttgtaacaaaccatattgttctcagagaccacagctgctccctttttcccagggtaaatatgtcagtctcccggcctgaactgcccatttcttgaaggcaggagccacccatatgttactcagttttgtatttctcatggtgcccagctgagtgtctggcacatattaagtactcagttaatgatttttaatgaaaacatagcagtaagcctattttccttataattttatacataattacagagtactttcccacctagaaccttacaggattaagggtcattagaattcactattcatccatcttgaacccagtgaaattttgtcagatacaaagaaaggccataataattgtgtttctaagtggggacagtttatgtaccattagtgggctctcatatgagtgagaaataccaacttttacataccacattgcaaaatgtcactgttacatacctttagaaacaaatcaatcttaaatttttctttaataatcacagtatgctttaatctaagattatagtgccagtaatagtatatgccactcgaaacacaaatacaaatcaggcaattcattgtgtctcaaagcttttaatttaggtctaaatatacctaatagtcatctggttatcttctgaagtcaagcacaaggacaagaaccaaacttttaattatttgaggcaatgtattatattaacaattattagacacttaaggggaaagcttactataaattaaaatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctgggatagaccaagtgttctagtggctactccacactgcacgcatagtagcattacagaataacgctgattcaagtcactttctttgtacaatattcttagaacaagcagatctttcttcttcaatagaagtaggaaatataaattttctctatataacatcactgttgctttgcacttaaaatttctgcctgtgcacttttaacctgtttctactctgccaatgaaaggtatgaacttcaagaaatgaattgtatgactgataacttcttatgtgcacatgagtaaaaatatggatcaaaagatctattattctaatgtactaaacacaagagttaatattgttctgtaaaacaaaatcttataattcaagataactcatttgtcctttaactagtcttatacttagaaattattactaagggcagctacattcatatgatcaaattaacaaaacaggtatctgctttgatttactctcgatttattggttgttcagaattatgtcatttaatttccacctatttgtgaagggagagggaactttccctccctcatcaactagagggtgatggaccagataccctcaaagggcatgaaaggtgaaaaccggtgccattactccctttcagtgttcctgatcttaaaagcagagccattaatccacttctacaagctagacatccagtacccctacttgtcacatccctcttcctccaagtttctggcacagtgtgagcaaacattctttcttgaatgatgaatgagtgtctcaatgcagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcgaaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatattgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaaggaagggagaaaggaaggaaggaagggaaaagaaagaaaggaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagttataatatctttggtataatcttattcgtgtcccatgtttgtcaaaaaaattcagtcaaaattcttctcagaattttaaaatctacctcaaaactatatctctggttggtatgtattttaagtctctcatttcccacaaatatgtatttggcaatgaactgttatgtaatatgcagatatgccatttaataagagatgatgtcactataaagaaataagtaaaagaactttattttggaaattaggaaattaggcacaaagggatttgttactccaaggaagagaaattccaagacttacaattaacatgaaagccctcattctttctgaaatgtcactgttcctttggcattttactacattttttgtttcattaactttcttccagaaattgaaacaatcataataattataaaatttgcatggcatttatctgggttaatgcctgaaacaagcaagaccaatataaaggtagcactttttcacaaggggagggtcaggtagccgttccccacagtaagtatcttgctcctgcctccaggcctcacatgaaaatgaaccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacatgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcctcagtctcccgagtagctgggattacaggtgcccacaaccacacctggctaattattattattattattatttgtatttttagtagaaacagggtttcatcatgttggccaggccggtctcgaactcctaacctcaggtgatccacccgccttagcctcccaaagtgctaggattataggcatgatccaccgcacccagcccctacttattatctacgtgttcagacgtggtattatcacatatgtacgaataacagcataagaaacggttgtgaaggaacttggatctttttatagaacttcaggtagtgaaacaaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaagaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaatgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttgaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctgaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgtaaatattgcacatgctgaaatcaccatgtccttactgcctagcaacatttcccatagttttctgtggaacactagtttcattcaaccctagtaactaatgaagaaagttttcaataatcaaaaagtttgaataaccctgattttaactatgtaatgcaaatttctttactgtaggacatctcagattccttaatacgctaaagagaaaataaagtatacaaagtctcccaacattgtacaatgttagaaacttaagattgtgagccactgtccttcagaaaacattttataaaatgtctaattgtacaaacttcagtctctctctctctctcacacacacgcacacacacacacacacacacacacacacagatatgtgtttacattttggcattctggaaaagactaaaaaaatgcagcccatctccacagtctccattagatcatcaggtgacagtaatagttgggttctttaatttttaccactgactccagaacttgccacatgcttgtctgctttctaaacctcatgggttcttcctcaactactaaatggaacaccattcatctaggttgaccgtcttcagatagtggagtctccacctgtctgttatctagttcttattataatcatgcttcacaatatcatatttataggaggtccctagaaggcatcatagtccacttacttaactacttctctgttggattgcaacagagcccattaaaggtgcacaattaacttctaacagaactagtttcaaaggagtctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgattatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacattttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcaacacttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtctcagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaaatgacagattgagaccctatctcagaaaaaaagaaaaaaaaaagaatgccactaaaccacaccattagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttcttttttttagacagggtatcactctgccacccaggctggagtgcagtggctcgatctcagctcactgcaacctctgcagtgagctgtatggctcaagccatcctcctacctcagcctcctgggtagctggcaatacacatgcatgctaccatacccggctaatttttgcgttgtttgtagacacagggtttcaccatgtggcccaggctggtctcaaacccctgggctcaagtgatccaccagcctcgggctctcaaagtgctgggattaaagacctgagccacggcacctggccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagatattgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacggagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactctatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaaaagcaaacagtcgcattttttactattagctcaaatacacacgttcacattcacctacctacacatacctctgactcagtccacctttttgacaagcaatgatgcaaaaatgaatcaagagagagaactaccagcatttagagtattgattatcctaacccatcactcatgaacaagcaccaaactgacatttggggtttacctacctacatagagaacaccctcttttgtctttcctgctgcttctgccacaccctgtttggttttctcagcagcagccacaactccctccttggcctttgaaagtcctttcatgaatacatccatggctaatgaattcctttacaccacactggaaaacataaaatacactttgaatgagaactttcggggaaaaataaacaaaaaacactgaaaaatcatgagaaaccctccaaagtgtgagactcttttaagtgtacactcatttaaccattggacaaagcagacatttttagctctggcattaaaaatttagcatctcccatccatcttggctagtaaaagtctagccacctaaccacggattaggatgaatcctctgagttgttattactgcatttcagaagtggagttgcatgaaaagattaaccccttttttaaattcccggggtctaaagggtaacagtatgagttagaagcatggaagctggaggcttagggtcaggggtatccttaacatgaatcccagaagaaggctaacaggttgatggtggaaaggcgtaggcaacagaactaactgctcactcggggtgtggttcaaactcaggcaaacagcaggcccaagtgtgatggttctaatccatccaacatccacccccgccctcagctatctaccctgagcaggcgccgctcacactcgcgggccgtctccaaccccgcgccagccacccgagggggcgttctcagcctccaccctagcggaccccgcgccagcacttgttaacccgttaccacctgttgacttggcctccttgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggc

SEQ ID NO: 2025 - DNA, 114198 bp, Homo sapiens
tattttcatatatgtatatatttattatgtcacaaatagctacatactggataagccagaaagatgaggaaacatgtttgcatctcacactagtgcagagattctgaaaaagaccccacttggaataccaaaccacacattagattgttctgttcccaattgtgtgccaaagtgcactctgaactgttttggtaaagccgaccgtggagtcatatgaggctgaataacttgggagaatgtaagtctgcaaaataaacctaggactggattgatcctcaggccacttggcaggtgaatgtctcgggagtgaatatgagacaagcttcctgaaaaggcttatatgacttaaagaactttttgtttaagtgtttggtcccaaataaactattaagatatataaagtaattcactgctcaaaaattaccgtcagataaatattaagggaagaaacactttaaaggagaatttgtatccacataaatccttaaattcatggtcacaactttcctaatctcaaattgttctaggtcactgctatcagtctagttctgtcctctatttcttaatttaataccaatacttttaaatttttaaaatatgctgctttaggtagatttaaaatatatcctaaccgccactttctaaccttcctgaaatatactgttcaataacaaatcctttccttgcttaaacataacttaaataaaacaagaaacttaccatttctctctagtgtaagatgacacatgcagcttagcactctgtagtagtctctcttcaattaggtaaaaaaggaagtttctatggtaaccatccttatagtcactcattcctccttccttcctcaccagcgcccaatatatatcacattactcatgaatacatataaactgctagcatgtctagaatattctgtcttgaaattatactttctactagtgacttttagaaatgactatgccccagaataattaaaaagagaaaccaaataatttttaaattaatttatacagagtttttcaccatcaagtttattttcagcacccatggggagttaatagatcttccctgaaagagaaaaacctttcctaaggaaaaatcctagaattcatatatttggcaacatttaaaggaggccatgaaatttttatcagtctagagaattgatctcctttaaggtgactctggtagttccaacgatgtttaaaggcatttcctgtaaaaaaaaaaaaaaaaagagagcgagagaaaaagagagagagagagagagaatttctgatgattaaaaaaaaaaagtgaggaatgctgagttaaacaaagttaaccacattctctcagagccttgaatgtgctaatatgtgctaatgtgtcttatggctctctaaggagggtgtagtcaaaatcatcttctacactgcttagttcccgggaacccactttttttttttttttattcatggtcgaatattatttattgtcagaaaggtacagcattcacaccaatatcagacaaaatagattttaactaaaaaattatttcgagacaaaaataacaatatatgttaataaaaggctcaattaaaaatgtataacaattataaacacatacacatcaaacaacagttccccaaaatacgtaaagcaaacattgacaggattgaagggagaaatagaccactctacaatagtagttggggtcttcaacaccccactttcaataattaatcacagccacttaaggaaccagtgcataccaaaacacacttctggcagtgttgcttcagggaattccgagtgtagggttaatgttccattttctctacctcttctaaaattcctccttcttcaaatggctattaataactttatatttttgtcctttgtgtcagttcttaattcatgttgcttataagcatgatttttattattaaagtgagatgggataaaaataaaatatttttgcaatgagataacgttttattttaattctcaccatttatatacaaacacaagtgaataaaacacatcgcaaaatggtaaaatttcatatttagtatttataggtgcatagtttcatgctcacatatttttaagtattatatatattaacaaatttcacaatacgtcattattcttagacagtatcattaaaagacacctaaaaatcttataatatatgatagcaaatcactaacaacttctgaacaacagcaacaaaaaaatagtgaggatttagaaataagtggtagtcacttaggtgtttttaatttgttttaacatcgtagattgaagccacaaaatccacagcacacaaagaccctgctaccatgtattcacttcagtgaaagggaagcaccgaaatgctgagtgggggcaggtacagatacttcaatcactgctgatggaagacttcgagatacactgtaaaaactttgagaaatgtcatgactgggcacattggaactgagcacttgtacaggatggaacatctgtcagcagatctcaagaaactgggagcaaagatatttcttaggcttcaggttcgtagtcttgatacccttcctaatattagaaaaatcaaaaagacagcacacactgttagtataagtttcaattacgcatcagcactgacagccaatgagataggaaatggctccccacttacactaaaatttacaatcaatgtttttgcaaatattctgcagcaaatattatcttatttttaatagttgtgtctttcttgtctgatataaaagtgaattacagtagtagtcagagttaaaatatctaggttctgatccggatgcaccatttaatgatcatatacctagtttggtaggacaaataagttggactgtctggttctcagtttcttcacctgtaaaatgtgagaacaaaatcaagctgtctataaagccttttccagactaagatgctctaattctcagaaggaaattaagatgtttgaaggcaagatacattttccctactttcactctcccagttgaaaatttcgtcttcatctatggcttcaattattacttgtatttcaaacctcaagctctccatacagtatctggatagcatccacaacacaaatattaatggatttaattaaagggatcagattattcctcctaaagagcaactctaataatatcaggattctgcttaaaaacaaacaaataagcataacttcaataactcaagttgttttctgaatagaatacaagctgaaatgacaagattatcctaatactctataacttgtctttgacccatagctgcaaattcaatctatcaccattttccttgttcctaagcttgagtcataattattcactgttctcagacatatccatttgcatgctcagacatacatgcctttgcttctgatattcccttgtgccagaatgtcctctgtttgttttgacctactatatctcttaccttttcccacccagatcaacattacctcctcaataaaacttctcctgattgattgaaacagatctttaaaatgttttactttttagtatgtcttatatatttttgctcctgtgatgcctggtacatcgaagacaatcaattatgtttgttaaaggaatcataatgaagaaatgaatgaatgaatttctattttttttcatcaaacctaccagactgtaaactccttatgtcctggtaatgtcaattactctatagttttccattgtgtttagtactgtgtcttgcataaaagaccccaaaatattggaaattcttattaggcaaacaaacaatttaatctcaatttctataagttgaattattatcaatatgcctttcgtgtgtctgtgtgagacagtcttgctctgttaccaagattggagtgcaggggtgccatctcagctcactgcaacctctgcctcctgggttcaagtgactctcatgcctcagcctcccaagtagctggaaccataggcgtgtaccaccatgcccggctaatttttgtatttttagtagagatggggtttcaccatgttggccagactggtctccaactcctggcctcaagtaacctggccactttggctcacaaagtgcgggattacaggtgtgaactgctgtgcccatcctcgacatgccttttaataatgccgtgaggaataatacataaccaaactacaacatacttgaactcaatttttaatggagccattatatagtttcttttcttgtgatatcttcatttggttttgattatcagggtaatattggtctcacaaaattagttgggaaatgtctcctcttctgttttgtaagagatattaattggtgttaactaattagtattaattcctctttaaatgtttggtagaatttaccagtgatgccatctcggcctgggattttctttgcaggtaggtttttttttttattactaatttaatctattcgctgtgttacaaatctattcagatttactgtttcttcttgggccagttttattcatctaacagtattttctaatttcccttttgatacattttctattaaagatactttcattttcaatcaaaataaaattaacaatcatattgtgttgtttaaaacattatactggaatatatcaattgtcgcaaatcatgcatttatctttttattctataacttgtgtgggtaacttttattttactatgcgtcatcccattggacatgtatggcaaaaaataataaccttcctttggcattccattgatttccctaactttccatttagaaatttattttagaatgtaaagtttctaaaaatatattctctaatgcaggggttagtaaacttttcctgtaaagggtcaagtagtaagtatattaagctatgtggactacatatgatttcttttacatcctttcttcctcttcttcatcttcctcctcctctttttttttaaggaccctttaaaaatgtaaaaactattcttaacttgcaagttgtccacgtaatgagcatgtagagagcaaatgattctcactaagcactaatgaaagagaaatgtgacaatgacaggtttttggtactgtcttgttagaaagattcagcttggactcctacctcagaaggcatttcataagcctcattgtcaggatccacaggcatatcttccagaattccttcctgtggggctccttcttcattctaatatttaaagtaagaagcacaaaaagaacatgatgaagtagcatttttcacttttaaaaatcagaaccatgttttggaaaaatcttacatatagggatgttggccacggatcttgaaaatggcacaccttaatattactactggcattctaaactccacaatgcctccggggaaacattgcggcaacatgggttatcaaccctcaaagtatgtaaactttttgctcaagtaatttactatttaggaaataatccacagctatagtccaaagatatttttcacaagatcaatgacagcaggaaacaaaatttttagaattgttaactaaatgttcaatgaataatgaagagttaaaaaattattgctgggtgcagtggttcactcctgtgatttcagcactttgggaggctgaggcaggtggatcatttgagtccaggagttcaagaccagcctgggctgttacaatgaaaccccatctctactaaaaatacaaataaatagctgggcatggtggcacatgcctacagtcccagccacttgggaggctgaggcaggaggatcacttgagcctgggaggtagaggctacagtgagccatgtgcatgccactgcattctagcctgggtgacagagggagaccttgtcttaaaaaaaattatcattcaactactcagtagattatgataaagacctgtattactattacctgagaattatgtaacaactacctatttatggtataatatttagcaggctataaagtgttgtctatattatagatacaacctacacagaattcagacgcaaaggtaaaaagtttggaagaaaacacaataaaatatgaaagttattttgttggatagtatgtatgttattttgactttttttctaagtgtttaacttttataaccacttataatgtaaaagcatacatatttaacacattaattttaaatgacaatgaagaaacaaattcttttctgaaatttgaagactgagactatacatattgaaggaaaataatcaaatacatggtcagaaaatttttctaggtatctcttcctagacaaagaatactacaaaactcagcctgaaatggtcatggctttgttggtattcttcactaaataccttttgttgctttgcatttatttcagcaaagtaattataagaagataaaggtaagtgaaaattcaaagaacagagaggcaatgtgagcctaaagggacttggagaaagagatcaaataatccctcagccaacgcggctgattttcaacaacatgtctgatgtaaaaaagcttccccatgtcttcacatggaagtgactgacagggacgcagaagtataagaaaatggctaacagtaagaaaaggtcacactaaagatcatgcttatggtaggtgggcagagaagcttacagatcattctgcccttgccaatgccctttttataaactaaaaaaaatccaaataatatataaattaaataaaatatgaaccaccccaaactacctcactttaaaatgtggagtaaacatactgttttcgtagtgtttcacttcttggtagatacgcctctgctgcaggatggctaggcacaaggccttccatgtcacaggacttgagctcaagtcctagcttctctagatgacagagcttttgtgatgctgagaagtttcctatgctttttctgagtgtcaattagtcttagtgatcaaacgggacagcaaaaccttctttacaacagggagaaggaaacgacatcattaactttctcattaatatttagattactgttaggatatccaagtataagggaaataaggcaaatttttttccatgattttgaaactgacagagatttgattttctaatataatttgttagaaaattttgatatggaccagacaagtaaatatggcagacctaccctgtttgttgtttgatgatcaaaaaggagttgttatgacggaactaagactgatggatattactggatttgtttatatgttatttggctgaactttgaaggatgtacacagatgtgtaggttaggtgagtgtgtgtgtctgcatggttccagcctgggtgagtgggtgtgtacaagagcaccctgcagtaatggaacagcgtcctgtccggggtgggttcccatattgctccctgagctgccaggataggctccaaccacctgcggcctccaccgaaataattaggtaagttatttgacttgtttgtattaatctttcttaaacgtatatatagctcacattaatttcaatgtttaatgtcagaagtgatttatctttatttaggagtttgatggtgtttttgtgtccagaaatttgccataggacttaattcttgcttatatcaattagccaatggtaaaactggttttgttatatgttgttttgcttcaagtcacagtttccagaaactattgatgaagttaagtgaggatttactgtattatgtgccctctgatggaagtacatacacatcaccatcttaaactaagactgtactagtttaagtgggctattgttcactgatccaataacttcatcaagtgggaacaagctacactagggatgacagcacaatcctattctagagtccaaatcgacaatagggtttacgacctcgatgttggatcaggtcatcctaatggtgtaactgctattaaaggttcgtttgttcgacaattgaagtcctacatgatcggtgaggtcaggagatctatagcatcctggccaacatggtgaaaccccatctctactaaaatacaaaaagttagccgggcgtggtggttctcctatagtcccagctactcgggagactgagccaggggaatcacttgaacccgggaggtggagattgcagtgagcccagatcacaccattgcactccagcctggtgacggagtgagactccgtctcaaaataaataaataaatatataaatagaaaaagaaaacaaaaaaagaaaagccctacgtgatccgaatttgaatttgattaacatttaactatcactgacaacttacagcaaatataaggtggtgaaaaacatgttcattgcttacaacagtggctacaatcagcaaattttgcactgtgagaaactacacaagacaaagaatacgtctaatttcaataagtaaattgcaactaaaaagaagttagtgggaacctgccgcttaaagtagaagtgagagagcattagccaattgcaacctaagaactttatttcattctcattgggaaccctacataagcaaatggaaaacacatatgaggtagttggggaaatttgaacactgacttgatatttaagaattattgtttatttctttaggtgtgatgatatattgcagttttacttcaaaaagttcttaacttttacaaattaattaaatgtttacagatcaaataagatatctatctaggtttgggtgggggaaatgggtgggatatagaagaaacatgagtttaatatttcatcagttttaaaaagtatatacagtagtctccttttatccgtggttttgttttccatggtttcagttgcccaccaccaattgcaaccccaaaatactaagatatttagagacagagagagagggaaagagaaagcgagaccatacccacataacttttattacagtatattattataattgttctcttttgttattagttattgttgttaatctcttactgtgcctagtttataaattaaactttttcataggtacataagcattggaaaaaacagtatatgtagggtttgctactatccgcaatttcaggtgtcctagtgggggtttcagaatgtatccctgtagataaaggaagactgctgtatgctcatttcaatagttagttctctaactatgtttttctgaatatgtgatctaaatttgttgactctatcacattcgtagattttaagcatactaaaatatttggcagctattccaaggagaatataacaacaaacacttcatatgaccatcagacacaattttatccctatacctgtatatttactgtttcataaacctatttctaaaaacattgttatctataaagaaatattaaatttcaactccaatttacaactgtgcctaatatagtttggctgtaacaaaaaaagaacattaaaatttgcattttatgagtattcatgacttgttttcaaaatataatcatacttgaaggtgtgaagtgcaccttctatttatttttaccacaaacaagaaaaaaaactaccaatataacaaatgttaaacacttttgaaaaaatcaattttttctcaaattttcattatgatattatattaacccagaatatgttagggcaataaaataaatgagaaaaacgtctggattttggtatatgcctgtatgcttaataagagaacctacagggtaggatatagagacatagtaagaaaataccttttattctctctctactaggccctatccctggaatagctgtagacttttttttttcaaatgggattgttttacgaacagtgaaatagactcagttcagtatcttatatctgcatttgacacacagaaagaaaaatggttatcaaaaaattacaatggaatgaccctcattgctaataaggaaagacttaaaagctatattaggaaacagaaatggctgagactgacctctttctccctaaaaagcttattcaagttctttttaaataaacctgtagggttgaatagctgatataactgattatcatttcgtactcgtcccagctgaagtgctctataaaacagatcatgagacgaagcttccttcactgctaatagcttattgggaagtacaattccagggaagtgaaagtgaaggaaaagggaagtgatacaaggagaagtaggaaaaaatttcagctactgtctttaggaatacaactacagaatttacataatctttttaaatttcctgttttgaaccatattgtatttagatacctagtaatactttctgtaaggaaattatctttattcaattctatgacttataactttaattttaaatatatttaaaatgacacataataaaggcaaaaattgctttccaaaccacactcttctagaatcatctagggcccttgttaaaaatgcaggtttgtagggccttgtgagtgtcttgttaagtatgttccttggaaaccactgcccgacatcaccaattgtttgtaaaccctgtggtataatttaatatagagtataccaatgtacttgctgtcagtgtgaataattttttttaaaaaagatatgctcattttgaagtccatcaaatgttggcaaatgttgagggttatctgaagacactgggaagtaatccatggtgatcgttaaaatagcaaggtttcatcaattatctggtatctatgctttgtcaaagttagaaatgtagagatacatttctaaattaaaacttttatgtgggaagaaaaattgaaattcaaggctggttggtctttggtatacccaaagaacaaagaggaggttggaggtgttctgaaaaagagaaatgatacacgctgctctttgagaaagttcattggcactagaaaggttctggggagctagtaagcttcaattggtgagtgacagtggtgggcaaaattagtcctagagctgcagcaagttttttcagcagttacagaaaaaattggtcccaggttacaacaggcagcctcagcatgcggacttgtagaaaattacacttttggagcaatgtgatgtttcttgaatgcttttcctcccaggcttcttgattgttttagttgggtataacaagaatgacccaatttgtgtgatcaactttcacagccttaaacattcaaagcagcagaagcgcactttctcttttgcccactgcttttacacttgaagatattttgggtagaaccattgttttgctgcattattgaacaatgtcacttagcctcaaataatggaattaataccttcactcaacaactcacaccaggaggatgaaggagagagatagtagccaaaaagataaaagaagaaactaaaaaagaactttgacttaagaggaaaaaaaggttcaacttaagcacacacccgtgttccaaaatgaaatcaagcccagaactcgtatttaaataaaaatagcatagacgtttcaaaaatgtgaatattctctacttctctacctcagacaggggagtgtgtacatagtgtagatagtatatttcactaagagaattaccatgtattttattgatgcacttaaaaatgaaggcgatagacatgaataccttgttaaaaagcaaggtaaagatatatttcatatgttcaattttctattatcaattcctagtctgctcataatgccattttggggtggggagcaaagggcatctgattcaaaatcaaactaatctcaatttttgataaaatctaaggaattttatttttaaaacattgaattaaagcaaactttggatactctgatttctcttgaggtcataaatcctctgcctttttaagagatctatgtggagaggaacaactctgggtcttaaacgaattattgaggtcttgttttggaaaggctagatattttgttaaaaaatataagatttcaaaaaacctaaaactttggacaatgttatttaatcatcaaaagcaaaacaatatgcatatttcagaaataacactatattttcagtcttactattatgcataagaaagaacaatataaaaataatgtaatgattacatttattgtttacatactctgaggagtatttaattgcatcctagtaagtatattctgtcacatgagaagccatagaaattggcatgttctgctgtatccaatgcccaaaggataataaagcatgataaaattacacttaacgaacccaacctccttttccaattatatatggttaagttaaaattcaaactttaatttttgggaaagtatagttatggcttagatctaaggtagaaataaaatgaccaaaggacttggtgcatttaacattctataactttagaaatgcatcaaagtggcaagcccagcattaagagctatttgtcactaagggcctgtggttgaagtctgttggatccatctgttctttctgaggcaatatgcagacgaaaggtaaggggagttgcaacataatttgtaatatttgatacattataatacatgataaattataatatattagaaatataatttatagcattacatctagtaagatagatgtaaaagggaacaggtaagtgaaagggcaaggcataagtcttgtatagagtgacaggtctggtacagtcctactaccaaatctataactatagtattttgaatattttgcactatttcaatgtagcagtattttaggtttggttggcctgactttacaacaagataaaaaattccaagttttaacaatgtagtgacctactgtgttttagatgttgaaatctataattttctatcaacattttctactaacctgtaaaagacatgccttagaatgtgggaacacacacaaacacatacatactcacagacacatacacacgaagtacagtagaccactgatgatctctggtgccacttcctgagatcattttgaatgttctaattaaaaagtgcaaagtataattttttgtcataaattatacatgctatgctattatatatgctaagccaaacctagcaacaaggctgagtgaagatgtggctcctgggtcatatgctaggctttctttcggcaaatggacttgctctccctcagttatgttacatacctactcagatcaggtctcagcaaatgtacaaattactatgtcatcagccatctggatcacttgggaatagtcacattggtgaacgctgtaagtcatatcttaaatacattatacataatccatacctacagattgagaatgcaaatctattttaattaaatgatacctttagagaacccagtcttacacataaataacatatatttagaagccatttatgctctactttgtttatcttttgtttagaggcagggtcttgccctattgcccaggctgtaatgcagtgatacaatcatagctcactgtagtctccaactcctgggcccaagtgatcctccagcctcagcctcccaaatagctgggactataggcttacaccaccatgctcggctatttaaattttttttttttatagagatgaagtttcattatgttgcccaggctggtctcaaactcctggactcaagtgatcctcctgcgtcagcctccgaaagtgctgggattacaggcatgagccactgcacctgagccgtgctctactttggataatctgttactatcttactgattttcttgtcttttgcccttctagctgtttctttagtcttggcaatcaccttagagagagagaaaaagagaaaagatgaaataaaaacaatttatttcagtttttaaaggtttggcagtggaggagagagtaaagctaatatattaaatatatttggggttattttggggagctatttactagttttatctctgaattcaggtttaaatacattcaaccataaattaaaaaataattggtggataaatcaggaattggtgcaaaatcatttttaagaagaaaatgtcattatatagcaaagaggtagtatgctgctttaaatccttattttccttggcaagcctaacaagcagggcagtgcctgctgtatttatggtagtgccatataattagctgactcacctaataagacttcacagcgcagcaacaactgccagctttttttgtcctgttacttggatagactcggttgaatatactaatgcacaaagggaaatctgggaataaactatttttacttttcatgtctaagggctgatcctcctcttctagaaataaaatttattatgtatgttaaactatattcaaatttgtttactattttaagctttcatggattagaatcttgaaggtcagccccttgggtagtgactgaataagacattaacgatgtgaagatgggtcaagctgagaaaggtttgctcttgtgctgagctcagaatcaataagtcatttcatgtttgcaaatacaatgatatttggaggcaggtctttttttttttttttttttttttttttttttgagacagagtctcgctctgtcgcccaggctggagtgcagtggcgcgatctcagctcactgcaagctctgcctcacgggatcacgccattctcctgcttcagcctcccgagtagctgggactacaggcgctcaccaccacgcctggctaatttttttgtaattttagtagagacagggtttcactgtgttagccaggatggtctcgatctcctgacctcgtgatccacctaccttggcctcccaaagtgctgggattacaggcgtgagccactgcgcccggccagaggcaggtcttaaaactagcaactgggtgagaaatcagtggggagggtaggctttgacaaagtaagagataaagagtctgctttcatattttagaaaaacccagggaatgctgaaaagcccataggaaagaagaaatatgctgtcaagatgttagtgagccaaggcccaggagtttgctctcaaaaacagatgagaaactggacttaaaatctgactgggagaaagtactttaggcaaaacaaactactcatatacaaaaggatgggctctgaagcagagagtgaaggcaatagcttcaagatcggtggatttaaaacctagaagtatcttctctaaaagataaaagattaagaaaggctttaagatagctagagcaggaataaagtagtcaagtgaatgtgataccacaaggttccagaagtttccatactaatagaaacagatactaagtgaagtttgaggggccctcacaatctggatagaaaactcttcaagtagatctcaaccttcaggctggaatatctttgcttagctatcccagccagaggaccatagtggttgatttcaaaaggagttgcaattattctatcttgtaaattctctcattgttaagttttgtcacagtttgttgttgctactttctttcagttacctagaaaatgttttctctgaaaacctctatccatgcctcaacagatcggagataaaaaaggaatcatcttacaagattatcaagaaagataatgggctaggtgtatccttaaaaggtcattcaaatgaaatattaaaattcttacttttctgtgttattcggacatggaataacaataacagttaatgtttatttggtgcttactctgtatttggtaccatttcaagagttttatatgcattatttgatcttaaaaaacaactctttgaggaagttactactgtctccattttatcagtgaatgaacagagataggaagtctggctccaaagcccacactcttaactattatgcaatattagttgtcaaatgtcttgaaaaaaaaatctgtgtaattactaaaatattacgctgggctacttattaaggtaaaattacgtttcaaaaaaattaatcctttccaaatgcaatgttaactattcatgatgaaatatcagaactatctctaataccaatatttttattggaataaaataggaggttaaaggaaatgtttatatatataaatgtgtgtatatatatgtatatacatatatatatactatgcacacacacacatacatatctatgtgtatatatatgattttttgcaagggcaaaaaccagattttttttaaacacataatcattaaatctgcaaatatcaagtttatcaattttttgttacaggaaaaaatagtttattataaattcaatgcatagcattttctggtttagacctttccattattgttctgacagaacaaagactatgaggttgtcagaaataaattgttcattttgtttcctaaatatgtggcaaagacattgtatgttttttgtttgtttgcttgtttgtttgttttagaatagtttgaaatgtcttcaaaccttttgaccaaccaagaaagcttttgcctgggcacaggctttatctttcttagcattacactagagatactaatccctcccaacaatttcattatgattatcgcaataaaatataacgatccattaagtccatggggcagatgtttatttatttataaccatgccttattccacagagaatttaaagaggaataaaagattatttcctcattgcatcaaatgaatatcttttattttgtctaatgttgtatttctttttctttaattggcactaaatgtttatttgcattcttttaattacttttaaggcatccattatttctggattacattactgaactctcaataaatcaatacatagttctgtatataattttttcaacattttttccttctttaatttggttcatttgtatctccctttgctgtttattgagtagaaattctgatttttgtagcaaagggagaacaaacaaacaacacacagaatattctgtatttaatgctgcaattgtctctatggttgcaatgtgtaggtggggtgcattcaagtgggcttgtggtatttgtgtgtgtgtgtgtgtgtatgtgtgtgtgtgtgttggaagaatatatattgaggatgattcctaattttatcactttgttgaggaactgaaattgtggctacacattcactctaaatattttgtctcacagtcccctcccttcaacaattatatacagtacactatttgttggaagctcaggagaaaaagggcatttaagagcatgagatttggtggcagactgacctaatagtagatggtaccagtgagatcttgagcaacgtaaatgtttcaactgaaaaacggtaacaataaaacatttttcagagtgatgttgtactaaatgaaatgatatacataaagtagcctataatgacccatgcacagtcataatatcaaatatttactgagcatctactatgtgctagattattttaagcacttttgaaaatataagtattttgataaatgtatatcatatattgtcttaataagattatattgttgttatatttcatcttattgctaattttatttttttaagaaaacctttttttggaaagaatcgaaactaaaaacccaactatttaaaaaatggaaacttttggccgggaacggaggctcacacctataatctcagcactttgggaggccgaatgggcggatcacaaggtcaagagattgagaccatcctggccaacgtggtgaaactccgtctctactaaaaatacaaaagttagctgggcatggtggcacatgcctgtagtcccagctactcgggaggctgaggcagaagaatcgctggaacccaggaggcggaggttgcagtgagccgagacagcaccactgcactccagactggcgacagagtgagactccatctaaaaaaaaaaaaaaggaaccttttgccttacttcgtttgctagctacattcaagtctgcaattaagctcggtgttttgcctttctcaaactgtgcacaggtcctcttgtttgttccccttctctctgttgcctaggaatacagccaaaaacttgagtaatagatgatagatgggtctgtcactaagcacatcctagtgacatagataagaagcaaatgctacaaaattataggtgcaaactacaagttgtgttttaattggttttaacaagtacttataagcagaagaactgtgaaaaatctaacattttgtcctacttgcaagcctgccagtcttttgagtgctgggcaaagacacaatagtgctgggtcagagacaattaactttactactcacattaatagcattagcaagagtatcatgattttcttgcactgattcctcaagccgcaattcccacagaaaagctcaggtgacacctacatgctcagtgggttgcattagaaaagaggaacgcagagctcaggaaacatggatattttataatggccagtaaagatgtccctttgctttagaaagaggcactacctctatccaaggctgcaagcacacctgccttttgttttagaaggagaaatgatttctatcttccaaggctgttcactatatgaaaagacagtcccaaacaaaaggcagttactgacttgcttgaaaaatgtgcagaaatgatacgctgcttgaatgtggacagctgacacagggacaaggagtaaaaatgattaggttttgagcttgaccaactaggaagataattattagcagtagagaaaaaaagaacaaagtagattttagggcagataagccattttttaggtaggttgagtctgagatgcctccataaatataagttgaaaatatgagattggagttgagacttcagaaatacatattttgagtagttacactacagaggtaagtcatcagagttcataaaattaaagtgagaaaaagaggcaagtgaagaaaaacaagatggcattgcatgaagaactttcttaggaaggaaggcagcaaagaggtaaaattggaggtgtagtcagagatggaagatgaaaaaggaaaataacaatatttcagaaatgaaatgaaaaaggtcttttactaagtaattggtactactacttgtcagtttcaagtgctgtaaaaaaaatgggaagaaccacacatgtgcactttcagtactatgtattttatgcttcagggatgcatacctgtttaacaaaagtatgttttttctcaaagtgtgttgaatagtccagaaaaagatggaggtagaagtcagacttcaggagataaaggaaccagaaagatcattgaaggctgtgatggtagaaaacattttgacaaagagttgtgcaatgagaaagctaggggtgggacaattaattttgagggtaacaattggggatttgagtagattttttgcttctgttctttaattgttttgtcttctttttaaagaaaccaagagactgttaatgtagtaggagcagagtttcacaatacagagcagagagggtgttggttgataaagaattgtctcaaatgagaggaaaagaatggagccaataacagagatgatgtttaatttgggaaaggtgggacatgttaacatgagtccagagaactaaaatgagcttatggcatgcagatgctgaagatgaagaaaggaaaggaaggaaaaggaggaatttatatttatttattgaataatcttgtaaaactgttaatcacccctttttactgacgataagacataaatgtcagaggtgttttgcctaaagtaaaaaattcgatagtcaagctgggtttaaaaccatatcagtcttacgtcaaagcatgttttaattgctgttgtgtggttgtgattttaagggaagaagaagagttttataatgggttctctgaaaaataaaatatcaattagaaagaaacaaaacaactgctgagaagcagtgaatccaagcagaatctgagtatcatcactttttagttaaactaaccagtccaatatcctgatttttctttaacaggcaaagaatttttgagtctttcccatagactgagttcttgtgaactattttacagcaataatggcatccaatcctatagataacaataacaaagctgcagaccattttgttgccaggtttctcctccagggtggctttccagctagtttgtaaacaaataactcaggtggccctgtcatgttacattaactaaaaaccaagtctaaagcacacatataataacatatgtgtgtgcaaactggcttgctttcaaattcctaaatcatacaattaaattttaaaaataactgtatttggaaacaagaaaaaagtcactttgacacccaactgatgtatataaaggagactgtgcatatgggttttaaaatgagatgaaaattgaaatttgatctttgagattaaaaacaatgttatgtaaatctatttttatttaatttttctgaaaaatattgtatttgctttataccctcttgctatacaaacttatattgttttgcttaccctctttttttattcctcctactttttcttaattttgatatctctgaatttaaagtctagagaatgattcatcttcactagttctatcttttccagtgctagtatttttgtttttgagctgtggtttccctatcccatttttgagatctcaaactataatttggtgtcgagtacccaggtatcttatctttaaagtgaagacgtaggcagcacaaaggtgcttttattagaacgtccactagatcagaatgaccagtgcacaaaatttattttcctagcagactcaccaaatttaacctggaagagaatgtctgactctgttgaattttcttaggcaaatacaatatttgaaagtcactgaatgtttcaaacaaaatataacaacattcagataacagaactgtgttattgttctcatgtgtttatgcccagaaaataagcagactggagcttctctaagattaaaagtcaaaacagtattacaattccagcccagatttgactatctaatcatttaaaccttagtatcatcatcatcaccaccgtcactgcatactcattaagttaaaaaaaattcctttaaaataaatggaaaagaaaatatctgtgtaaatagattaaagcgattcctgctcaccactccctttctccctggggcaggagacttgagcacatcaaaggaactcatagcgttcttggagtaagtgtgaaagccaccgtgatgaactaaatgaatgcttacatctaaagaaagatgtaaacatattacattaaaaggtggcatgacataatggtatatcactgattaagaaatgtgaggcgactttcatgtgccactgataaatcattataatttgacatagtagataatgcccctatatttcatctgcatacctggaaaatgaggactttcaaaacatattcctgccagttacagtcaggtattgcaaaacaagcatttagtgagcatctaaactgaagcttagaacttcagttttgtggcggggcgcggtggctcacgcctgtaatcccagcaccttgggaggccaagacaggcggatcacttgaggtcaggagtttgggaccagcctggcccacatggtgaaaccccatctctactaaaaatacaaaaattagccaggcatggttgcacgcacctgtagtcccagttactcaggtggctgaggcagaagaatcgcttgaacctgggtggtggagattgcagtgagctgagatcctgccactgcactccagcctgggcaagagagtgagactccatctcaaaaaaataaagaactccaattttattttcttcatggcatagcataatagatgagttaacaaattaatgaaacagattgacatgtgttaattgcaatcatatacagaacagaaatcatttccataaaatatttaacctgcctgttacttcccctaaatctctctgtagctgatgccccaatttcactattagctcttcagacttggatgttaagcactgtgccttcccctggacctctctttaaatgtcacagctatttctggcaggtaagactattgctttggttagtgtgaacacacaccactgtggatcacaaggcacctgagagaaaaggctgccgaaagcaggaaaataactcagaaaaaagaaaaaaaaacacatggtgctgaaaaatacaacagatatgcatttgtatacttatgatctaatttatgtcagtcattaaaagaaaataaggtgtttagaaaatacagtgctgtctatggttatatttaatattgtgaccacttaatacaaagcaaagcattcttgcttgctctcatggagagtgcaatttagaattgagagctcaatttctaaggagggtttatgtactctatcttgaggcacaccaaggagattgagtttaccagtttagaaagcactgccataattcaagtcagggagagggctgatggaagatttttaaaagattttaaaagatcatgagggcaagctggcttttaacaaaacaaaatatttccatgtggcttctggctgactgaattaataaggcccagagactgatctgaaggcaaaagcctttattttttattgcaatggagaaaaactgaacattatttgactatcagttgtgaagtttagtaaaaagattttcactaatgggtggttttaatatttatgaatgtgatggttcagcaaattttctccaatgttttgcaagaccactaattaataatcatctttacaaatggaacatgtaattgtctgctactattttttctttgccaatgcttaatacttattttgaatacgttttattttttttctaaatttctctatttatttctacctgagcatttcttaatttttttattcagtcctgttattctcactgtaggatttttaaaagctggtatattatattaaaatccttcaactgtgaattcagcaatgttttgagttccagggattcatctggcattaggctgaccttgtcaagcataaacatcaacattaaagaaaatatttaagaaatgaaaggcctgaatcaaaataagaggtcaaattttccagggtgttttgtgtcttgaaaatctttctgctgtaattacctaaagactgtggttagataattattgagggacttttgcaattgtcccttttctctatatagatcaccacattaattaaacgagagtctcactgggaacaggttgctgttctgcatctttaagtatttttagtactttattttcaaaagagaaaaagaaccactaagaagaagattgcttctcagccaaattttctgatatacagatattctcaaaagacaagcacacacacacacgcacacacacacacacacacacacacacacaccccccaaggctctggaatgtgccttaacaatcttatttttgcacattttaaaaggaggtcattatgaaatttgcacatattttatgacctgtaatgtacttctctgatctgatttcacttgagctaataaaaaaatacaaatcaggtgcttgctgtgatcaagatgctaaagttatatttacactgcttcataaatgtaaggtgttaaagcttagtgagacaagaagtaaactgataattgattaaccagggtgctatacaaatctacctagagggtgccttcccaggttaatgcaattatgggagaaagatcctggctcctggctacagaaatgccaactaaagtgttatccaccccatccttcactttggaggatgcgttaagatgacactgtgctgtgtcaaaatgaaaatacaaacaaaagcaaataaaccgagtgataataaataaaccgagtgactcagtttccttatccattttccagttacctttttttttttaggccagtctgcatgtccactagaagaaaagggacctgggttcttcatcagcccatccttagatcttagtgcacatatgcacctagtaagtgccgagcaaatattcaatgaatgactgtacctttcctaagaattcttcgttgattatccttcaacagagctaacttctctccctatgtgctcagtcaaatgctctcccattggactgagttcagcataaactgccatgttttgagatgattggtgtaagcgaatgtcctctcctgagttgcgagaatctaagagcaggacaacatcacatgcttctctactttctatagttcttttgtccactgtctaacaaataatgccaagtgaaaaagggaaaaatgaatgaataaattttgtaagatgccaatggaaaaaaacagaaaatcaagagttactaaaaaaaaccactaactccatttaattgttttagactaagaatccctcagtgatacctagccaaaattaggattcagatccaaaataaaagatactgttgccccaagtagatatcataatttgttacaataagtaaaaatgtatattattcaatactaaactgttataccacatttcaagtttttaaaactttatcttccttttatgcatagatagtagtagagcattaagaacatgcatggctatcacctgaggtgttgattgtaaattcacattcctaggctttgtctcttaactactgaatcggaatctttgggagtgaactgacaggaatctgaattttaaaaataaggtcttcaggtgattctcatgcatctaaagataactgctttaatatataacaaagaaacccaaagagggacacttgaggattttttcaatatatcttcttttgcagagattaatagtgaatgttgttttatctgctgtttagaattttacatatgcattggatgatacatcttcttttactgacaaaaaggcttttctctggagaaaataaaaaggcagctttccctgagagcacacacttctagcaaagccccaatccatatgactctaagacagagtgatttccaccttctagtccttactttcttgcaaaaggggctttcaaatctcattactgatggtcccatcttttattactggtgttatcaatgggatgcttgcagcagcttaagtatgtggataaagaaggaatgcacaatatacggtactgaatatttttaaaaagtggtctttcagaatgtctgtatgtgtgggggcccatgcttaggcatatgtgcatgccagtgtgttatttatgttgaaaccaatgttttacattaatggctggaattccagaaaaataagaaaatatttgtattttctaaaccattaaaagtttagtggaactcattaatagtctgtatcatctctctgtatatttcagaagtacattttaagtgtaacagctaggggtaaactttcataactgtatgatttgaacacaagtacaagaaatattcaaggttttcttttcttttttttttttagatgaagtctcactcttatcgccgtagctatagtgcaatggcgctgtctcagctcactgcaacctccgcctcctaggttaaagcaattctcctgcctcagcctccgtagtagctgggattacaggatcctgccaccacacccactaatttttgtatttttggtagagaatgggtttcaccatgttggacaggctggtcatgaactcctgacctcagtcgatccacccgccttggcctcccaaagtgctggattacaggtgtccaccgcgcctggccaatattcaagtttacacaggaaaaagaatactttctctgcataacctttacttatttactcataagcctctagttctctctggatttgactgtaaatctcaacacatttcccagaaactaacatcttctggctgacttctattaaaaattcagacaaagaaaaaaactgaatacaatggagagagattataatactgctattctcccattctctctctctacagcatatcacctcctccaaaatcagttcatatctaactcctagcacatttttagttaaaaatatacatgcacaaaatatatgtgtaaatacacatgctgatatcacacatatgtgtgtgtgtgtgtgtatatatatatacacaaaagcagatatatatatatatatatatatacacaaaagcagatatatatatatgctttcttgcaggtgatagaatgcttttttggaggtggttttgtgggcctatgtaatgtctctattgttatattttaaaagtttcttttttgtttgtttgtttgtttgagatggagtctccctctgtagcccaggctggagtgcagtggcaggatctcggctcactgcaacctctgcctcccgggttcaagtgactctcgtgcctcagcctccagagtagccaggattacaggcgcatgccaccacatcccacttttttttttttttgtatttttagtagagacaaggtttcaccatgttggccagggtggtctcaaactactgatctcaagtaattggccagccttggcgtcccaaagtgcaagactgcaggcttgagccaccacgctccaccaaaagtttcttagcactcattctcatgagaaaaattgctgaaaacttggcaataaagaaacagaatgactacatgtcctttaaatgttatttttaaggggctcaatcaatgactatgaagttatctaagataaaacaccagattttgacattgccattaacttttttattagagcccccagatctacaggttatatgtgcagatgtgcagtggctgctttatttcccttttcaagagcttttcttatacagcatctatccactctcctatagagatgaagttaactcccttgacaactatcacttgtccccaatccccacccttccacttgacatacaaacccaaagagattcatgctcatttatgctcagtagaaaacataattccataggttactgctattattaatcaaatatttactagatttatatctattagtcaattctctttagaatttctttgactgtttctataaatctttattcctcagatattcctttaaaccagtcttaccagcttattggctccactactaattaattagttgaataaaatctttgaaatgtgtttatgtttgtataaaaaccatcttctttacttttcaaaaactatacttgagcacactgtgaaaagataaattgctaggttcaactgaggaactgaataattttttcctcttttagttttaacattctacacaatctaaattattttaaaactcagaaaatgctttaagctcatatttatagacttcccaagtagtacaatctgttaactgaggtaggtaagtaaacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggtcaaaagaacagcaaggacaatgtctatccacccaatctggtggcctccgaaggacaaaagccagagttaatctaaagcaatcaaggagtctgaccaccatggaagccctgaggaagtggctgctgtatttcccttttcaagagcttttcgtatacagcgtctatccactctcctatagagatgaagttaactccctagacaactatcacctgtccccaatccccacccctccacttgacatacaaacccaaagagattaattaacatttgttccaggaagagacacagacaaaaacatccgatattggaatattccttcgtgaataaatataaaacttatggagagggaggaagatattttgaaaggaaaaaaatcattggactttattgctcaaagccaaaagaaattgttttttgtggcaaaagtaaaacaaggtaattttgtactgtgtgctgtatttctggcaattatctgttatcttaagaggcttatatagaaagaacaattgtacctactttcacagcatgctctgaggatctaaggaccctcaacaaatagttttcatgctacaagcaggcacttatttaggcacaaataggatgggattctttttttaactgtagtataaataattttatataatacagttatataggcttttttaaacaaaatacagtcagattttaaatctctctattctaagatagacacttcacaatttaaattcaagactccttgtttcttgaagacatctatgaaagcaaatgtttttgagaacttggctgaatctgagtccattccgattagcagattccacattcacttttgagccatgacttagaagctatcaagacattatgtagcaacctttttctcagtattccaggaaaataaaaatgtgcatgcattaactcaataggtattcagatgtttcccattagtaagttgtgaccatgcaataaaaaccatgctcaccaatattccccaataaacttcaagatttgtaagctcatgcatacccacatttatgttaaaatttgaaataatgaaatatttttgcattgtgaaaaatagatatatatgcattttgtgaccaaaaccatcaccacagttccattgctgttgttgttcttcttcttattattattattattatttttggtttgtttgtatctggcacatttggggttataaatcacaaataacataaataagataatgttaatctccttcttacaaaatccaatggcttcccacaagtctatatataatatgcaaatttcttactatagcttataagatctggaataatttttcctatctccagccttcacctcttctcacattcatcatattctagctaatcaggactcttttatgtcataaaatatgctagatttgcacacccttaaagccttcatatacgagtttgttctgccttggatacctctgttccacattcccgaacattctctctctcatcacacagctggaccctttcaccctcctgatctcaattgaaatgtgaccttcctgtataaactttccatgagctggcttgtctgactgaacccaaatggctaatggattttctttcccgttacatgctctctaatttatgatgctttgcttggggggaaaatgagaggtgggagtctgtttacggaacatggaagtccttttgcagaggtacaagagtggaaatggctgttccccagcctggctctctgagtcagacctgacatccacagagagagcactgcagtaactgcaaacgcttctgttttgattgtggtaattggaacaatcagggcacaaactgcaaggtcactggcaagggtagcagcaggcatgattcctcccttagtaattttaaagcagcagatttcaaaagggaaaaccaagcagatgaaagtgagcagatttgttcttcagcacatgtgagatacccttggagatgccaataaatcactggagagactgtgaaggaggcttaggccctgcagatgaagttagtgatggagggaaatcgtgtttatcctcgggctgtcaggtctgaaatacctgggttaagtaaatggcctctgggatggtcacagtcggcaattattagcagttacagatccatctctatgccaaaacagataacagcatccaggaattatccaaagtcacaaatcagtgtcagtgtcttgtcactcacccacgtagtgcttttcccttcctcctagttacttaatggataagggcacattgtcaaataaacaaacaagtgaggataaatgttgctccgaaatttaaggtgaatcattagtcagacttggtatcgtcatggaatttggtctgttttctaactagctttattttagcacagccataaatctggctgtaattgtctttaactccgatgactcatacatctaagcatttcatttaactttcaaccgtgaaaaattccaactgatttggcaatatgaatgtgctcttacatgcatatgatcatatgatgctgtcagtacaacatctgtttttgttcttgggatgttgatggactatcatgaaccatcttataactttcccagtcccctttaagtccaagaggatacaactgagaaggcaggtagagtttttggtcagtggctaggtttttcctgaatatcaaacaaattgcctggtatgagaatttaacagaatatgaccacaatttttttaacagatttatctacttgaaacatcgcctcagtcaatgaagaaacttatgttctataactaataataaaagatcatttgtaactgaaatatgacaaattgctgttttaatcatgaggattaccatttagaacagctaggtaaacatttactttttaatccggaaataagttaaagcaaataataaaaatttatatttaaatcacacaacatgttttatcatgaataataaatgtttttaaagtttaaaaatgtacttgttaccttgtgggtattcctgaacatgattaggatttttatttctccaagtatttttattcactcacagaatcaaaatgtcaaggctatataagttttcatcaagtgctaatttagcatctaagtttttattaattaatttgtaaaggaaataataatgagagtcaaaggaagaagcatctcctgtggtgagctccatttccagattccaacgaaaccattaaaatatttatggcactgaggctgaatcagacgggtcttgtgtactctcttgtgtggccatattgtgtagcaacagtgggtttcgaataataagattcagtcatccatttagactccaattggagctcaggcaacttcaatttgtgattataatgattaacttcaaaaagatgcactatttgtagacctatgttgaaacttatgcagtggaactaaaaagccacctatttttataataaaaaggcacaaatacgcaaatgcaaaagaaattcattggaaaatcttgaacgtttcaaatataattatcacaaatgcaaatataaaataacaatatgtttgttaatattatactttcatttaatcagttcttctaagtaaggcaaatatatgaattttttaatatacaaaaatacccccccaaaactccattaagtatatctatatgaccattgggtaagattttttatgattattagtatgggaaaattgtgactgtttagatatattaaatatattaagtaatatatttaatgatttaagattgttaaataatttatattaaaattgaaacctcattttgccagtattaaaaatttcaaaatttaaatacatatgacaccaatgcatacaatgttactttgtcctgaacataagttttaaaagaatttaagtttaaatattctcctaaatgctttgtgagacttaagataaaaaacagttcctcagaactcctgacaaaggggggcagtaaagaagcaaaaagatttttatggagttcagggaaagctgaaaggcctttgtgtacattccctattttctaaacagtaaatgatggattgcattttaggcagactacaaaattgctaaaattaaatgttgggatggaaatgtggaatgcagagtttgcaacccccttttaatttaatattttcaaagaattaagagaaattattatattttattttataaaatattatatttaaaattactcaattctaaatgaatgttattgcaaacctaggcttataagaagaatgcatttagaagccctagataacatacaatataaaaataatatttgcaaattatgcatttgttttcttttctttctttttttttttttttttgagatggagtttcgctcatgttgcctaggctagaatacagtggcacaatctcggctcactgcaaccaccgcctcctgggttcaaacgattcttctgcctcagcctccccagtagttgggattacaggtatgtgccaccatgcccggctaattttgtatttttagtagagatggagtttctccatgttggtcaagctggtcttgaactcccgacctcaggtgatccacccgccttggcctcccaaagtgctgggattacaggcctgagccaccgcgcctggcctgttttcattttaagtgtagttgtctagcattttcaatacattcccccccgtttgacaaattttatcttgccatttagctaatgggcaagcaaaaaattaagtggaataattggacagaacaattatctggtaacctaaacaatggtaacatgagataggtattttatgcattgtttggacttataaactatctagtgttctaataatagacataatggtttattcaactaatagctactgtcatccttagaggttattaacaactcaaagtagtgaattacatccaactaaagggtgcttttgtatagacatttgttcttattgctggtcacttattcttcaaatatcttttaggcaccatttacaaagatgaccagaggtacaaaatctgcatatataatagaaagagccaggtagtcattcaataaaagaaggtatatagtaccaggaaaagatttttatcttagcctaaggcagtctgaattctcaagcccaaagcacataaatttgttggaattatttcaatttctagtcactaaaaatgtgacgcacatttacaccagtggttcggttgattacttctcttcagccctagtctcttaagcacaggtatacacacttacagcaatatctctgcatacaatatttttgacagaatgaaaaagttaaaaatattgatgtttatttcagcgattctgaaatggtttataaaaattctatgactataagaaattcatgaggaatgcaatatatcaggaaagaacaatgtcatctttacataaaaaggatgcgtgtcagtaatttgagaggctggaatctagtgacaaatgtgtcactttttaaggtgtgcttgattcacagctgacagctttgatttgaaattgcctttaaaacaatgtctatgtatcagtgcaatgaattctaaccaaaagcttgttggagctaaccacagtacctatatattcaagatgttcatgggaggaatggaagatttgatatttaggcactgaagggttgctatgatagttattatacacaattgagtttaaaatgaatatatgtgtcagttctattattaaatgttataaaatatgagggaataataaatgctatgtaatttataaactacaagaaaatttatatcaggaaactgcttatttcctaatatatgcactgtcttcagtgtctccaaaactgtcaactctgccaatgtgactagcagatgatgagcaggcagtccgtgtgatattatcaattacatagtcagaaatctgagtctttctttcaccttatgagctgtttaggaagaaggtgtatatgtgtgtaacagggagcaagaggagattaacttgtaagccattatctgatgcaaaggcagacatttactaagtcatctgtgaagagatggttcgataatagctaagcattcatataaatcttcagggactcgaattctctcaagtgtgacagaatactcctctcaactgccagcgctcctgttgtaaaaaatcacatttggcaaagggctctggtgttttgagttctgctcagtgacaggtttgttttaagtaagattaatactgaggacaataaaatgaccttcaattaagactccttttaaattttgtctacctgatttccactatggttcgtgtctagctgtactctatctaagaatgatctttaaaacattcaggattatgagagagatatctaggaagtcataggaaataaccactattcaatgctgttctgtacaccattagtaaaccataagagaggacaaacatttatccaagaaagagactattacatagccaccaggacccaatatggattcagcacaattgagcaatacatgtaacagatttgtggtgaaaaacaggtgctgctcaattgcttagtctaaaattctccctcaattccttcccatcacctaatttgtttgacatctagtctttttacattataatatagtatattaaaaagttcttattatggtttttttttttgagatggggtctcgctctgtcgttcaggctggagagtaggctcagtgcaaactctgcctcctgggttcatgccattctcctgcctcagcctcccgagtagctgggactacaggatcccgccaccacgtctgggccaattttttgtatttttagtaaagactgggtttcatggtgttagctaggatggtctcgatctcctgacctcatgatttgcccaccttggcctcccaaaatgctgagattacaggtgtgagccaccgcgcctggcccttattatagaatttttgggcatacattgcacatttttctaattgtgcttcaataataccaaacaagtgggcaaatgcttcactgggctacatttgcatccctgagtacaatttcacattggttttggttttgtgaattttggaggaatttattttgagagatgcccctggaaataaataatgctgatgttttggtgtaattttatttattgcattaatggaatatgtaaatacaatctatcagcattaggcagaaaatatttaagagatatcaaattcttttgccgagaaaggtagtagtttgccaggaactacaagctttctaactgaacttttaaaaataaattttaatttttaattttgatagatcatcatagttgcacatatttaagggctatctgtgatattttcatacaatactgccatgtttactgccactattcacaatagccacgatatggaatcaacctttgttcatcaacagaagaggagacaaacctgactttggtctgtgctggctgcaggttctggagagctgtttgaagtgacaagatggcaaatgaaagggtcagttggttgcctggtggattattcgtcctcataacactttacctagaaattttgccttttctcacaaaaccataataatggacaaacagcatgaacctagatatgcacccccagtcactatcgtaaggtcaagttggtatgagtcacataagtagaggactagaagttttatctgaatagtattgtcatagtggctaggaatgagagtgaaaagtagactagatgtgtgctttgatatggcttggagcaaaaggtcaggtattggggcacttctgaaatgatatctattatttaggaactgggtcaggaaaatctataattacattcctactgtatttacataccattcattcctaagagagctcttccaaaaaaaaaaaaaaagagatgtcagtgcataaaaaataaactccatttctttctcaagcccaaagtacataaatcttgaaattttccagctaaaaaataggcatatgttctagcatcagctttaatttatcccacattcattctctgctacaataaagtgacaaagccattcatattttatgttacatctaattatctgtttttcagttagataaatatgctttatatcctaggtaccatcagaatttcaaagctcagaaaatcactaatgagaatggaaggaattaaccatcatgcaagcagaagcatgcggctaccatgctacattgctcagagttcatgtagcagtttaatcagggtagcagctgtgcaatgagctttgttggaactggagtctcgcatcctaaatgtgaaatatctactgtttgaaagggtgataactttatgccttgcaaagaaaacagtcctcaagtgttattttttaatgaattaaccctttatctttcctcacaccttttctcttctttttttttttttttttgccctcagaagtatttaaaggataatcccatatgataactcacactgcctagcttcagtacaatgtctcatacattgcaggcactcacaaacatttgtttaatgaatgaataagtgaaagtccaatggaaaattacactgttgaatttacaatggttttagaggtacatctctaaatttgttgatttatttaggattgtacattgtcacattttcactgctaaatttcatattattcattaaagaaaggcagtgttggagagttttatagttgacagatgaattatctataacttctaatatactcagacatcatgtttttctagcatgtaacttttaaaatataaactctccaacatttaaagttttaacactttttagtaattttttaagaaatgacagatcaatagtagctttccataaataaaagcctattaatttgtataacataacaaaattcagtgcaacataaattcatatagtactcctacaagaaatctataggagtaaaattatgattataaaaatcaacagacttaaacaaacaaataacagctttcaattaagtttatagataccaaagacattcaacctttaacatcccactgtgtaaaatcaaatgggaaaggataaaaggaccaaagctatggttagtaatataattgattgctgccctacctacaaactaatttgttttaatatctgtgctagaaccagtatgttaccccttttaactttagctaaataatgtttatacaaaccttactatgcagagctatctttaacaagagcatcccattgaggaaaaaagaaaatagaaagatatgaaaattttcacttttttctaataccaacagatatcactttattgatattgcatttctgtatataatgacatagaatatgagcattccctgtagttcagttttactgacagtaacattgcacaaatcattttagggctatgtgctatgcagagacattgtacagttaattggcatcattaagtaacattttgaaatgatgaggtgttcaaatgtagtagttaaaggcttgattggacattgctaaattgggtactagatctctaaagagatggaatttaccccctagtaggctttatcctttttcacttgtctcagatttggaactcatttcttttaggttgaaaattttatgttcatgttggaaacttaaattttaacaattaaaagattacttgaaatgcaatgctacccacggctgcctgtcattttgggagtttcttatagattctttttagggataagaattatgttaaaaccagatgctagaattgctttaatttttattccccagtttctcatttccattttgacaaagaggcccaaaacatgaatagccttttgatctgtttttttctcccatatcagttcccatgagaccagtgacttcattctttctgttattgcaggtttacattttgcagtcatcttttattcttgtatcactatcttcaatcattgtggccaattctttccaggtcattctcaaacctccatatcaaagctatagatcaataactatcagaacaagttaaacattaagataaagttaatcatcttttctttataataataaccaccactgaattgcaattgttatgaggtattatgctaaacactttatcaaatcttatgaaataggggtaatttttattctcatctcacatgagaacttgaggcacataaaaattaaggcattttgccccaggtctcatggctggcaagtggtctgtctgacagtagagagccagcttcaagcactgtactatagggccactgtgtcatgactataaacctttcatggcatggtctatacatttgggctcttcagcttcaaatttatctatcatgcaggcatgacactaggttttcacttgcactggaagtcaactgctggaaaattagtctgtagaaaaccgtaggccacagagttcctgaatgtgttagtaagaggcttagattttattttggatgggctgggaaataattgaagggttgtaacagggaatgtgcagaattgcattgtggagagatctaattggagattgggggaaagatgagcaggccctaaactgtgataatgttggcaagcttgaagggagggacagaatcagaaaatatttgtaagtgacatttctaggcccctgtgatttactggctggaggatgagcaggtgagaggtgtttgttttgaaaaaagtgattttgaagagaggtcagaaaaagattttcatttttttacttcatgtgttcatgagttggggagtcagggtacagaaggaaagacacatgaagccagggactgacacagagaccagacacacagtgggtgcttcatggatagctgttgaatgatttgtgaaaatcagatagcagtggtgagggtttttatgcaagtgaaatacaaatgaacttctcaaggtgccatatctgagttgtggctttgatctggttcctgactttgaattattttgttcctatgaagtacaggactttgtaataaaaatccaccatacacaaaatcccctggacttaagaatatctccacaagttataagaattgaaactgcttagaaggaacaattgcttgtactcagccagtcatcctcagctgcatgagtctcaaaacgggggtggagagtgtctacctcctccagaaaaggtttttagagcgaaatcaaagagactgcctcttctccaccaaaattatttgtcttaagatggggacaagaaacctggcacccaggagtaaggacacagacgtgctctctcattttaagctgaagctgaactgtcttgtcctaaaaacatatgcccagactctagaaaagctctcttagacagactgctaatttctccatttctgtcacttaagaggattttagggacatataactttgagaattccattctgcagctttcagaggtaatacaatccaatactcatagtgggcttatggtgtacccggcacttttccaaacattctacttgttatagcttctttaattgaggtacgtattcttatcattctccatttgggagatttgagagagaggcaaagtatgtgccttaagatgacacagttggtaagtaggaaagcagaactttaacatcagcagtaaaaccctgagactattgttttaatgtgtttaataaatgccccactaagaaaccagagcaaattaaaagtatgctgtgttctattaatttgatacaggcagaagaaatctaaaaacagcaaagaatgatatttaagaagaactctattttaagtagttataggacatatgcttaaactgagtgaactttttatgaacttttcatcagagatttttttttaattgttgtttttctcctgtgtctgtgactgaataaatggcctctgttcactggaatgcttcacatgcttcctctctcagttgtaggtgtgtttatttctattcagacaccaaaggcctatgggtatctgcaaattaacagtttcatttgctattatgttccatcattgtgaagcagcacaggaaattaacatatctgtaaccacgcccttactatataatatgaaagtgtaaattaaaacatgccgtgttcattaaactgagataaaaccacattttgaaaataaagtttagtaagtggatacttagtatcacattggcgatactaagcttatgacttgcttttaatatttggattgcaaataaatttggaagctaatgtatggagtacaataatagcgaaaagcatgggctttgatattagacatggctatgcatccgaatatcttattattggatattcgattcaagaacatatcagaatagtaattatgttgtatttgattcagtggctgagattgaagggcaactaaccaacagaggagaagatattattgattgttctaaagatttatcctccaaagctttcctttaccctatcttgttacatcttttttaaacaatgctaattgtgtcccttgtacatattcttattcaactcctcagcaaacatcttctatgtgaccaacattctgagaggtgctggagatgcagggaagagtaagatgctatgcttgacctgcagtatcttgaagctagttggggcagcaaaccattaagacattcagcagcatagctgttgtctgcagaaacagatggggatccaagggttggaaataatacagaggagagatggattcatttgaagagttctcttgttgcatgcttaatataattaaagtgcctagccactagtagatgacagttttctaattttacacatcatgtaatccccttagtcttgaagatattgatggtgttaatcacttgaatgcagtgacattaataatttcttagataaaaagtatactgtttccaatcataaattccctgcctcccagactctctgtgagcctcatgtgcataagtggagggaaggacctgctgatctaagaatacccctagtgtcaaagaagtaaatggtcaagtaaggttgtcctaagaagccatgttaccccttctgctggtgagcacagagcccaggtataaaattttttttttttttttttgagacagagtctcgctctgtcacccaggctggagtgcagtggtgcaatctcggctcaccgcaacctccacctcccgggttcaagcgattctcctgccttagcctcccgagcagctgggactacaagcacatgacaccacacctggctaattttttgtatttttagtagagatggggtttcaccatgttagccaggatagtctcgatctcctgacctcatgatctgcccgcctcagcctcccaaagtgctgggattacaggtgtgagccaccacgcctggctgcagaatctttacctaggttactgttgtccatgtgggtaacaatcttgacatctgaagtgttcattgaataaaaatttgtattgaatattcttctaacaaaatctgaaaaaagtacagagctatttttgaaatggatgagaatgtatggtaatttagctagttcattgtatgtgtcctgttttcagttatcattgctactgaattatttatctttaggtgtataaattatagtcaagatgcttacaattgatgaaggaagaatgattttaaaacacagagcaaaatgttattttaaatacagaagtctattcttctcctccatgaataactggcattctgtttctattgtatattaggttgaaatatgtgtttttgtcattaccagtgtttccacaggataagactgaaggcacaagcatttaatatttgctgaaagcacttaaacagaaaaaatattggctagtgagattaagaatgaaataaggtagacaaatagctggctgcaaaagagaccttaaaaagtttctcagagcctggccaaaatggcaaaaccccatctctactaagaatacaaaaattagtggggtgtggtaccatgcacctgtaatctcagctactcaagaggctgaggcaggagaattgcttgaacccaggaggcagaggtaggttgcagtgagccaagatcatggcactgtattccagcctgggcaatagagcaagactctgtctcaaaaaaagaaagtttatcagtctattaagaatatacttgatttttacaagaagaatcaattgctttacaaagttatttatctaaaatgtatgaataaaaatgtataactataaacatatctataaaactagtaaagatcaaaagctcaggtatctttaactttctctgcttctactattcacaaaaatatttgctcagagacacagaaactcatcttcaagatttatttttatctgggtggagttacagagttgccttggtaacagcaactatcaccaaattaagtgttaagcacacgtttttaaacatttttaacattttaaaaatgcagatgccaaaggagagcaatgtcaggagagaatgttgtaaactccctttttcccacatctacttgacattacaaggtttgtactactttcagaaattctccagtgtttaaaaaatgcgtctataaacacacatatacacagagcacttcttattgaagtaatcaccttaaaaattatgtaatgcaatgaaaaccacaatggttttcctaccattgactaagaaagcaaaggacctttcttctgaaagtgaggaggacctcttgcctcctgtcatttgtgaatagaactctgtagtcagaaccagagcatttctggcatttggtctagaatcattctgaagggcaagcctggtgctgtgttgctaagcacaaacaatttggtatttggctccaaaaatatgctcgagattagttcttccctcagcaacaggcgctcagccaaataatttttaaccaactctcagagcccagtattgcttgagctactgagatcctatttcaagttattgctatcaagatatggaggagagtgaaatactgacacttgtgagatcccaagacttacactaaatccatacaatttctgtcctgaattaaaaatttttttaaaaaagagatgaaaagtgtgacatttccaaaccacgtaattggtttctttcaccttaaactccaagttagagaagtattttgttgttgtttgttttgttttaaaactagacttggtggaatacagaacataaacattttaaacaaaatattaaacttctagaacagtggatcacttaaaatgaaaactttaagactttccttagactgagttttttattcttaaaaaaaattaaaaggaagttgaattttatttctaaacggtgcaggacaaatgaataaaatacattttgcctctgtcttaaacttagaacagatacgcaatctctttaacagtatgtaaaaattcagtcttttctttctttggtttccaaattacagtgaaatgaaacattttccttttatgtgtaattagtgcagtttaactaagagttatggagcatctttccacctcatggtgtatccatgtagctgaatttcttcagcatttgcttttttaatttgtataaggagtaactgttccatatcttagaaatctttgaaattagaagttgatctaatagcatctctaatgtagtctctccttgaattttaaatataatagatatgacctgttatttaaaagatatagtgtttactggcatataacagttgtgttgagaatttttcattgaataaaatatatttcccttgaaatttttgttttatggtcatatctcataatccacctctgaatcaatgaacacttgtattggtggagaaaacaaagatccttcagacagactttctgtgtggtatgttctttctgtttcttttctaataacattaacttacatttaaaattattataattcactctattttcacaaatcatcaaatcatactcagatatttaaaaataaattttattgtatatatttacagtaaacaacatgctgttataagatgaatgtatatggtgaaaaggttattatagtgacaaaaattaacacatccattgtctatctcacgtagttacccactttttcccctgtggcaagagcagctataatctactcaattagcaaaaatcctgaatacaatacactattactaactatagttgtcatcctgcatgtcagctttttagttcctcctacatatctgctactttgtatccttagatctacatctcccaatctcctccctgccacctcactcatggtaaccagtgtgtggactgtgttttttgtttttttattttgagacagagttttgctcttttgcccaggctggagtgaagtggcgccatctcggctcactgcaacctatgcctcctgagttcaagtgattctcctttctcaactgcctgagtagctgggattacaggcacctgccactatgcccggctaatttttgtacttttagtagaaacaggatttcaccatgttggtcaggctggtcttgaactcctgacctcaggtgattcacccacctcggcttcccaaagggctaggattacaggcgtgagctaccacatccggccggtaaccactgttttattctaactttatatttgaactttttctttttagattccacatataagtgagattatgcaattttgtgtgtggatgtgtgttggacttatttcccacagcttaatatcctccaggtccatgcatgttgtggcaaatgacagggtcttctccttttttaaggctgaataatattccattgtatatacatataccacagtttcttttatccattcatgcaccaacacatacctaggtggtttccatatcttggctactgtaaataatgctgcaatgaatatagcagtgcagatatctttatgaggtgatgattttatttcctttgggtacatccagaggagggattgctgggtcttaggtaattctaattttaatttctttaggaacctccgtactattgtccataatgactgcaccaatctatatttccaccaacaatgtacaagggttcccttttctctacacacttatcaacacttaaactgaacatgtagactttttcttttcattattctctaaacaatatagtataaaaactatttacatagaatttacattgtattgggcattatcagtaatctagagattatttaaagcagcagtccccaacctttctggcaccagggactggttttctggaagaaatgtttccacggacagggatggtgaggggaaggggaatggttttgggatgattcaagcacattacatttatcattagattctcataaggagcgcacaacctagatccctcacatgtgcagttcacaatagggttcgtgctcctatggcaatctaatgccaccactgagctgacaggaggaggagctcagctcttgctgtgcagcctggtatcgaacagcctaacaggctatggaccagtactggtcatggccctggggttggggacccctgattgaaagtatatgagaggatgtgcataggttatatacaaatactaagccattttataacaggggcttaggcatctgcagattttagtacccaagggaggtcctgaaaccaatcccctatggctactgaaggacaactgtgtatcattcttaacagaaaaaaacaaaatctgttttgtaaataaaattttttcattattatttccatttcactctggaatttagttagaaattaagattaacaaaatattaattgactactaaaatgtaccagcactagcagcacataccaaaaactaatacaaatattccaataatattaaataatgactgcatttgtatttcatctgagagtggtttatggttcttccccataagtggctgatttattgatggccactttttcttaactcctggtctttctcacaatcacagaaaacagtcccttatcacacaaataaaaaagtcatctcaccattcctctgtaccttttatcttaacagacttgtgttttgaaatattatttatactattttttaattttttgagaccgggtctttctctgtcacccagtctggagtgcagtgcgcgatcttggctcactgcagccccagcttccgggttcaagcaattctcctgcttcagtttcttgagtagctgggattaccagcgcccatcaccacacccagctaatttctgtatttttagtagagatgggtttcaccatgttggctaggcttgtctctatcccctgtcctcaagtgatccctgcaacttgacctccaaaagtgctgggattataggcatgagccaccatgcctggccttatttatattatattaactctaataatcactatgccactttctgttgtaattctttaggcacttcttctttgtatgtttttaattagcatgtagttatatagttatatatttacgtttagatatacctccaagtagccaatattctacatgaagtgataaaggatttatttatccctgaaattatgaaaagtctgccttgttttttctttcttgcattgtgctacagtacacacatacacggacacacgaatgcacacacatgcacactgggttctgctaattatcatttccttagttccatatcattccccaacccctaagccacctgtgtccataccagtcttcccactgcctaccagccccatgtcagatgacctccatcagtagtatctccatttatggtgtctcgcctttctgacacatagtaacaagtgaggtgttaagactaacaagagaaagaaggcattattcttatctggctagaaagaaaacaatcagcaacttgtcttttatttaagggaagaaggcttcactctactatattttcaagatattccaaaactgcaacagaccctttcaattattttactttcatctattaccaaaaaggccaacttttagattgaggcaatgaaaactcagaaacttttttggaatgaccttcagatttgagatgaccactgtttcaacaatatttcagttataattctttctctatattcatttagggaaatttgattctgaaaaatacaaatagcttcctttctcctgagctaggactgtatttagaagggaataaattgtagattttattaaaatttgatcacattttctttttttgtgctacgacacagtagcaatgtagattgaaggcttttacatgtatttttaaaattgccatagagaattatttgtattaatcatagatttccaaggctgcaaaagctaaatagtaaagcatataataatggtagcgttaatttgaaaaaaaattccagctagcaaaacatgagtctagatgtagatatcatgttcaaaaatcacaaagcagattgccagcaaaaaattgaaccaagtttttccccttcagaaaactagctttatttaaaaaaatttcctaatatttaaattgattcacacgtttataactatacaagggtttccttgtttcatcaaagaaataagtatgaatgagcagaatgttttagtataaaagtttacaaagtttattcacactcggaacaaaggaataagtaggaaaaaaagagcaactaaaaacaaatgaattcttttccccatccctctcgtttgtctccaatcagttaaatccttttaatgatatatcataagtagcttcatgctttagttcacattgacgatattcttatatctacatcattaataatcaaaatagtctttctgtctttagttttgctgtctctaagtcagaactcaatactgttgctctaaaatacaaatgttaagatgattcttcaggagcttctcatcacctgtactataatgctactagcatgagagcacccacctagccttcttatctcaagtcctgccctgccactctgtacatatatcccctctttaattcacccttagacagagacagagagggccacgcatcttgtcttttcctgaattaatatgtggtttttgccccatgctttagcacatgtgaatccatttgtccagcatgcctttgctcacctgtgtacaagaagagctacataacagatcaaaaggaacatcaaaggcgctggttcttagagtctcatgtccattcctccaattctcgccacttctggatgcactgtttcttatgagcttccttaaatatgctgtgcctttttgctttctgcgtatgggcatctccagtgccaaagtaagaggagatttctgcagaatttcaggaagttaatatcctagtggcagctctcagacaatgggagacaggagctaatggctgtttcttcgttttgtccttcaggctgataatccagaaaaccaatctgcacaatgcttgagaaggtgcagagaattagagccctcattgccctcaatgcagtacctttatattggctttttctccttattcatcacatgctcctgtttcccgagattgccacccacatatactacttgcaccctacactatatttcaggctcttccttcaggataatgaaaccaagctaaaggcaaaatccaacttttgtttaactcatcctgcttctgagctcccaagatccctgaacctacttctcttatataatttattatagaaagttatttaagcatgagatttctctagtttatctttgaatctccactgtcaatatagtctctggccaatgaaagctgttcagttaatgtgtggtgattcaatacatgcactcctaattctcatttatgaacattttgttaaatcgtggcctataggaaataggcatgtaaaatgcacctgtaagttttatagcacctagtacagagtgacagctcaaaactatttgcagaatgaaagaaaaaaggaagttgactctccaaaacaatacacatggccaaagcctggaaaaaagtaatagtgtcccagtgtaacttctaggaggtgtgaggaagaaagaaaaacaaaattggcaccttttcccaggctttagactgagagatattaacttggagaggggaaagcatagtctaaagagaaacagggctaaggaaggtatcactttcttttactatctctcagacagattgcaatgcaatctcaaggcagcactacactggacaaggtactaggactctgaccattcttgtttttattcttttttttttttttgagacagagtctcactatgtcacccaggctggagcacagtggcactatcttggctcactgcaacctctgcctcccgggttcaagtgattctcctgcctcagcctcccaagtagctgggaatacaggtgcctgtcaccacacctggctatttttttttttgtattttttttgtaatttttttttgtatttttagtagagacagggtttcactatgttggcctggctggtcttgaactcctaaccttgtgatccacccgccttggcctcccacaaagtgctgggattacaggcatgagccaccgggcccggcccatatttttattcttaaagaaccagaactatatgcatctagtgttccccaagttttcttctttgtcttttaacattccaggaaaacagatattgagtgttttgctggatcatgcatagttccatatccttttgaccctctgtttgctgtagccagctttgattctttggattcatggtcaccctataacatattcactaatccaccaatgaaaggttatgtaatgtataacaatcaactcagggttttctaatgacaatctttatcaatgttctataagcttgaaaattaatttaataatttataccattgtgcataaaatataataaaaactttaatttaataacgaaattcatgcatacttttacaaacttatcagtcattcagaagtaaatgtggacttcagttttgtgggcaggggtttacagaagtatgttttactaaagtttggagaaaagatcagtataaaaatatgaaattataccaatagcattattagaaatagttaaaagacaaagtttaagtattttcataatcatatcactttttaagtgactaaactactaaagaaacatttagttaactctaaaatattgttgtaaaatttctatgtgttttgaggaaaaatacttttattccatcataaaattttcaacttagagaaacaatttgtttacttgaaaaattataatattttcaagtaaaaatggttatactgacaatttattaaaacataaataaaagttcttcccacactttgacacatgattagaaaaaaaaaggcagtaagattttcatacagaattctggggttaagtagaattcacttgtgtttgctggtctaagatgcaatggaatttggaggcaatggggctggattctatcaaatcagacacacggaagaggttataacgtgagaatttatattttttcattttctcagcccacacttgaaataacaatttgcaagagttttgctttgctcaatattaggcctgattagctaaaatgctcaaatttccattcaatccttaaaaacagatccacacttagtcattcttcacacctctctccctcgccctttcacacccaaattgttaacttttttctctattctcacatttatagtctggttcagacttccgtgatctgtcacttgctcttgtggttaaatttctgaagtgaaattcctatctctaatctcttctcctatgtatgtcatcagacttgcaattttttctaaacccaaaatgtgttttcactagtcccctgttaaaaaactgtcaacacatccacattgcccactggctatagagttcaattcaaactagagtcattcactacttggacaaccagcttcccagctccacctctgggtattctttctcttgccttcagaatggtgttgaggatataaggtgaatgcaacagccattgctctcagtgagctcatagtctaagtgaggagacagatgagcagatcattataaaacaaattggcaagtgcaatgacagaagtgtgcataggtgctatgggaaccaagaggaaggatatataataagccagggaaggaagagaagattcagggagacttactggaggatgaattgccctcagaaagtattgaagtgtaggtaacagttggttaagagaagcagaaagaaggaaaaggagacagcagcacagggtgccaaaataagaaaagcctgggtaatactgccaagagaaatctacaattaaatgcaattcccatcaaaataccaccatcattcttcacagaactagaaaaaacaatcctaaaattcatatggaaccaaaaaagagcccacatagccaaagcaagattaagcaaaaagaaaaatctggaggcatcacattacctgctttcaaactatactataaggccatagtcaccaaaacagcatggcactggtataaaaataggcacacagaccaataaaacagaatagagaacctagaaataaacccaaatgctaacagccaagtgatctttgacaaagcaaataaaaacataaagtggggaaaggacatttgatgtattgtatgggttacataagatcgattaagtggagatggaaattttacaactttttgttgtatattgtaaactatttttaaatattagtggcaaaaagactaatatggataaatattcccaacaatttgatatttgatgtcccaaactattgtgagattggttataataaaaaatagcaaactaccctgctgatttcccatgaagcttaaccctctctcacatttcagaaccagcctgacttaagcctctacatacttaaacagcttcaaatgcctatctgagacagctttgtaatgggtctctgcccctgtttctctgtccacaagaggtactaattcacttctcttcagttgttagacctaggacacaatagacaccaagttacatttctgttaggtgcatcttggaagtgcctgagaactgaccactgggcacctacctttttacctaagtctctgttaatgttggtctgtttacctgttagtagtggagcctggtgcatagaattatctccttgccatctgtgtcccacaacacatatataaccccctgcatggcatatgaggcctttcctgagaggggtgcttttaagccaacattccagagacctagttcccctgccccaggtgcctcagtttttacacctaggatgctattttgaatcttctcctcaatgacaagtatctgtactcacttagtttgggtccatgccacattcctgaggcaactgaaacccacctactccttgatggccttccaggatgcttgtctgtactatagtggacatcccttcctgcctcacggatgtccgtgtgtgtgtgtgtatgtttggtttttactggattcctgaggaaggccttccactgaacttcattcatgtgctttgctacctgttagaaaatgtaacctaatgtaaatgtaaacctctggtgcctctagttttactgacttatgttatataaatcttggttcctggttctttctgttgccctgttatgagatgtatcactctaagccaagcccaaacactaagataacaagtgctaaagatgacgaatattctgaagagttttcaggacacacagaattgtttgtggccagcacctcagtaccaataacagatatttcatgttatatagtggggtcattaaggacttatttgagggaataatcaagaaaaacttcctagtcttgctagagatctagatatccaaatataagaagcacaaagaacacctgggaaattcaatgcaaaaagattaccacctgggcacacagccatcaggttgtctaaagtcaagatgaaggaaagaatcttaagagctgtgaggcaaaagcatcaggtatcctataaaagaaaacatagcagattaatagcagatttctcagcataaaccctgctagccagaagagattgggccctatatttagcctcttaaacaaaataattatcagccaagaattttgtatccagtgaaactaagcttcataaatgaaagagagataaagtctttttcagacaaacaaatgctgaatttgccactaccaagccagcactgagaaatgctaaaaggagctctaaatcttgaaacagtaacttgaatacatcaaaatagaacctccttaaagcataaatttaacaggacccataaaataataacacaattaacaacagcaacaacaagaaggtattgaggcaacaactatcatgatgaatagaacagtacctcatacctcaatactaatgttgaatgtaaatggcctaaatgctccacttaaaagatacagaatggcagaatggataaaaatccatcaaccaagtatctgctgtcttcaagagactcacctaacacgtaaggactcacataaacttaaggtaaaggggtggaaaaagatattccatgcaaatggaaactcaaagtgagaaagaatagcaattcttatatcagacaaaaaagattttaaagcaacaacaattaaaaaagacaaagagagacattatataatgataaaataattagttcaacaggaaaaatttacaatcttaagtgtatatgcatctaacacttgggctcccaaatttataaagcaatcactactagacctaagacatgagatagacagcaacacaataatagtgggggacttcagtactccactgacagcactagacaggtcatcaagacagaaagtcaacaaagaaacatggacttaaactataccctagaacaaatggacttaacagatatttacaaaaaatcctacccaacaactacatccttttcatcaacacatggaatattctccaagacagaccatatgaacaagtctcaataaatttaagaaaatcaaaattatatcaagtattctctcagaccacagtggaataaaattaaaaattaactccaaaagaaaccctcaaaactatacaaatacatggaaatcgaataatctgctcctgaatgatctttgggtcaacaatgaaatcaagaaagatgaaaattttaaaaatatttgaattcaacaataataatgacaaaacctatcacaacctctgggatacagcaaaagccatgttaagagcaaagttcatagcattaaatatctacatcaaaaagtctgaaagagcacaaatagacaatctgagcttacacctctaggaactggaaaaacaagacaaagcaaacccaaacccagcagaagaaaagaaataacaaagatcagaatagaaataaataaaattgagtcttagtgtggtggctcacacctgtaatcgcagcactttgggaggccaaggcaggcggatcaccataagtcaggagtttgagacctgcctggccaacatggtgaaaccccgtctctactaaaaatacaaaaattagccaggtgtggtggcaggcacctgtagtcccagctactcgggcagctgaggcaagagaatcacttgaacctggaaggcagatgttgcagtgagccaagatcatactgttgcattccagcctgggtaacaagagtgagactccatctcaaaaaataaaaataaaaataaataaataaataaataaaattgaaacacaaaatacaatacaaaagataaatgaaacaaaaacctgcttctttgaaaagataaacaaaatcaatagaccattggcaagattaaccaagaaaacaagaaaaaagatctaaacaagctcaattagaaatgaaatgggagatactacaactgataccacagaaataaaaaagattattcaagactactgtgaacacatttacgtacacaaactagaaaaccaagaagagatggacaaattcctgcatatatacaaacctcctagattaaaacaggaagaaatagaaattattaacagaccaataatgcatagtgagagtgaaacaataatagaaaaaatgtcaggaaacaaaaaaagtctaggaccagatggattcacaggtgaatgctatcagaaattcaaagaaaaattggtacaaattctattgaaactgttccaaaagatagagacagagggaatcctccctaaatcattctatgaagccagtattaccctaatatcaaaaccagaaaaggacataacaaaaaaagaaaactacagaccaatatccctgatgaacagagatgtaaaaatcctcaataaaatactagctaaatgaatccagcagcatatcaaaaagataatccaccatgatcaggtgggtttcataccggggatgcagggttgctttaacatatgcaagtcaataaatgtgatacaccatataagcaggagtaaaaacaaaaatcatatgataaactcaatagatgcagaaaaagcatttgacaaaattcagtattgctttatgattaaaaccctcagcaaaactggcatataagatacacaccttaaggtaataaaagccacttatgacaaacccacagccaacattatattgaacgggggaaaatttgaaagcatttcccccgagaactggaataagacaagaatgcctgctttcaccacttctattcaacatagtactggaaatcctagccagagcaatcagacaagagaaagaaataaagagcatccaaactgctaaagaggaagtcaaactgttgctctttgccgatgatatgtttgtatacctagaaaacctaaagactcatccaaaaagctcctagatctgataagttaattcagtaaagtttccagatacaaaatcaatgtacacaaatcagtaccagtgctatacaccaacagcaacaaaactgagaatcaaattaagaacttgagcctttttacaacagctgcaaaaaaaaaaaatgcttaggaatatacctaaccaaagaggtggaagatctctacaggaaaactacaaaatattgctgaaagaaatcacagacaacagaaactaatgaaaacacatcccttattcatggattggcagaatcaatattgtgaaaatgagcacactgccaaaaacaatctataaattcaatgcgactcccatcaaaatgccaccatcattcttcaaagaacaagaaaaaaaatcttaaaattcacatggaacaaaacaacagcccatacagccaaagcaagactaagcaaaaaataacaaatctggaggcactagattacccaacttcaaactatactacaagactatagttaggaaaacagcatggtactactataaaaatagacatgtagatcaatggagcagaatagaaaatccagaaataaagctaaatacttacagccaactgatcttcaacaaagcaaacaaaaacataaggtggggaaaggacatcctattcaacaaatggtgttgggataattggcaagccacatgtagaagaatgaagctggatcctcatctctcaacttatacaaaaatccactcaagatggatcaaagacttaaatctaagacccaaaaccttaaaaattatagaagataacattggtaaaactcttctagacactggcttaagcaaagagttcatgaccaagaaaccaaaagcaaatgcaacaacaacaaaaaagataaatagatgggacctaaaactataaagcttctgcacagcaaaagaaataatcatcagagtaaacagacaacccacagaatgggagaaatatctgcaaactatccatctgacaaaggactaatatccagaatctacaaggaactcaaacaaatcagtaagaaaaaacaaataatcctatcaaaaagtgggctaaggacatgaatagacaattctcaaaagaagatagacaaacagccaacaaacatatgaaaaaatgctcaacatctttaatgaccagggaaatgcaaatcaaaaccacaatgtgataccaccttactcctgcaagaattgccataattaaaaaataaaaaaataaacgttggcatggaagtggtaaaaagggaacatttttttacactgctggtaggaatgtaaactagtacaaccaccatggaaaagttatggagattccttaaagaactaaaagtagaacaatcatttgttccagcgatcccactcctaggtatctacccagaggaaaagaagtcattatatgaaaaagacacttgcacatgcatgtttatagctgcacaattcacaattgcaaaaatatggaaccagcctaaatacccatcaaccaatgagtggataaagaaaatgtgatatatttacatatatatataaagcataggggggtgtgtgtggatgctatggaatactactcagccataaaaaggaacaaaataatggcatttgtagctacgtagatagagttggagaccattattctaagtgaagtaactcaggagtggaaaaccaaacattacatgttctcatttataactgccacctaaactaaaggatgcaaaggcataagaatgatataatggactctggagacttgaggggaagggtgggaggaaggtgaggaatgaaagactacacattgggtgcagtgtatgctgctcaggttatgagtgtaccaaaatctcagaaatcatacctaaacaacttctccatataaccaaaaaccacctgctccccaaaagctattgaaataataataataaagttaatcagaaaattattgtctataacaccaatatattatttttattaatgcatttcttttaatgtattgttatttgtcattaattaaattagtagttacactattaagcgatctgttgttataattaattaattaacctccctttatcaattaaattataaagccctgaaggcaactgagtagaggcccaataagtgattgctgaattgaaatgctgaactgaattatacttcattatatagaaagcctcatatatagggcctcacatatacccttacacaaaatataagaatccactacaaatcacttcatcgattaatcaactggctgtactttgtaacaaggtttgcacaaataaaatatctttcaggaaaagtgtaaaatatatttcattaatctgtgaaaatgcaactggaagttttgtggcttcctagtttgaactccgcccaagaaggcaaaacctttatagacccatagtttcccgtctaggtactgctctttcacacatctctaagtctgactagacacattgtaacataagctgtggtcacatgacaggtaggtgtctcagtaacaggcaacaccagtcatggaaaaacaaaactaagtgtccaaatgagtgcagaatcctgattgcagctcacatttactcttaaacaagaggccctcttcttatattctcaggtaagtgactctgtaataagaggattgtgtagcatttacctaacagctttactttaggactgtatactgtccttagatatttttaaaactttttatatttcatttctaaataagaatattacaaaaaatttcctaacatttatataacataattctcaaagtagatagagccaaataactgacttctgctagttttttttccagatatttgtcttttatgtacatggccagaaaccacttagaacttgcataaaaacaagttaagaagcaaaatgtcagttagttcctttctctatcccagagcgcactgtttcattaggaatttttcaataaaaataataatgtagaaggtgtgatttttacagttttcatgtcttgatatatagtgaaattgagcaatgtgagaataaatgtgatctagaaaagaaaaatatctttcgatttgagaacagatggttaataataatcatgacagtgattcaaggttaatgacctacatgctaaacttgttttaatttttaaaagccattactaactgaaaactccctgctttagctgaaccaacacttaacaagtgttttttaaagatgtcttgataccttcagagaagttctcctgctgctagttttctctggagcaacagtgggaaaccccaggtggttactcctttgtgaatataagcatccacatgaaattggttgtttccgcatgcacgggcaaacatgttttgttatactaatgtctgaagtacaaattgttgtagaatcattttattccatagacttccaagtctaattctaatactaacttccatcaatagttaaattattatttatcttctatccaaaggctacctgaaggtcctatcactttggtgtgagaagaatcgggtaagacaaaaagttaggcttgcaccagttatcaatagaatattaagaaagatttttaagaaggagaatagcagttccaggttccacatatttgatacttttcaccagaaaataggaaagacggattgggtctgcaatgtattttcaaagtcaaacttctattcctctatttaatgtatttttacagagatgacttgagaaaacacacatttcttttgaatcttgatgtatatatttttgacggatcagacactcttacttgagctaggtgatctcacatcattatctgttgctatgtgctattgtttctgtagccaaatgaatgggccattggcaatcaagccaaacaaattttgcttttacacccgattttagcattaatctacagacacggcttttcaatagtagaaaagatatctcccattttagtccaaatttaagtatagttaaagctacattttgggaaaaatgttttatcatttttttgttcacttgtgggatgaaaagtaggattaaacagtccattatctctaccttctctaactgcctttactaaaattttaaaatatttcttttgaagaaacaaaacataatatttgccattaaatcttaaaagtatgacaactaaatggatgctaagacaattgtgtttcaactgtgggcttataaactctattgagaaactcatttatgatcatgagttttttccaggatggacatataaagatggatttttaaaacactggcctggagaatagggagagaagaggtaataaaaaagtatttatattacttatatgagacatatctttttataatatctatatttaaaacattttaaagtataaatatttctgtactataatacaatatacagtattatagtttatggtctgtgatttacggtaattactgtgggtcattttttctgaattaattttataagtgaacaagcaaagtgaccaagagaatgatctatgatccagaaataactttcaatgataaaaaacctgaagtacaacaaagaagtcagaggcagggctagacaaaatggaactaaatatactaagaaggtgcagaaaaagaagagaagagtatgttgtggcttaaccccatatttccccatggcagaaggacagaaactaaatctgagggcaactcaacagtagtcaataattatcagccaaatcaatggatgaataggtggatggatgaatgcatggatgaatgtttgtgcctgggaacccttctgtcatcatgcataagcagcctgagtcttagataatactatatgacatgctttcttcatgtgaataaacagacctaaagacaggcactaggagaccctgggaccacaaagctcagattgttataataaaaggagggaaacaaagctccctgttgaagaaaatttttgcacacttgatatacaatatttctactaatgaacagagaaagcttgacttgaaaggacacatttatattagatgtcatccctatctagaggccattactatcaagcatctgtcaggtaaaggagatgagatgcctgtaattttttctttaaatattgttttttctaagttgtgttggaaatggggagttgcaagtttgtatttccattgcttaaaaatagaaaacagatgaagaaaggagatatcatcagcagaacatagaagatttcataatacggaggctaaaactcttaagaaaaagcaatatttattctagtgcccaacctaccatgagaaagttgtgcgactttgggcaagttatttaattcctctgggtctgaagatgagtctgcacacaagagcctataatgatcccttccaacaccgggactggcgggtctgcagccacagttacatctggaaactccactggtgcttttggagcttcccaagagtatcaggaattcaatatgcagtcataaaaaattttgggtcatgttctctaagtacaacactgccatgtgtgtgaagagatatctttattaaaatttttcttaagttgttccttcctaaagtagtgaaagctgagcagatcttagaaattcatttagaattcatattactcaattacacttgactataacacttaagaatctagttattttccttttgtagtaaaaatatattttatttgaaatatgtgaatggttacttagtcattttaatctacatgaaaaatttaaccttaaagtaactctattttaaaaatatgaaatgagactatcaatcggtacttatgaagcaatgtttattcttctaatatagtgtgggaagagaaatgtaaaagtcttgcaacacaaaagggattgttctcacaaatcataggtttgtgagatggggtggcaaaatctcattgtttttaaagaaccaagctgttcttcatgagcaagaacactgaattccctggttttctttttctagtcactatacccctggcatcataacactactgtcaatcaactgcatccagaaggtagaataaaatgccaagtgatactttcggcagaattccagagattctcagatggttttttcttttccctcttaaaaactgtaccatatgagttaggtttattttgaaatgtccatgaaaaagaagtcagatatttcttaaaattggcccctcttagatatttctggggaagcttcatataattccatttgttcatgttattccttttcatcataaatcagtcctctataaagagcttcaaattttcactgcctgatgctactgtaaaaatatacctaatatgtttgatcgaaagacagtagtcaatatatttattaggagaaatactttattcactaatcttaagaaatactagaggaaatccagtacaatctgaagttaaaactaatgattattaaatgaatgttaccattttattaaaaattaataatagtaataaaaaactacaaagtactttcacatttccatttgactctcacaataactctgcttttacacataagcatatatacttacttacctgtatacatgtacacatattatgtataataaccctcttactatatgtaagattcagagagggtaaataacatgaataagaccacaggactcttaaattatgtgctagtgattataattcctacattatttctataggatcagctggcttcactgatatcaaaagattatatatagttatataattttataaagttctgctaacttagtgactttatatgcatttttcaggaaacttgcaaaaacaagaaggtgaataaacttcgaaatgagaagagttcactaagcataatgcatttattttgcatcaggatttttcaacgttttaatttttaattaaaaaattaaacatttttaatagccgacatacatctccaaaatttacttctccaatctttccaaaagaattgatgaaaatgtaaaccaagatttagatgtaaggatgatcattataacattataagaagcaaaaattacagaaaaacattgtattcaaaaacaggtgttgatgaaggtatttactttattcacaagtaaactgaaaccagagagatcacatgatttggtcacaggcacagcaacaggtaggagcagatctgggatccaaatccatgttagctatctccagacatagatctctctccaccaaaacacacttcagaccacactccaactatgggaccaatggtttgccccattgtttattgcctatggtaatgggtttatgtataatcgtgactaaaatcattatccttttaaattgaaagaaagatgggatgggtgggtaaatagattacagcagaaccaagcagtagattgctattttgccacacataccaaatattagataatgaacttcatattaaatatcttctctaggtctttatcttcatcatagctcacaatgttgtatgatgctctggcagaaactaaaaactatgcttgtagaatgtctcatttatatgacaacagaacgactgagtgaaatggagcttaatattaagtctgttaagaggttagggacaagccaaagacagagtgagactctgtctcaaaaaaaaaaaaaaaaaagtaactcagagataaataaaagtaagttctgagctgacatccataaatgctttgtggcattagatgctgctaagagtgaattatttccatgaagccaagatcaagctgttgcacaagctgtacattaattacttgaaaaaaattcccagtagggcaatgtctaaatatatttccatgagaatagtatatatatttgttataaaggtgatgatctagccaagagggtgtctgacctccaaaatatatccactaataaaaaaaatccaaggagcatttggataacagtggttaaaaaaaattgcaaaacagatggacttcacattttgggcatgactacacacgtggccagatcaatcccagtgattcttccatgcaaatatgttagtgtgattagttgattgtaggaaatgtggcatttgcattactaatatgttttgttcttgtcatggttgtaaaaacagtctttacttagcaagtataaatgttagcaagtataaatatgtttaaacataaaaaataagactaaacaagaataaaaactgtttttaactataattatcaagtctacaacccaaaagtctttttcccatccttgacacaataacattcaaacatgatttttaatgatctcgtagtacatttattgctaaattgtactcaaaataatgtttcattttacttaagtggcacaagccccctgtaggtatgattacattccgcatactaattcttcttgagctcactgacagaagtgactatgtcttcttataaaatttctatactcccatgatctagcttagtttcaaccaaataaacggcattcagtttatatttgctgaagggaagataatctccttctagttagcatctatccacacacagtgcttaataacagattgtatcagagtttgctagttgtccaccaaaatctgttctcccttctttgtcagggcatatggctatatactacaattttctgtctaccttgaataaattgtggctggtatccaaaggaatgagaaaggaaataatgtatgctacttcgaagtgggtatggatgcatcccctcagaagacggtggggctgcaacttgggaggagtctgggttcctcaatctccctaagggagaaactcacccacctgccaaaaacacctaccatggacttatgtgaatgagaatcaacctctactgtgtttgagcattttaattgacattcatttaacactatttaatatacagatgttcagtagatgttcactaaatgaattaagtttttgtagtttgattttctgaagaatttgaaacagatcaaatgtatagagaagtttcaagaacagtcaaagagtccctctatccacttcacccagaattcctaattgttaacattttacctcatttgctccctctgcctaacacatggatgtatttgtgcgtgtgtgtgagagtgtgtgtgtgtgtgtgtgtgcgtgtgtgtgcgtatctttttccagcacaatggtgcattaaccctaagtacttcagtaagtacctctctaaagcaaggattctcttctacactaacactgtaaaactgtcacaaccaggaagtcaacactgatagaacactgccatccaagccagaggatgattaaattattatgtgcttattgggtgctcaattgggtgttcagcatgacaagtatcataaccaccataatcatcctggctttctctttcatccaccatctctgtctctctctcttttccctcctacttcctaggctgctgggcacactgccattgacctctgcttgacatctccttcctccccctgtcagcagccttgctcagacatcaaccaccagtgtttgcatgtccccatggcaagaacaagggggaagggagtaggagggaaaattagtaaggacaagggaaggtggatgaatgaattcatttttaatataatgctacgtgaaaagaaatgccagaaagtaacattctgaaaatcactggtaaaagcatccccaaagtctacctgatatggacatttaaattcattaaaaattctgagtttaagaaaacagctaagaggttgagaaatcagagttggctgcccaacttacaattctccttgctgaccagcatcttttggctgcctctcaaaataacaggataaggcacacaaaactgaattcttcacttggattaaatctgaatcttccttctcttattcctttgcttataaaatatcttcctaggcttgagacagtctagagaccacctgagaacactgaatgttccttttgagtatccagtagcataactcacactgtcaacaaggccttacttacgtgtgctgaacatttttatatttttgtatcctttatcacaaaccaaacactgcttagttataaaatatatgtgtaagtcaacataattttttttgtcaaagcaaagatttttctccaaaatatagctacagaagaaaaggggcttataacaagtgtatagtacacattcagaaacattttgtttcatggatgtttcagtaaatgcttcatttctatgtaggaggtataagattcctgctaaaaatacattcccttccctgaatattcacaatagcttgccaaaaattctcacaaatgaataaagacagaactgattaactgtattaagtgtcctacttaatacaataataattcaggttttaaataatttcaacatcagttcattatattaattaatctcataaaaacctcccaattaatgtactatgtataaattttatcaagtactttgatgaattaagaggaaggtaaaggttttcatcaatatctgcaataatattattaaattgggctaaaaggaaccaagacaaatgaagatatataagaaaactaatcattattttagactaaaacaggaaaagaacatagttatctaggacactgtctccttagtttttaatgtttcttccccagatgggtttgcacatcttttgcctgaaaaaagaacttatttccaccacacaagttacattaaatacgtcttttagctcctagggagctgaaaggcaagtccaaaatgaacttttttattcgttatgtcatgaaactataacactgcattattaatacacctctaatcaataaagcctaaaaatccattcccaagagacccagatttctctaccagttctagttgtactagttattctcagcggtaagttttcctagttcttaatattaaaatgagaggtccagaggctctaggtggtggaggggttgctagctaaaaggagggtgtcctacagaaagggacagagtctccatgagcaatgctggatggtacctgtggtccagttcttggcacatggtgagtgctgcctaagtcttggtgccctagacctgcagcagcaatcggcggggaaaggaccatgactttggtgacaaaagtgatggcagaagagtggaaagaggtatgagtgatgactaaggacaaagaaacaagggtagaaggacaattccagcagcagcctatccgaataacaaaatccttatctcaggaaaaccatctctgctatgaatacatacacacacatatattcatcaggtatcaatttaattactgattggaacactgtaaacttgttcaaaatagaggttattattcagtatcttcagctgtccggattcaccattttatagcatgctctctgacattagtgagaatgaattgtactctacatatttaggtaatggtttggtatacagctgctattaacgatttgtgtgctatgcaatatttgtggtctcctgtcacccacctcaggagacacaactgatgtaagtgagacagctcagcatatcctatggaaaaatctcttattaaataaaggtcaatgattaagtagtatagtcattgaattaatttgttttccttaagaggagctctcctcaggtcaaaattaaagtcagggatagataagtctctcatatggttcccccagtgtgagaggagcaagctgttggtttcctttggtggcttttttcttgtctcagaagaataaattaataaattctgcatagctgtgattttgtgtgacaaaaatgaagaacctgtgcctctgtttacaaagcaatgcaatgggaatcacctcccctggtgtctcttccccatcaccaccactttgcccgctgaaatgttcttaaccccacccaccataaaaggtgatgataaattgttgcttcaaactcatgctgattgaaattttccagctatttttaaataacccccactactggatttcttgcttctatgttatatgacaatgcttctttcaggtgaaaatgtcctggaaacaagtaatttttacctggctacctttttttttttttttttttttataaagaaagaagtttaattgactcaccgttctgcatagctgaggaggcctcaggaaacttacaatcatagcagaaggggaaggggaagcaaggcacacctcacatggcaggagaaagagagagcaaaaggaagtgccatgattttaaaccattagatcttatgagaactcattcactatcatgagaacagcatggagaaactacccccatgatccaatcacctcccataaggtccctccctcaacacatgggggttacaattcaagatgagatttgggtggggacacaaagccaaaccgtatcactatggatggtagtatcagggtgcacatgcatctttttttttttctctctgattttctttttttatttaaattctttttttttaaattatactttaagttttagggtacatgtgcacattgtgcaggttagttacatatgtatacatgtgacctggctacctttaaagatggatattgactcctccaaaatgctttcacttgaaaaaaaaaagaagaaaaaaacctcaaaaatgagaagggctttccgacttgaggaaagcaaatctttttaacttgcactaggaacatcacgacattttcttgcctcttagatggtttgtattttggatgcttctgaagagaaacaaagacatatagaatttaaacattatctgtgtttatttgtagaatacttattttttgtattttgttttttaaatgagtatgtctgatatctcatacatttagaatatttgtaatagaatagcaaatttccaccatggaatcagtggagagctatgcaatttaacaactgcaaagaatcttagagatccttagagtaacacatcctcttatttacaaatggggaaacagggtatacgagtagaagtgacttgcctaatccataagctaggggtacaacagggtcattagggccatcctgttcaatttctccctgatatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgttgttgttgttgagacgggatctcactctgttgccaggctggagtgcagtggcacaatcttggctcactgcaacctccgactccttggttgttcaagtgattctcttgcctcagcctcccaaatagctgagattacaggcacgcgccaccaggcccagctaatttttgtatttttagtagagacagcgtttcaccatgttggccaggatggtctcgatctcctgacctcgtgatccacccacctcagccttccaaagtgctgggattataggcgtgagccaccgcgcccggcctcttgtagtttttaaaattaaatttaatccaataaaacatttagtttgcctttatttggaatttgttatctattgttatatactctattaatacctcctcttcagcaaggaaattttcttacatctgcttacacgtacatcatttgttagagcccctaaatattggtaatgatgatgatgatattatagcatgaattactttacgttgaacattggcctaagtgctttaaacacattatttgcctagcatttacaacatttttgtaggtattatttgtcacaattacattttcttgttctatgatataatttgttttgatatcgtattagttttctattgttcccctactgaattaccacaaatttattacattgtgggattgtaagtctgaagtccaataggggtctcactagcctaaagttaaggtgtcggcaggactgtgttctgttttggagactctaggagaaaatctgtctccttgccttttccagcttcttgatgccattcatagcttctttcatgatctggcatcctatacgttatacttattttctgattatattttgcctaacctctgtgagatattaattatttgagggcagagatttttatttgtttgttcataactatatccaggtgccttaaaatgatgcctgacacaaaataggtactcaatcaacataggttaataaatgaatgagcaaaaagttttattgtgcatattaattgttacctgggggaatatactcagacatcttaagtctcatatgtaaacttggggtattgatatcaacatgccattttgaggattaattgaggttatgtctataaatacctactagcatagtgtctagcacatagtatgaaaacattgtattattattatttattaaaatggcattttgttttctttatagcacctgacactatccaaattgccttttctgtttcttttctttttacttatttcttaattgtttcacaaaggcagagtcttgtatgctttgcctctatgtctttagtacctagaatagtgcctgtttaaaagtaggagctgaataaatgtttgctgaattaatattaatcatgtgtaggaaaagaagcttgggaatgttattctaccacccacagctgtgcccactattatgatggttgttttgtgtgttctttctcaaggattcactttcagaactcaaaatggggtgtagggtggtggtggtgccagcagtggggatgggagaagctcgatctctccctacagtagaagtgcttactgctctatgtgttcttcagccctataagaaccaatgaaagccatccacacttccctcgatactggacatccctacatactcacagcagtctgcaaaacatatccaagggcccactgagacactgaagatgacccattgatttaatacatatttgcaaggctctgattgagaacctctggacaggcgcttatctagaggttacagtgtgtgactaacacgacacagtttaggatttatgtaacaggaatatgctatagggagagaaagaacagaagacctcagttgacacggtggaattggagtgagagagatttccatgaagccaagtaaatagtattttggagagtgaaggaggagacatcatccttaacttcaatattattatcctgtgtagattcatactttgtgtattttttacttaagagaaaaaatagtaataatattcgctaggagaaacactttgaagaaagaaataagtccaggagccctgtaatgtacttttcctctatttatttcccacataaaattaaagctgttttagttctcatcgcatttatcatcttgaactcatttgccacattattttatttaaatattccttaacctacagagagtggacttaactgctaaaaagtacttaatacatgttcccaaggaactgcttcaattaccactgcacaaaggtttgtttgtttttaataatacagtattattactagaagtatcatcaagtcatggaatggtcaaaatattcttacttctattgctagggtgttagaaaggactctggactacttgatgtctagatgcagataaaaaaagcagctgttcacttcacataaagtagccgctactgcttaaaggtaagggtaaatcttgttcactgtggatgaaggttactaaagagaaggactaacatataaaataggttcaaatatatacggagatatagacttaaaaaattaagacttctccttcaattaatattccaagaaaagaaactccatattgccatctaaacacagaagcttttctgtaatggtattccagtgaaagtcatttaaattcgaatagaaaaatttaacttgagatctgcccttatgaaaagtggtgagaattcaaatagttctcgaaccctatttgtcatatcacttcctgaaaggatactcaatctcttaatttttttctattattttgtactttatggaaaaatatttaggaagattatagaaagaaaatttttaggaagtagcgtctctagttttcctaaaatttatgtcaaacccggcattatttattttacatataaaaagatcataacttttactctttgttaaaactatattaaaacaaaagagaagcaacccactaaataataattgattaatttcatttggaggtcttctatgtttagtatgtttatggactttttaaacactgaggattcactaattttttttttttttttttttgagacaggatcttacttttttgcccaggctggagtgcagtgatacaatcacagctcactgcaacctcaaccatccaggctcaagtgatcctctcacctcagctaccagactagctgagactacgggggtgtgccaccatgccaggctaattttcgtatatattttttttttggtctaactgtgttgcccaggctggtcatgaactcctaggctcaagtgatctgtccaccttagcctcccaaagtgtgggattacaggcatgagccaccatgccaggcgagaatttgcttttaaatgagaaagacacaatacctgccttcggaaagttccctgtcaaattttagaaataaataattaaacaaagtttataggcataataagtcataatattcttgaaaagatatgcagagggttccaaaggagcaccaaccaaccagaggggaaaatatgggggcaacagagaggcaagaggtgatatgagagagaaagcctgagctagaacacagagccaggtcatgaatctgaaggcaggaacaactctgtcagctgtgagacatgaatttggaaggctgctgggagagaaaagcagagattagtcgtgcaattatctacttaagatattttgggctggaagcagtggctcacacctgtaattccagcactttgggaggctgacgcgggtggatcacctgaggtcaggagttcgagatcagcctggccaacatggcgaaaccccatctctactgaaaatacaaaaattaaccaggcgtggtggcagatgcctgtaatcccagctactcaggaggctgaactaggagaatcgcttgaacctgggtggcagaggctgctgtgagctgagattgcaccacggcactccagcctgggcaacagagcgagactccatctcaaaaaaaaaaatatatatatatatattttgaagtctagagatgaattccagaaataaggtatacagaaagtgaaactgtaggactttgtgattgactagaactgagggacaagggagagggaaagggaagagttgaagatgatggaaacaatagattacaggaagaggatcaaatttagggggaagaagatcagatcataatcaatacaacttaattccacatgttctgaaagttaaatatctcctctagccaaaagacccttcctattttacttctctggacctcttaatgtttctttgatgtttattcccctgcacaaataatttaacccctttacagatccaaaattttatagtaggcaaatattgtaacccccttgaaaatgtatgttatgaatagcctttgtaggtgatatttttgcagtttggtaacttaggacaaggtccattttcctgtcccttgttaaatgtcacaagacttcatcttctctacctatatatcacaaagtaccttctgctctgctgatcacaaggtaattaagttttggagtggaggagtgtcttaggtttatgttcatgcattaaatataaagaaatctatgatttttaaaaaattaactatattgaggtataattcacttacaatcatatgcactcattttaaatgtacatttcttgagttttgatgcattaataaacccatgtaacgaccaccacaattgagaaatcatatatcttcattattttccccaattttcctttgtgcctttttctagttaattccttctccttctcctccacctccaccccagccccatgggggtagccatgaaggtacacctcttggatcttttctctccaattagctgccaggagtgctattggcctcctgctgcagcagcaatgggatccaccacagcacaggaacccagactggcctccagccaatgactgggagcagcaaggaaactacagcccagacatgtctgcctaatgcatgactcctcaacaagtaacctttgttggaagccaagactttcttgtaactgcactgtaatctgtggctattcctacccaattctccttccttctgcctccctttgaagtgatatcacaactacattgtggtttttccttgcctggtttttctcctgttctctttctacctttcatagctattgcctgcaataaatctcttgtggatggttgtaattctaacaccatcttggaatcagcttcctgaatgactgaactgatgcctctacctccagcaagcatggatcttgttgttaccatggatgacatttgtcttttctggaattatagtatgtactgatttgtgcctggcatcacacagcatgatagttttgagattcatccatgttgttgaggttatcagtagtccattccatttttgttgctaagtagtattctgctgtatgaatacagcacaattgttgattgattattgtgttgttaccagttagagctattaagagtaatgctatcgtgaataattctgtacaagtcattgtatgaacatatgcttccattaatcttaagtaaatacctaggggtagaacttacagatgaagaaacagaagtacagcatgtaagtgactttgcacaagtaggcagcacaggttttctgactttaaatctatgctcttaactcctatgccgtattgttcttcatgggaagaaaagctatttttcttgacccatttaaactttccataatgtttaatcaaaatattcaatatttaagttaaaaacagcaaaatctgggatacaaggtgtaccaacctcaagtaaacatgccaggtgtttggaaaagtagaagaataatgaaccttactacatgcaaactgtgcaatagttacatgtagaatgcatctcaaaaaaaaaaaggttcctggaaaccacagtgctatgaaaagataatcatagaaaacaaggataaatttgaataccacatactcattttaagaaaaattttcactgagagaaaaaatttaaagcaagttgatggcatataaacatccttgaaattcttcaagtgaatacaaattagttgagttaagcattcagataatttgggtccttctcaggtggcctagcaagttagtcaaaagataagacctgtaatcaagctgccctctctcattaccgtcgttaaactgcataggtagacataataatcgacttgaataatgtaccatcaaacaacattaaatagtctatcagatcacactgcttatagtacacattaactactcatatgctttactatctaaagcagggttgtccagtcttttggcttccctgggccatatttgaagaagaattaattgtcttgagccatgcataaaatacactaacactcatgatagctgatgagaaaaaaacaaaaacaaaacaaacaaaaaattcataatgttttaaggaagttcacacatttgtgttggatctcattcaaaaccatcctgggccgcttgtggcccatgggccacgggttagacaaacttgatctaaagcaataccatccattataattattctgtgagccaattatgtaattttaaattttctagccaccacatttaacaaattaaaaagaaccgggtgaattttatattttatttgatacaacttattcaaaatgttatagtttctacatgtaatctataaaaaaattactgagaaattttatgggtttttttcataatatgtcttgaaatctgttgtgtattttacccctatatctcaactcaggctagctacttttgaaatgcttgatagcaacatgtgtctagtcactatggtattgtacagagtaggtgtagagatcaacaggaaacatttattgagtacctatataagaaattatactagataccagggaaaccaaaaagaaaaaaagtcatctgtaagaagtttagcaggagcaacacagtgaacagattccagcagagattatggcagagattactgtgatcttgggcaaaagtgtgtatcttaggaatttaagatttaagaaagaattttaggcatgaactatatgacaaacatacataaaggcaggagaagcctgctatgctctggtgacaatggatcaaccagtattagagaattcacatgatagatactgaatttcctggatgctcagtggttagctaagtcttaagtttatgaatgaacaaatgacacaagatacaacattagaacgaggatggagaaaaaatataaaatctttaaaatatcagtcaaacgacaaattccagcttcttatgaatgaagagccagttaaatacgtttgaatgaaaaatgacgtgtgaagtgatatatgtggcagttaaagttaaccaggagagaaagctaaactaccgctgcacaggctcagcatctattgcactaatctaggcatgagttgtgtcctatccaaaccttcataatggaagagatgggggagagaatgaaagagagattggaaaaaacaaggatcctaaaatcatcttatggctaaatttgagagggagggaactatggaggcatcagtgatttatatggtttatattgtaggtcatgggaagtcataagaaaaattctggtgccaatggtgataactgatatgaagggactccttgcttgaaggaaaaattaagttaaactgagacctgttgaaatcaaagtagtagtgtgatatctaaataaaaatgtgtagcgtgcaaagagaaatatgagagtgtgtatcaggcaagagatctggctagaaatgtaggcaaagggataaatagtcataagactataaggcattgcggagggaagaggaaaagcttggagaatgagtcagaaatccacacaatagattaaagatttaagttgtgagaaagtttttatggagagtgttctggggaataaattagagattaataaaagaataaaaaatcaaccaggtagaaagggcatgcatcctggtgtgtgcaaacatgtatagctgcatgaatgtcaagtttactatcttacgtggctatatcactatgcaaactatagcctttcatagtacgtaagtgaaagcattagaggattatctgtgtagtcctaaaatcctttgtgaatacatcacattgtcctattacattcttgcccatgttttacataaccagactgactgtaatatgagtattgtgtgtgccctttgttaataaatccttgtataaaccccacaaggatttctctaaagacaaacctggcttgctaaatattactcactccaggctaaattttaataaattccataaaacactatcagatatattcctgagacttttgtattttaagtgctgtcttttcctatttggtatttgcattggttacttttgtggggtgtgctggtttcttccttcttccccttcagacactccaccccactcctgcactgtgcctggagaagatgaattgtactgactacaccacggtttttcaaccttggcagtaatgacattttttaactggatactttgttgtggaaggatgtcctgtgcattgtagatgtttaaaaaaatccctcagtgaatcatagtagcactccactcctctcccttcctcccctgagctgtgataaccactaatgttccctgggagcacaattggccctggattagaaccactgctacatcaatgcactccttttgtctacgctgtgagtttggccagtggaaacaccacaaagaggaaacagggagggaggaaagtaaggtcaggtgatccattttccagatattgactattctcgccctgctaggccagtgcaggcaggtggtatcagtccaaagatcacacagctcaagtcaggcagccgtcttcacataggacttgcttggtcatctctccttcctttctccctctttttctgataaatggtaatctccctgttcatttagttcattttggcctagtggttataacggtgctcgctgttgccatcctaaagtattgcactattccgtgtgtttttcctaacccggtctaaaccttcgtaattagtccctttataaagtctcctccaactaccaaatttgtgtgcactgtttgttttcagcaggagttataattgatatgatgtaagtacatatcaaagtatttacagaaaagcaaaattccaaatattgagatgttttctctgtattggccccaatcattggaatgttttgtgcatacaactttataataatcactgacacctatattattttcatactttgatttgctcaatgaatgctagttataaaaaacaagatcatttaaaatacttccttgcctttattattctcaggtgaaatggagatatgaatttataataaagagtgacaagttagtggaattgtaaaataacattatactcaaaaaagaagaatagagattgtaaagaaatgagattgagtccgtaagtaatgtataactgtctcagtatttcattgtcataccttataagtaagcagggaagtacaaatagatgtgtacttattaatttagtctttcagtcactcattgagtcaatcaattcttgaggccaattgtttttgaaggcactgattgtgctagatactgtggatgttacaaaggtgaataaaatgtcttaatctgaggaagaatttacaatctacacaggcatgaaaaaacaaggaagagtgtaggtgaaagggaaatttgaatgtgaaatcaccaaggtcacaaagcatgtctcctcagtgctagcgaaggactatataataggctcacaaaaatatttgtttaaaatgtaattaaatgaaatttgaagaaagcagaaaatgtctcacaatgctatgtggaagttattagaataacacccccttcccagttcctaattgcattcctggcatatcttatgtacattaatctataattaaatgaaacattaactgctttattaatggctactttagaaggagtgcattcattaaggattattttgaaatacaaataatttccccataaatcttacattcacatatttggattctgagttttacccaagtggcacacaaccataatttgtaggacaggtgaaataaagttcctactattctggtactgtatctagactgagctttacatatttttaatagctttttttttttttttttgagacagagccttgctctgtcacccaggctggagtgcagtggcgtaatctcaccctactgcaacctccaccttctgagttcaggcgattctcatgcctcagtctcccgagtagttgtgattacaagcatgagcaaccgcatctgtctttcttttctttctttctttctttctttctttttctttctttctttctctctttctgtttctttctttccttctttctttctctctttctctttctttcttttcttctttctttctttcctttctttcttttatttcttctgttctttctttcttttctttctttctttttttttttttgtatttttagtagagacaggatttcaccatgttggccaggctggtctcgaactcctggcctcaagtgatctgagggtcttgacttcccaaagtgctgagattactggtataagccatcacacctgaccaatagcttgtatttttgaaagaagttttaggtttgtggaataattgtactgagattacagtgcattcccatatactccattacccttcccccaattcccctattattataattttgcattagtgtggtacattattaaaacttatgaaataacattgataccttattacaactaaagtccatagtttatattagaattcactctgtattgtaaaattctgagttttaacaaaggtataaggtcatgtatccaccatgacagtatcatagagaatagtttcactgtcctaaacatgccatgtgcttcacccattcatccctctgcactttctcagagccccaggcaatcactgatctttttactgtctccagaattttgtctctttcagaatgtcatatattggaatcatatagaatgcaacctttcaaactggcttacgtacctaagttttctccatgtgtttttgtggcttgatagctcatttctttttatcactgaataatattccattgagtacatgtgccagtctttttgttcattcacctattgaggaacatcttggttgcttccaagttttggcaattatgaataaagctgctataaacgtgcatgtgcaggttttggtgtggacacagtttacatttcctttgggtgaatatcatgtagcatgattttggatcatatggtgatatggttaggctttgtgtccccacccaaatctcatcttgaattataatccccataatccccacatgtcaagggagagaccaggtggaggtaactagatcatgagagctgtttcccccatgctgttctcatgatagcgagtgagttctcacgagagctaatggttttatgtgtttggtagttcctcctgcattcattctccttcctgtcaccttgtgaagtaggtgccttgcttccccttctccttccaccatgattataagctttctgaggcctcctcagccatgctgagctgtgagtcaattaaataaacctctttcctttataaatttcccagtctcgggaacttctttttagcactgtgaaaatggacaaatatatatgttaagtatagtttagcttcgtaagaaattgtcaacctatcttccaaagttactgtaccattttgtattgccagcattagtgaatgaatgaaagttcttgttgctccacatctcaccagcatgctgtgctcttggtgttttggattttagtcattttaataagtgttttgtgagctttactgtttgatagctgagttacaaactggcaagtatccaagcaaagaacagagaactggaggtttgcttttctaccgaaggaaatatgttgagaatacaggaaagtttcacgctaaatgtaaataattttttacagttaaactaataatgagtgattgaaaaaagttgacttgtgacatacaaatgatacaaacctttcattgtcctctctttcatgggtattaatatttcatttgataaagatttaagtactaatgactatcagtatctgttgattgctagcaattttgagtagaacactttttctgatatgtatgaatatatagacaagaatcatatgatacacctggattgtgtaatagcctttatgatgcagtaaggcaaccactgaacttggaatcagtgaattacaatttgtttcttctgggtccctcactagccctgtgactttggtctatttgacttctgtgagcctcaaaagtgcatttgtaaaatggaaattaaatttttttctgcccatcttactgtgaagctgttgtaataataatattgacaatagcaataattatactaataaaaagcaatttactgtgtatttgaaattatgcaaacaatttgaaaatcatagcactatataaaatgtaacgtcacattagtgttggagtttacaatttggcagggaagctgtacaactaaccacggcacaatttgataagcaataaacttcctttagagtatacggagaaatggggaggattataaatattaagcccttttgtgccaggctctgggaccacaattatcccatgtgatctccatcacaccttgcagatgtaaattttcttattcttattttatacagatgatgcaactgaagaacgaagcaagttgtccatggtcacacagctaataatgatagtattttcctattcctcatagaaaactggagacggccacattatatatccttaactacagggaccatttctagaaatcaaatttctagaattcaagccacaccacatacaatatattaccccatagcttattgataatgctaaaatatgggatatctttgcatagagatccttaaattgtgctagaatatgagatctttttgcatagagatcctctcgcatagagaattcctgctactcaagaatcaatgttagacattcactctgtgctcacagtgttcttttctcttctgtcaaaaaaaaaaaaacaaacaaaaaacaaccaccttattttacttgtgaccttcagtaccaagtaagactggatagaatatcaagataaatttgcgacagatttagtgtcctttctgtcgcattatcatggttgcccagaagttaagaggtttggaatgattccagtctgataaggagaacaagacattgaagtaagtgtctggagtctaaaatagatctgggatagctattactttagcttttctgagatttaatatgggaatgaggtgtaaaagaagagttgaaataactattacacagagatgcttgttccttcttcctaaggcctaagaacatttctcactcattcttctatcctagaattcataatggtatatggcactgcacagaaattcattaaatgttagtgaaatattacatgtgaaagaaggtagtaatgtaaatagaacctaatataattttttatgggctcatttatgttctgcattttcttataaaattactttttagattgttttgctgctcgaatcattactggttgctatctagggatcaccttcaaacccctttcaaaatacaatgttcaaaaaaaataaaaacaagggcctggcacaatggctcacacctgtatcccagcactgttgggaggccgaggcaggagaattgcttgagcccaggagttcgaggccagcctgggcaacatagagagacgctatctctataataaataaataaataaatatttttggaaaaacaaatgctgttaaaatgcatttctagcttaggtcacataaaggatctgaaatgggcatgtaaacaatggcaagtttttatatatatcaattaacaggtcttgaaaaaagtattgactctactggcttgtgtgaaatttccctgaatgaaatcagacaatggtgttctcagaaacaatgcatcttagaagagttaatatcagccaaagacattatatcatactaacttctctcccaataaaatgcctagaaaacaatgtatctctaacaagaaaaagttcaatgctgtgttaactggcaattccatttaaaatattttcaaacacattccctaaggtaacaaatataattattaaaagcctaataaatcttttaataatccagaaagaaacatttagaagacattaagaaagacatattcagaattcagacagaagctcataaaagctaacataaaaagcaggttaaaaatcaatttctacaagaaaaatatagacatataatcaaacaaaagggggaaatacataacaaacactagacgaatgcaaattttcaaagctatattttaccaaattttaaaagttaactttaaaagaagaattaaccttggtggcagcaaaatccatgtctgtgtgtctggctgatttgggttcaattaaaatcttgggtagagaacacttaagtgaaaatatagggcaaaaataattccatacaaaatataatgaataaatagagcaaaatttcgcatataaccaaattccaacattttaaggaaggtattaatttcaagctaatatccaaatttgtctggtaagaaaaaggtgagcatgatccctatgatagtggttgccattacttctacttttgtgaggcagaataggtgggacagctctagggctcttctgattttattctatcaattataagaggtctgagaacaggaaatgaaaaaagctatgaccctcaagccatctagctcaaacgatttcactggcatctaggatctgatatattttggattggggaagagtaaacacaggcaaaatttgcattggatgtgaagctaatggcccttccacataattttgctgtaggatatcaattgattccctgtttcagaggaaggattgttaagctaaaatggtttcaaccagatcaaacattaaagtaagcagagtttttcagtagatttgactagattcttcatttactataaagatctgccacacccgaaataccacctgaaattagttttctagttaaatcagtatagactatggataaaagaagttacgaagacaaccctcttaatcttgatcaatattcagagatgactactccccatcacaaaagctaattcgtttttcacatttttctctgctcctaatgaaatcttttttgctgaagtttctgaagaaataaataaagaagcctggtgcctctcagagttccacacagctgatgagtctaggcagtgacaaatgacactatattcctcagcgtgcaacctttctctccctctcatcttcttgcaatggaacactgctacattccttgcagaggaaacgtactgtacatttcatagctgtcaccttggcataaaaggcagagggagggggaaattcttcttttggtctgcctaaacattttactttattttttatatatcaataaccatgagaaactattgagtaagtttagatataaaacagagaactttgttttggaaggcattacttttcaaaggaaatgcatcgtggagagtgaggagtgaagggtcaatgttttcaagagcgatcggaagctccctgccttgatattcctaatcttctttctggcatcttatgctcaccaactgcctaatagtggatgcatgtggttctgcccatctgtccaattgccattctaaattatgtggtttactaagaaaatacttaacattatatgaataatgtataattaattataagtagtttttaaatcttcaagatttatctcatgagtgaaatggttgctttgttcttaaggagaaaattaatttatttcccacgtatccatgtacaataagtagtgctgttataaacatataagaaaatgagctatcatgataagtatacagcatagagttaagtttattagaataccctcatattctataatatacaaaattactaacgtgcagtgaaatcatatagaattctgaagtagtgaattgtttccttactgtttaacacattcttgcagtttgtctttttaaaattaaaatcaggaattctgggcagttagttgtttttgaagacaatgtcatttatctttgctttaagaaggaaacagtctacatttaacaaacaattcattttctacatattaattgagcagtgaaaatatggttggcaggtctgaagaacagggaaaaagacagtgtagttagagtgtagttggagggtggcatacaaggagaaaagggataggaagtaagaagttactgaggtccagataatgtagggcctttaaaacacagtaaagatttgcatttcattctatgtatgataagaggtcactggatggttgggagcagagggggatgtgatctggtttctttcttaaaagaattattccgactgctcaagaatggactaggttgggtgtctaagtggaagcaggcagatcagttcagaggttagggaaggagtccaggtgagaaatgatgaaggcctagcctagggtggtaacagtagagaagggagacatggtaagactggggatacattttgaattacagtgtaggtaaaattattagcttaagggttagatataaaaggtatgaaaggaaaaggatcaaggatatgtatggtatatctgcaaatgctaggagaccaaagtgaaatttcacatagtgaaattactgtgtttcagcagttagggataactttttggagttctggaggcttgggctggacttttttgcatggataaaattcagacaggagacataaaagccttcttagtggtaagacagttattagataattgggaagtattttgaagatacttgtctacctagaatgaagaattttgttgagtatttgagagctatatggctgaaaagaaagaggccagataaaacaaggccctgagtaacaagagtaggccttgggccttgattctatagagagtgcaaaaccactggctaattttttgtaactaatctggctagaaatttccagatttccagcacactatattaaaggaagtactgccaaaaaacatttcatggattccaaaaatagagatcaatgtagatgaatttataagatgaatgaactctgggaagaccaagcagatttctgaaacaacactaccatatatttcattatatacacacacagctacacacacacacacacacacacacacacacacacaccataccctgaacataccctacaccctacataatacttatatatacacgttagtgctctgcagttaatttttataaaggcaccaattagtttctaataagaaaaagaaatgtgtaaagaagagaagaaatttcattctctccatgaagaataaaaaacacaaatatttgttagctgtaacaaatatacatttttttctcaaatcatttcatgatatttatcacatgaaaaatgggtactttggggagattttctcctaaagccttcattttttcatatatagtgagatctaaacaaccaatttctatttacagttgaattctacttccaaaaacatacaactatgactcaatccttgttacctttcaataaactgttaagcccaaagatataacttattttaaaatgtgaacctagacatttgggatgatcaggcatgctagttactattaagaatagcagtatgtactaataaaatggtattcagagattataagggaagcactaatgaataaaaatgacccaaactatatataaagtctttgttcatacacaaaataaacacatgcactatggatggggttctctaacgacagtagaagtaaacgggcagctaaagagtgtatcaaaaactgcacttttacagtttcctatatatcgtcagacaggttaacaaaagtatcgaaaagttggcatactgtggataaagtacattaaaatgagaaaggcaaagttttaaggatatatgaaaatgaaaggatggcaactagtatggtcgaaattcatgtgataaatcgtaataaccaacgtgatagtattaagtggtggggccttgcagaggtaataaagtcacgggggcagagccctgacaagtggaattggtaacattatgaaaggccttgagggagtgagttggccctttctatctctctaccatgtgagaacacagcatttggccctctggaggatacagtgacaagacaccatcttgggagtagagaaccggccctcgccagatactgaacctgaagacaaatgccttgatcttggagttcccagcctccagagctatgagaaataaatttctgttgtttgtaaattacccagtctcatgtattttgttataacagcacaaacagattaagacaacagctttctcagagcccaaaacatttataatagtaagaatttgcaaaatcaaacaatgagtaaggcctcaaatgatcagctgtacttgctaaaaatgaaagaacaactaaatcactcaattcacttgggcaagacaatccattattcgtctaaaatttttgttaataattttctgatttactatctaatagtactggataccatacaaccaattactcctacaaatttttttgttaatagttctctgttttgctttttaataatactggataccaatactggatatccaaaatggtttgatagttgggaacaaaggggataaaggaaagaaatgtactataaccagagatttttgaaaaataatgagactgtatgtactatgatacttcactcagaaaacctcacttcaaacttaatgggaagagaaaaagattggggaagaagtcttcaagcacagtccataatattgatagatagactcctacacatattaatggttgacagctagatgtcaatgcctagagcacaacaaataggtcttatatatcactatattttttatgatgcttggcattgtattttttttgtttgtttttgagacggagtcttgctctgtcacccaggctggagtgtattggcatgatctcagctcactgcaaactccatctcctgggttcgagcgattctcctggttcagcctcctaagtagctgggattagagtcgtctgccaccatgcctggctaatttttgtatttttagtagagacagggtttttccacgttggccaggctggtctcaaacacctgacttcaggtgatccacccgccttggcctcccaaagtcctggaattacaggcgtgagccaccgcaccaggctggtgtagtattttatacacagcatgcatcaacaaaatggatcagatggatgggtggacaaatggataattgaaagaataaatagcagaaatgataactctaacttttaagagtctatcaagctaaaatgacttttgaatcagtcgaatgaatgtacgtgggaactgggaacttaagaaagagaaggagcataaattgcaattgtggctaaagcagcagaatgcttatttacataagttttaaccagtgcggaatattgtaattaccatttatgttgtttttttatgaatccagtacatgcttattaaagggaattggagaaaataaaaataagaaaggaacgcaataatccagactgtaatctaggacccagtaatagttacttagttgcaaaatttcctcaagggcaatatgagagagaccattttgtgcttgttgccatgctgggggtgcctactggcgttaaagaggtaaggcccagggcttgtaaacatcctacaatgaatgagagttctccacagcgaagaattacccagcccaaaatgcaaaatgggcttcactgagaaaaactgagtaccttgtgcatttattccacgtctttatatgtacataagccacatacaggtttttaaaaaataaaaatattatgctgcacaaactgctttgtaatttgttcttttcacatactgcaacaatagcatccttccacaccattaataattattctacaacattttaatggctgttcagcaaaccactgcatggatcaaccataatgcatttaatgaggtccctatgatcaaacttctagcactatttttttcaattttgttttataatcaattctgtgataaacatcttcatatttaaacttatgatcatatttaaattcttagacatgcgactggtcagagcatgcataatttcaatgcttttgatagacttccaacatgtcctcaaaaatgacttttattagtttattctctaaccatattgttctgattgatggacatctctaacataaagttgctgaaaatatgaaacatcagctgaggcactgtgaccctgggaactggctggtcccttcctagcccacatcttagtagaagatgcaagggttattgtggaatacgtccgcgggttaaaaaccatgtatcaattctaaattccaagtgccagaccctttcattacctttcattagcgaagtataaaaagaaagagggagaagggattttcaaggaaagtaataagaagggaagtattagtggaacattagagtttgtctctggtccttcctctgagtggggactcatgaggcttggtgttgtctgaaagcaggaaggacttgggtcttactccctggtaggatgcagcctgaggagcaaggccggcagtcacagtgtgagcaaacattcatacagacgtgggggctgacatatcaagttggagaatgtatgctcacttcctgtcacccccatacaccctgattcccaagagttgaggcagttgtggtaggggttcttaggtttcccatgggctcagattaggcctcggacggaagtgaaggcagtggctggctgggtgaaatatggcggacagagtcggtgagtaacaggagagcatgttatcccttttagacccctgaagtattagagaggatcagccaggcacgtttagaccatatgatgtatcatattgtagattcaccccaaggcatttgtggctgtgcagtaaaagtgcaggatgaaaccagactctctgaagggtagggatattcccgtccctatccctcatcttttccccctttgcagataaaccatcccactttcaaatgaacttgggaggagggggctttgaactgtgcttggggttgtttctcctctggaaatgcttccattctaaaaagttctggcatagggaattggcctaaggaaaaactctgccctccttccccttaatggactgtcctgcctttgagtgtgagtaaaaggggctgagatcattcatcagccaattttacagctgcaatctacttagacctgcccccatctaggtcaccaaggatctttgtcagcatttggtacaaagcctatgtgaatgaagatggtcatttctttggtgttgtcccaagaaatgtaacagaaaatgactataaaagaatggattctgatatgggatgctgagtcctgataatctctctaaatgtctttcatctaggacctgcaatcagccattattaagaaaaagagaaaaggattgcaggggacagttccaattaacctgtggcatcccaaatctgtgttttactgaacacctagaactattctccatgggtttggcgtcaaagaggcattaggaaagatggtaactattcctcttacatacaatattaaggcctttgagatttgcttcagcttaacagagatacttttaaactttgttaatttaaatgtttcccaaaattatttgagcagagaatccattctaattataccatgtgcataatactcaatggaatcacatgactttggggaaatcagaggaaaactaatagtgattacattttatttagctaaataaaacggcatgttcagtgatgcttttccctctttgtgttatacaatttacttacttaatatcatcaaactacaaaggaatatggaaaagattttctgtgatcatgtatcgacacacttcttagagaaaatgtaagttcttggcaaaatattacaactgtataatgcactacaatttttaaaaatcttttgtctgcattatcttatttcattcacactccaaccctgggcagttggctggccagttacagatgagtagctatggtttagaaaggttacatgagttgccagggatctggcaacgcataattgaatacattgtcttaagattcaagctattaaacacagactgaaagcattttgaactcatttaattcaacatttttatttcacagataagaaaactcatgcttagagaggggagatgacatcatccagtagagtgagagagagaagaccaactctctgttccctgaattcaagcccatgccctccacaccatgccatgttttccctgtatatgaccaaacaaaatggtgcagttaaaccacgagccgtcatgcacaggagggccagctggccatcatgctggatcaaacagcagatatagaccatctctagcagaacacttgtgaattgcctttgtttcaaactcataaatgttagtatacctttgtaggaggactaccatgaaagatgaattgccactataagcagtcattagtatttagtggagattaacttttaaaggtgcctactttagatatgtcataatattagaaattaaggatgaagtatttctatctatctatgctttgtaggacaattatattaatcccaaagttacctgacataagtaggaagcacatgcctcttctgatatatagcaaataatatatactcaatccactgagcaaaaattggaacctcaaggcaaagctgtatgtacaacctcagaaaatctgtgtggcatgaaataccgtaacgtacactgaaagggcaattttcgatttttgtgaggattcccaatagccaaatagaaaaaaagtgtgtatacatgtgaattggagatgacttgatattaaggattgtcagacttatgtcaccccattgtaagcatagatagttaaaatctatttgatttcattaaattaaaagtgtacattattcatcacaatccataatgtaactgaattcattcctatgaactgaattccaattagatttatcatattgttgttgtgaacaccagagaaaagtaggacagtcccacatctaagcaggaagataaaatatatatccgttctttatttccattttttcacttacttgttcaataaataatctatttattcaacaagcataatttctggctcagtattctttgcattagtattcactatgacattaataagaattaaatgctactttggaattttcacaagtaactgcttagtgattccagaatcacctggtagaaggggatatttaaattgcaacttaaaaatccaaatgttgttaaaagttttaataaaatttcttataaaaattacttcatatacgagttgacaaattgttcattttctccttgtagaagaacaattaaattgatgagatgtatcatctaactctcatacacgtaattatatatttgcatgacaaatacaattggcatctcatttacctcatttctgtacccttgaatatcacgtaaacatattttgtcctgatttttaaatactttgaatagtttgagaaccaaaagacctcttttgacaatttcctcttgataaagcaaatagcatcatcaatgtctccctaaaacttaaaagctaacagcctatgcttgaaggggcagaaaagtcaagttatttcttactttttagggacaaacaggttgtttatcattgtagttggagacaagatatatggaataatatataaacacatcttatcctatttatgcccgtcacctaaacatataagtgctatttttccaagtttattatcaaattacaaagtggaaatatggctcagatggtagtagaggtaaaaacaaacctaagtcatgtaagatgagtaagtctaaagatctaatgtacaacatgaagattattgttaataatattgtagtgcatactggtaatttttcaagaaagtagattttaggcactgatagtaaaaaagcaaagataaccatatgatgatgggtatgttaatttgcttcaatgtaggaatcacttttatatacgtgtgtatattatatatatatataaataaagataagtatctcaaaacatcatgctgtacaacttaaatgtatacaattaaaaataattttacaatacaactaagtttgaagtcatcctacatttaacagtatctcattaatgaaaccagcaaaattatcatgccatctttgcaagtgaaggaatactaacaatagacgttagcacatgcacagtaaaaatgggttcacagaagtgtggtcattgctctcacgttgcagtccacagaattttaagctatgttaaacatttatgaaggaacaagggaagtgcacaaatatgatttaaacctatttgttggtgtaacgtgatgcagttctatcccactcatcctataatacatttctttgacaaacaaaactatcatcgcaatcagttctttgaatattaaaattggatgtatagtcatgcatatgttgtgggattgtaatgcttacagactattaaccactgatcctaagatttgggtggaagtatttgtctctatatctaagcagctaaaatatcatggctactatctgtgcgtgtatgtgaggtaatttcagtctactgacaaaaacacaatttaatgtatgatatttattgagagcatcagcctctctcatttctaagataaatctctttttttccatgatggatatatacttgtaacaaaccatattgttctcagagaccacagctgctccctttttcccagggtaaatatgtcagtctcccggcctgaactgcccatttcttgaaggcaggagccacccatatgttactcagttttgtatttctcatggtgcccagctgagtgtctggcacatattaagtactcagttaatgatttttaatgaaaacatagcagtaagcctattttccttataattttatacataattacagagtactttcccacctagaaccttacaggattaagggtcattagaattcactattcatccatcttgaacccagtgaaattttgtcagatacaaagaaaggccataataattgtgtttctaagtggggacagtttatgtaccattagtgggctctcatatgagtgagaaataccaacttttacataccacattgcaaaatgtcactgttacatacctttagaaacaaatcaatcttaaatttttctttaataatcacagtatgctttaatctaagattatagtgccagtaatagtatatgccactcgaaacacaaatacaaatcaggcaattcattgtgtctcaaagcttttaatttaggtctaaatatacctaatagtcatctggttatcttctgaagtcaagcacaaggacaagaaccaaacttttaattatttgaggcaatgtattatattaacaattattagacacttaaggggaaagcttactataaattaaaatatttctccagtcctgacatctcttattactaccttgttataaaattattttaagattatgcctgtgacctgtgtgtgcttcttcaaagaaatctgaaatgttgcctgtgacctgtgcttgtttgtgaaatcaacattaaatgattcagctgatggcaacatacatcatctgattaatcatttaatcagagggtccataacactcaagtgtttaaaaataaattttcatgaagcccaacatgacagccatagtaagtcaaaggaaatgagtaaaaggatacttagatattatattcacaatgtcaaacctgacattttaaaacctgctttttttttattcatctagcacacaactggctagctatccttttatgaattaagtcaggattattacagaatatacacgtgtcaatccatttgaaatcaagatttaaaaaaagttgttcataatatattgatgtaatttttccaaaatggcattgcttaggaacttcattctgattttgaacaacaataaataacatcgctgaacctggatgttttaagtatccaaggcaacagacatttcaagcttatttcttgcgtgaaaactattaatcatcatgtagataagtcgtgtctcaatgggatatgataacgaagctgactgctgtattatttgtcaggcagtggcttcacagtttattcaggacttttgctctctaaaactccagaaaattacaaaaatataaaaacttcaggatccaactcttttagagcattccatgtggcatgaaagagatgctcattagttcagcaaggatttatttgagcaccagccacaagcaagacactgttgaggagctgggatagaccaagtgttctagtggctactccacactgcacgcatagtagcattacagaataacgctgattcaagtcactttctttgtacaatattcttagaacaagcagatctttcttcttcaatagaagtaggaaatataaattttctctatataacatcactgttgctttgcacttaaaatttctgcctgtgcacttttaacctgtttctactctgccaatgaaaggtatgaacttcaagaaatgaattgtatgactgataacttcttatgtgcacatgagtaaaaatatggatcaaaagatctattattctaatgtactaaacacaagagttaatattgttctgtaaaacaaaatcttataattcaagataactcatttgtcctttaactagtcttatacttagaaattattactaagggcagctacattcatatgatcaaattaacaaaacaggtatctgctttgatttactctcgatttattggttgttcagaattatgtcatttaatttccacctatttgtgaagggagagggaactttccctccctcatcaactagagggtgatggaccagataccctcaaagggcatgaaaggtgaaaaccggtgccattactccctttcagtgttcctgatcttaaaagcagagccattaatccacttctacaagctagacatccagtacccctacttgtcacatccctcttcctccaagtttctggcacagtgtgagcaaacattctttcttgaatgatgaatgagtgtctcaatgcagtcattaataagcatttcaagcaaaaagagtttgcttatttctatttaccagggtcattttgatcaaagtttaaaaaatgaaataaattatttcaaagttcataatgaacaaattaaatactttcattgaaaccatccagattttttagcatcccatagatgtgaccacaattgcagacatttattagagtattctttgaattattatagaaactcagaactttattgctaaattagacttcaacaattttctagtagagcttcctcattttatgagaaagacttttaggagatctgcgaaaggttatccagtcaggtggtgtatgagcagagaggaagactagccattttcactctcagtccaatgtttatttccacaactatgctgcaatttctaggttctatggcttcattttcatattagaaatcagtaagaaactatactacctataagggaaatatctccaaatgattaattttgtcacatcacttagatttctgctttaaatattaaaataaatagaagtatttttagatgggtggaaagcaaacccagttttgtaaaagattaagcactttcatgctccatttgcaatttatattgtatgccttaaatgcaggtgaataaaagacggtacatgtttccctgttgcttaatattctgaagcaataaaatcctctagttaaatctagttgtccataactgaatgtataaagacccaaaggaaggtaagttttgaggaagtgcttggggaagtgatatagtggctggaaaagtactactggtgtccagtctattccaaatgactgtgcaatcttggactacccacttcctctgtagatttctgtttcctcatctctacaatcagaagattgatctgaacagagggtctgtcaatggacttcccattaagctctttgatgtgcgtatgtgagtgcgcatttttctgaagctaagagggtctatagcttctattagcccgtgaaaagggtcggagacacaaaactgattaattgcctgtgtactaatttaatctgaggtccctcttaacttgtgaaatcttacgaagctataaatagaattaaaattttagatggaaaccaggaattaatataattattatccctaataagattatttgaaaagcatattttgtacaaaggggtaccaccatgaccaaccatgcattcaaacattagctgaagaacttcactagaagcccagtaaggatttgccatcattagcatccattgcaccagacactagacatgtaagtacatgtagtaaatctaaatatatcacagatatttttgttctgcctttttattatcagagttttaatgggctatcaaggtaaggctgctacttaggattacatgaagtggaaacaacccagaatagtttgccagcaaataaaacttctttctcacaattttcaagatattcatccaaaatcattttgattgtaacttttggatagctgaatagcactgttcttatactaagcatatgattataaaagacccagaaatgaaagttgttgtgcttactcacttccttccctccttaatttaataaatgtttgttaattgtctactgtaagttggaaactctcccagacacttgtgaaatatcaatgaacaaaataaatatatttcactctcatggtgcctacattctagaagggagaaataaaataaaaatcatacattaaagtaagcacattatgtattatatttaaaggtgaataacactttggcaaagaaaggaaaaagaaagaaaaggaaagaaggaaggaaggaagcaagaaagaaaaaagagaaagaaagaaagggaggaaggaagggagggagagagggaggaaggaaggaagggagaaaggaaggaaggaagggaaaagaaagaaaggaaagagagaaagaaggaaagaaagaaagaaaaagaaaaagaaagaaagaaggaaaaaaagtagggagactgggaataccagaggtgagaagaatggctccaattttatatagattagggcaggcctccccaagaacgtgtcagggcaagggtatgcttgatttattcaagaaatagcaaggaggtcattgtggcagggaaaaagcaaaaattattttgctgttgtagtggtgatgtttgtgaaacttcaacgttgttgacacctcatactgtattagttccatatttaaaatgaaagttataatatctttggtataatcttattcgtgtcccatgtttgtcaaaaaaattcagtcaaaattcttctcagaattttaaaatctacctcaaaactatatctctggttggtatgtattttaagtctctcatttcccacaaatatgtatttggcaatgaactgttatgtaatatgcagatatgccatttaataagagatgatgtcactataaagaaataagtaaaagaactttattttggaaattaggaaattaggcacaaagggatttgttactccaaggaagagaaattccaagacttacaattaacatgaaagccctcattctttctgaaatgtcactgttcctttggcattttactacattttttgtttcattaactttcttccagaaattgaaacaatcataataattataaaatttgcatggcatttatctgggttaatgcctgaaacaagcaagaccaatataaaggtagcactttttcacaaggggagggtcaggtagccgttccccacagtaagtatcttgctcctgcctccaggcctcacatgaaaatgaaccgtaatctcaccagcttataaatgtaacacaaaacgtacacagccataccttgcccaactggtcctttttgacaaagccagtggctgctgcaatgctccctgctccctccactgtcttctgggctactgctgtcacacccgtcaccactgctcctccaacatttgtcacttgctctttggtcttctcagccactggtacaaataaagagcaacaacagattaaagggtggtagaataacagtgacttaaaatcattccacttccactagccatcggcttccatacacctgtatctacacatgccatagataactgagtggtcagaagaaacaaaagccaccaagatgtccaagtgagtgtggttcaaccaaacattgaatcttggctaagatattttggctaaagtcatgcagtattaaaaagtgcttcaagtttaacgatcaggaatgtaaagccatgagtgatttggatttggtttatactatggaaagtttacagaaagcaattcttacaggtgcagttatatttgaaccagactcagcatgaatatttctttatttcaattcagtgccaatcctttgatctcactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcctcagtctcccgagtagctgggattacaggtgcccacaaccacacctggctaattattattattattattatttgtatttttagtagaaacagggtttcatcatgttggccaggccggtctcgaactcctaacctcaggtgatccacccgccttagcctcccaaagtgctaggattataggcatgatccaccgcacccagcccctacttattatctacgtgttcagacgtggtattatcacatatgtacgaataacagcataagaaacggttgtgaaggaacttggatctttttatagaacttcaggtagtgaaacaaagggttcttaaaaagctaaatttgcagtaattttaataggagcacaggagctagacagtatgaaaatgaagaggctattgagcacccttacaatttcttttcataaaacaaaatgagatacggtcattcagtagatttattaaaataagttaacatttttgagaagacagtgtaaatagtttgaattgagtttacaagcagaagtttaatttcatgtcaaaaactttcttgttcagttaaataagccagaaacagaaaggcaaacaaccacatgatctcactcatgtggaatctaaagaaaaagaaaagttgatatcatagaagcagagaggagaacagtggaggagagtggaggatggggacactcatctaaggaaatgaaggcacattttcttgacatgctttgtactccccagataagcctcagtctgagaggagttacaccatgtcagctgtttagtgctattcacatgactattgtataggtttcatctcaccagttgaagaagccaatatttacttatttatttatttatttatttattttgagacggagtcttgctctgtcacccaggctggagtgcagtggcacgatgtcggctcactgcaaactccgactcccgggttcaggccattctcctgcctcagcctccccagcagctgggactacaggtgcgcgccaccacacccggctaatttttttatatttttagtagagacagggtttcaccgtgttagccaggatggtctcgatctcctgacctcgtgatctgcccgcctcagcctcccaaagtgctgggataacaggcgtgagccaccgcgcctggcctgaagccaatatttaaatggtgtggacaaagcaatttgttttcaaatagactatgtaagctaagggggtctgtaaggacaagaggctttctccttagtacaggcaatgtgggcaagcctgacatagccacacagcccaagaccagaaacggtccacagtagtgttgctccctatttgtcttttaggctagaattttgtacaactacctaacaactccgtgccacttctaaggatatggctgatgtctccttaagagcaagagctatttacaattcaaagttcgatttaaatgccagcgaaaagctgtactgaaaatcttatgttttaaaacatttctgaaatgttgatcctttaaaaatagtcaattatgtgtttcaagttgtcatttttttccttttcaaggacgtgaattgaaaattttgcttgaaacgaacattttcttgttataaaatctcaaagcgagattaaaaataggttttgaattttttacagatccagccataaattttataatatctagatagccttttatatatgtataaattttaatctagttttaatgcaatacactgcacagtaaaatgtactctacacattattataattttgttgttttattattataatcataaataaaatggctacattacaaaatgacagagtgtacatgtagcaataatcgacacatttaaaaacatttctgtagaactgatttctctagtagggtctctgctgacctttaacctctatttttccccttgagggcctttcacactatctctctactcactgacattccaaatgacgggtgacaaaacaaaaggaaaagagacacactcatattagtacattttgggtctaataaatggtaactgtttttcggcaattgagttctttgaaatcagggattctgctttatttttctttatattatttcatagtagataataaataatttagaatatactaaaatgaatttagtgtctacctctaatgtctgcattaatataaataataggtttatatttgactttagctactttaaaaataaaattccaaaaaggaaatgtgataccaacttttagaatagatatagccaaatctaacctttgacattaaacaaaattataaaattaatatatggttttgaattgttatacaagtaaatatgtatatttaaatatacatatgtaaatatggatttaaagaaaataaatttgaaacaatttactaaggaaatttaaatcataatatgttgaaaattagttttgttcattatgatgtaataaatttataagaatcaaaaccttcagaaaatctccagtgttagaaatttctttatactatacttgcatgaaaaataggtaactttatatcatagtttatttttaaagtacctgaaaaaacatatcattcagtaagtttaattaaacacattttcatatatttctataatatgatgcattaagttgataactgaaataatttcctgagatcaaacagccaggatttaagttggtggatttttcattgatattatctaactaggataatttattttatttgaactttgtaggtagaaagttcccagcccaagtttactgaagtctgtatttctcccctgccccaccgaaaaaaaaaaagctaatgggatgaatttaggggaaattgtttctttaatattagaagataatattaggtactatgtaataatttcttgtttccctgcattaagacttgtagcaagaacaattaacaattagttagcacttaatatgtacccataataaacattttacatcaggcataatatgcaaattattctccctctctttaaccattgaagtgtaattatcttatttcttctcataattagacttaagcactttatattaaataaccctattcaaaaagttaattcatttatctgatgtgggagaggaatgattatgatagcagccgatttatcccaatgtgtttctcatagccatactagttatgacagcatttttggttatttcactactgccagggtggtccatgggtgcaatcgctgtaaatattgcacatgctgaaatcaccatgtccttactgcctagcaacatttcccatagttttctgtggaacactagtttcattcaaccctagtaactaatgaagaaagttttcaataatcaaaaagtttgaataaccctgattttaactatgtaatgcaaatttctttactgtaggacatctcagattccttaatacgctaaagagaaaataaagtatacaaagtctcccaacattgtacaatgttagaaacttaagattgtgagccactgtccttcagaaaacattttataaaatgtctaattgtacaaacttcagtctctctctctctctcacacacacgcacacacacacacacacacacacacacacagatatgtgtttacattttggcattctggaaaagactaaaaaaatgcagcccatctccacagtctccattagatcatcaggtgacagtaatagttgggttctttaatttttaccactgactccagaacttgccacatgcttgtctgctttctaaacctcatgggttcttcctcaactactaaatggaacaccattcatctaggttgaccgtcttcagatagtggagtctccacctgtctgttatctagttcttattataatcatgcttcacaatatcatatttataggaggtccctagaaggcatcatagtccacttacttaactacttctctgttggattgcaacagagcccattaaaggtgcacaattaacttctaacagaactagtttcaaaggagtctgttttatttttacactctgatttttaaatcaaaagtattcatttaaagaaatatttttctccactagttgtaaaaatgttgcacaagaaagttcactataaaactataagtaacacttataaaatacatattgtttgcttttgttttccagatgttttgtgtacattaattcactgaattattttatagatgaggaagctaaatcacacagaggtgaagaatcttgcaaaaaacacacagctggtaaggagtaagcaggaagttgaaccaagaagatctgactcctgtgtttttagtcatatccacaacactgtattaagattcccatatcattgtcctcatttccattttagaagtcagtgataggaacattttatttgtataggcactattgtgtttaatgctttccgattatataaattatatttctgattatatcttttgcttcaccacatctgccaggaaacgtggagtacttacaacagaaaacttaattacagcaagtctgtgggcttttaatttgttaaattttggttctcctttgatttctctatttctggcactctcatcctcatcttcctcaacatctgatgatgattatcatccttttcatcatttttgatatttcttgattgtaaacctaattgacttgttcaaattctcggtaaatttaggccaaatgaataatataatcagaaatgtaataattgcacaataatatttgtacaaatagctataccataacaatacaaagataaatacaataaacattttactgactgtccaagggtgtttcctgaaatgcactctgaattatcaaaggaatattgtaatcaacataatttaaggtcaaaatattttactgtaatcaacagaaattttactttttttaaaattatggcaatattcacattttatttttgtcagcagtttgtcaatacatttttggtcagaatatttaaatgcccacttactataaattaaacatagcttatcaattcaaagccctcattattcttggcaagtatattttttatttataatcaatatttacctatttaaaaatactttataaagaattcagtttcaataagactgatatgttcttagaatgctcagtgattgttttacaatttcataggaatcttgaatactgggccacactaatcactagatactttaaatatcatctttggatataagcacaatggagcttacctgttgccacaccatgcaccactccctccttggttttggagcctacaaaaacaaattcaagacataagtctcaagctagccttaaattgctgattagctagttttcaatacaactaatttaaaaatctcaatcttcagaagtatatatattattatatcttcagggaaagaaaaaaatatatatatatatcctaaaactagaagaaggaactccagtaaccaccacaataaatagaagaaagcccagctaacaggaggtcctctccaattacgattttagcacaaaataatgactttatcccctttgttcccacatcacatgtcaacttacagaggagaaaaaagaatgagataacaccggggcccagtgagaagataattttgaattcagaactgtagaagctttaaaagtacagcactagagacagatcagtcaacccatgaaacaaaagggaagaaggatggagagaaggctttaacatgtgctgaacacccattatgtaaaaaaaacattttaggctgggcgcagtggctcatgcctgtaatcccagcaatttgggaggccgaggtgggcagatcacgaggtcaggagatcgagaccatcctggctaatatggtgaaaccccatctctaccaaaaatacaaaaaattagccaggcgtggtggcgggtgcctgtagtcccagctacttgggaggggctgaggcaggagaatggcatgaactcgggaggcagaacttgcagtgagccaagattgtgccactgcactccagcctgggtaacagagcaagactctgtctcaaaaaaacaaacagacaaacaaacaaacaaacaaaaaacacattttacatatcatcttatttaatcttcataacagccatttaatatagttatattatgcccattttaaatagctgatgaaattaaaaatccgagttaagtaatttatgtaacattacacatgtaataataggctataagcacattcaaactagggtctctacacaggatcagaatttcttccaaaccttgaacattactaaacttgaatacaaataattattatgtgtattattaaaattatgcttgtaaaaaattgtattcatatcctctctaatgttggatttttcagtgtaattcacactgtataatttatggaatcggcatgatttttatgttttacagaattatcatactcctttttaagtttggatcagtttacaaaatgttatcatttgcactttaatgtcatgatatactgacagtgtatttaacataaggtgtatttttcagcaacacttcctctgggacaccttcactctttatcacaacctctttccccattatacggataccttcacctcactacgttcctctgactgcatatttagagtctcctgaattgcagcagtgacaacatcctcagggtagctacttcctgtatacatcaacttatgtttgattcaaattttacttccagaatgtttcacttcctttgtttgctactctttcatctttgctggccagtttcctcttttgattgcgcattttcgtgaaacatcacatgggctcaccactgggagacaatgtggccacacaagtccgggcattgctgtctgtatgaactgcataacagatgtgaagcaaccaatctccaaaaagctttgaaagaagtgctgtggttttgtcactgattataatgggtttctgttatttatgtaatgatttgaaggctgaagagttagcagcaaagtttgtactttatgcaatgactttcggtatactgtggtaacagaaatttgaattgtgttgttagtggctggtgttatttaactaaccatagtacctggaatttgtttgtgctggaactatgcagagtgagaacagctgatatttaagagaatatgtttcaatctctatctctcatcctcaccacctgcaccccatgttgtcttaaaaatgactagtagtaagaaatgtctaacagctggaatgcgatctttgttctttgccttagcagtacctaagaatttgacctttggttaaattatgaaacatattctaaatcaaagacaatgagatagaagtagagagtagaattatgattattagaggctgacaacggtaagagggaggggaggatatggagaggttggttaaagaatatgaaattggagccaaatatgaggaatgagttctagcattctgtagtactgtagggtgatatacttaacaatagtttattgcatatgttcaaaaatctagaagagagaatttttaatttttactgttcccaccacaaaggaatgataaatgtttcaggtaatggatatgttaattaccctaatttgattatcacacattgtatacatgtatggaaatataattctggatcccacaattatatacaattattacatattcactaaaaataaaagaaaaattaaaaatagagtagcatatgacccagcaatccctcttctgggtgtagatccacaagaaaagatttcagcatatctgtttccaagggccccaacacagtggctcttgcttggaatcccagtgctttgggaggctgaggcaggaagatcacttataactatataaggaattttaaaaacactaaaactaatatttatttatttagcaaaccagaatttaaaacattagaaattaaagtgttttatttctttgtaaaaaacttatcaagagtaatgtaaatagtgtttgtcttcttctcattgtataacttcctatacggagtggacatgttttttatattttacagaattgtcatactctattctaaatttgaattaggagtttgagaccagtctgggcaacagagtgagatgctatatctacaaaaaatattaaaaattagccaggcatggtaatgtatgcctgtagtctcagctacttgggaggccaaggcaggaggatctcttgagcccagaagtttgaggttacagtgagctatgataacaccactccattgcagcctgggtgacagcaagaccctgtctccaaaaaagaaaaaaagaaaaacataatagccacaactaaagtgtctactgatagataggtagataaaaagattgtggtacatagatacaatggaatatcagtcagccctaaaaaaacaagatcctaccatttacaacatggatgaacccagacaaaattatgctaagtgaaataagccaaacacagaaagaaaaatattacattatctcacatatatgtggaagcttgaaacaaaattcaaatatacagagactacgtaaaaaacagggttaataggggtggaaaagtaggtagaaaatagggacatataggccataggatccaagcaagtagcagatgtgtaagatgaaaaagtgtacagatctaatgtatgaggactgtaggtgataaaattgtactatatttgagattcatgataaataagtggattttagctgcccttgccacaaaaacaacaaaaaaggtaactatgagagattatgaatatattaatttgcttcaatatagtaattttttagtgtctaatgtatctgatagcatcatgttgcataccctaaatatacacaattaaatttatttttaaaaaagaatgccactaggccgggtgcaatggctcacgcctgtaatcccagcattttgggaggccgaggtcggggatgatgagatcaggagttcgagaccatcctggctaacatggtgaaaccccatctctactaaaaatacaaaaattagccgggcatggtggtgcatgcctgtaatttcagctactcaggaggctgagtcaggagaataacttgaacccaggaggcggaggttgcagtgagccgagatcacaccactgcacttcagcctggagtgaaatgacagattgagaccctatctcagaaaaaaagaaaaaaaaaagaatgccactaaaccacaccattagaacttataattaattattttttataaatatcttatgcaacatattttatatttttgtagtgcaaccccaaagagataggtatataacttaaaaaaacgagataaatgagagtcctcataaggttaccatgtatcaaaccaatcagttgttctttgaggtcataattatttactaataatctgtaattgatggttagcctttaatttatgagtaatctgtaattgataacgtacacctacaaaataggtgccaagtggttatgtgactagcaaggtataaatgctgtagggacaccagagctgatggcttccctgagcggaggtgtcccacacacaccctatcttgtcttcccaacctcaaaagagcacagagtggagaagaaggtcagaagtaatacctgagagttttgagaactcagttatccctgttgtgcatgttatgttgactttgtcagcttagtgaggtgaagcacattttgacttgagaatttgctatcaatttcactgatggccactgctgcttattgagcagagtggcattggaagacactcaaagatcatcattttcttgtatttattgcatttatattactgagcattatataaagataattaaatctttctgcttttggatttagatctaattaatttctgagtcatttgaagaaatttttgtctattaaattgaagtatgttgattgaaaattggtgtacgcagataacaaaaatggagggaacaaaacccataaaaataacactgatcattaaggtagttcttcaatgagttaaaaagtagttgttaaaagtatattcttataaaggaatgagattacttttcttatgaggcttctaccaaacatcttcagccataagtgaaattataaaatggtctttggtcgcctccaatctttcaaactagttatgtaatgaaggataaaagaataaatggaaaacgtgttggcaaagtaattattccgttggagagtttatttgataataataaccatggttcctatatataaaagtgtgctcaattattcatatgtcctgtcttattatgacattcccacaaaaactgcaaggtagttgcagttttctaaatcatattttttactaatcagggaagtgatgctcagagatgttaagtacgcttccccaagaccctaaaggtgataagtgatgtagtctcaactaaaactttggtttgtgtgattagtgcatgttctttccactctatcagtagtcagcaagctacaacatacaagacaattccagcccaccacctgttttgataaatgaagttttattgggacacagccacactagttattgtttatgactaccttcacacttcaacagcagaattgagacatagatttttttttcttttttttagacagggtatcactctgccacccaggctggagtgcagtggctcgatctcagctcactgcaacctctgcagtgagctgtatggctcaagccatcctcctacctcagcctcctgggtagctggcaatacacatgcatgctaccatacccggctaatttttgcgttgtttgtagacacagggtttcaccatgtggcccaggctggtctcaaacccctgggctcaagtgatccaccagcctcgggctctcaaagtgctgggattaaagacctgagccacggcacctggccaagacatagatctcatggcttaaaatacgtgctatctgattccttacccaaaattttgccaatccctggactatactattgtgtcttcacatggtcattttttatcttaaattctgtgtgtaagttcaactctcaattagaactcagaatgtaaccaataaaaaatttatagaatgtgctatgtgttaaatgccatgagagacattgaaaatgatttcaatgaacagttaaaaggtaactaagtcaaagaaacttgtgcttgcagaacttggaaatctgaggacaaacggaaagatattgataaactgcatgtcactgattcagtattccaaattccatctaaaaaggtataattcacacttcataaaatatttaaaattaactcatcaattttttcctcttgtaacaccctatttcaatgactttctgaaaatatgttttaaggtagaaaaaaagtaatttaattgaagatttgtgggaagattaagtcaacataagaaaagtctaaataatgaggcagtggcacatgcctataatcctggctactcaggaggctgaggtgggggcatgacttgagcccaggaattcaaggatgcagtgagctatgatagcatcactgcagtccagcctgggcgacagagcaaggccctgactctaaaaactgaaaataaaaaactgaaaaaaaaatgtgttgtgaactttgatgagatgcattcatataaatcatcccaagtataaaatttcccccactgatctatgttgaagagatagtgtagctttctttcactttgcagacatagacggagcacatgtttcagctaggcaactcaatgtggtcatcctccacctgactgttcatcctgtgactcttactgctatagttgccaccagagaatgtgaaaaagctcagaggagaaagaagagaggaagaatgggcaatgtgtctgtgttgagtgtgtgtgtctatgcctgtggatgagagtgtgtgtctattcttttccaaggaattcaaagtggtttgtaaaataacactcaattgaatacagttcaagttacagaaaagagagtcagagtttgggtgtataccccaaggtggaactttaggaacaagtaggtaataagcatcaatttctttattcttttagtatgtgtgtcatttgatggatgaactatacaaatgtttctgagagattagtagcagccctcaagcacttttctctgtcctcagtgttcacagagaccaaatgatcacatgaagtaactctatcaaagactaatctgttctttccattttagggccacaaataggtctctttatacacatcacaggggcatatcaaagtcatattttaaaaatcagaatggattaaaattgacaaacatttttcatgatggtaaaagaaatcacagatccatcaatgattttgattcttaagaatattcttgattattttttaaaagactatgagtttttaaaactgttctctgaaatagaattatgtaggtacagaaacattcatttttaaaaagtcataaatattagggcaaaattaaaaatctggaaaagcaaacagtcgcattttttactattagctcaaatacacacgttcacattcacctacctacacatacctctgactcagtccacctttttgacaagcaatgatgcaaaaatgaatcaagagagagaactaccagcatttagagtattgattatcctaacccatcactcatgaacaagcaccaaactgacatttggggtttacctacctacatagagaacaccctcttttgtctttcctgctgcttctgccacaccctgtttggttttctcagcagcagccacaactccctccttggcctttgaaagtcctttcatgaatacatccatggctaatgaattcctttacaccacactggaaaacataaaatacactttgaatgagaactttcggggaaaaataaacaaaaaacactgaaaaatcatgagaaaccctccaaagtgtgagactcttttaagtgtacactcatttaaccattggacaaagcagacatttttagctctggcattaaaaatttagcatctcccatccatcttggctagtaaaagtctagccacctaaccacggattaggatgaatcctctgagttgttattactgcatttcagaagtggagttgcatgaaaagattaaccccttttttaaattcccggggtctaaagggtaacagtatgagttagaagcatggaagctggaggcttagggtcaggggtatccttaacatgaatcccagaagaaggctaacaggttgatggtggaaaggcgtaggcaacagaactaactgctcactcggggtgtggttcaaactcaggcaaacagcaggcccaagtgtgatggttctaatccatccaacatccacccccgccctcagctatctaccctgagcaggcgccgctcacactcgcgggccgtctccaaccccgcgccagccacccgagggggcgttctcagcctccaccctagcggaccccgcgccagcacttgttaacccgttaccacctgttgacttggcctccttgcacttccatttcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatctaggaagagccggaaagggtcctgagggtgaaagggagactactaaggaagagtcacaggttgaggaggcaggagaaggctcagcaaatcctctttccacgccactatcaccattttcctttccaccaatcagcgcctgccagacgctgattttcccatcagtggaacaaggaataaatattccccagccgtctaaaacaagcggtcctaaggcttttcgctctagaaatgggacttactttgcagacctccctttatctgggagacaaatccagcgtgatttagcctaccggaccatcatatccaatttcttcttcagccccttctgaaagggagatgctacacaccactcacctttctgacttctgattctcgttgccctcagaattgacacccccttttctctccccccacccaccacacgcacatgcacacagacatacacacgcgaacttcaagacaatttttgcatcgcttaacacattttcacctctttcagagctggaagacagctgttcctggatcacaccagaat

SEQ ID NO: 2026 - DNA, 112878 bp, Homo sapiens; identical to SEQ ID NO: 2024

SEQ ID NO: 2027 - DNA, 82435 bp, Homo sapiens
gctgagcgcgggcgcggggccgctacgtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccgtaagtgacaagagacccgctgagggggcctcccctgcaccgcccaggtggggacggcggcccttctttccagaggcgcgggcccttcccgctgttcccaggtgcccgcacccttgcgggctggaaagaggtttgggtcccttgggcttggagcagaggagccgcctccttttcagccgaggtgtgccgggcagggagaaatgatcagcgcggtagagcggggagatggagcgcgtcgatccagggattcttggctaaaaagacaccccggggagagggtggggcagaggtggattctagattacggaagaagtgctgtggcaccttacaccaggccgggtagaagggggtggggaggtggtttttaaaatttatttatttatttttttattcattcattaacgggtagccttgagttgaggaattgggaggggtaggcaggtttattcgtgggattgtgggattgagggagaaggcccaggggaaaatccatataattgactgattatcagatttggtgaccaggaaagcaacagcctgtttttcagttccgatgcatcatacttttctcaaattacacggattattgagggggatcgtcacggaatggggagcaacatgtcctgctgaaaggaagggcttctatctctacaagacacgttaaaaatgatggtatcagaaaattagaacggggaggaggcttgcacatgatctccatcaaacctttcattttacagacagggaggctaaggccgagggacgctgagtgttgggaccaggatcattcagccagatgggagcagaaccaggcctacaacctggcaggcttctgacttccaccccggagttatgtccacctctggggcctgggaactgggtttggattgcataagctccccctcctctcccaggagggggctgggctggaggctgaggccttcgccaggaagaagcagggactgcttggatagttgaccagcttctgcaggggctcctcagtgagagaatggaggtgaggtcagggactcctgccttgcctctgccatcacttccagtgatgcctattcctaaggtaggtacatagctggaccttcattattcttaatattatttacttttttctttttcttttgagacaaggtattattctgtcacccaggctggattgcagtggtgcgatcttggctcactgcaaactccacctcccaggcttcagtgatcctcccacctcagcctccctagtagctgagaccacaggtgcgggccaccacacccctggctaacttcggtattttttttgtagagacagggttttgccatgttgccccaggcaggtctggaagtcctgagctcaagcaatccacctgcctcggcctcccaaagtgctaggattacaggggtgagccactgcgctcggccttttattactattttttaaaggaagggtagacttgagattgactgatagggcagtttttaataaaaatacaaaaataaaatacatttagaagaaactgtgtgaagatgtgaaatatcagtgattagcatggactcaactggtcgtcctgtttcttctaccagtccatttcattctcacttttgattaccatttaactggggaggacatcagtgttgacagtgggacttgctcaggctgacactgtgccccaccagggagtctcccctccaggctggtacacacttcctcttattttactaatgggaaggacccctgagttaggtaacctaaagtaatagaaataagcacgttcattaaaaaaaataaaagtatgttaatcaaagagtaacgttggtgttctacagcaattctgctgggctttggagcagtggatatcttttctcagccctaggatcactactttcattttaaggcttcattttgctcgttaagttactggggaaaataacttcttttttccgtttttagtgacagggctgtggtttcacaaccacttggtgaaaggcagacaactggttgagaacaggggccagtctatgcagattttcatttcctagcatggcggagaagggcttttggccaagctcatggttgactctgtggggaatcccccaaatttagcattgttatctccaaacatctttttcttagtaatctggtaggtatgaattagctcttctgttctctaagccctgttcaaagaggaaggtatatagtgtagtggttagaacttgtgattccagacccatctgagttgaaatcttggtataataattttctaagtatagttttgttggcggggcacttaacactctctgagttgcctgttattcagaaataaaaaagggtgatggtaatctttgcttcccagaactgttaatacaacagctgacatttatcgagtgcttactatattccaggcatcgtgacattatcgagcacttaattatgggccaggcattgtgaaagagtttttatgtggcagtctcattaagcatcacaacagacttatgaagcagattctgttactgtcttcagtttacctctggggaaactaagccatcagagtatttatgatttctctaaactcagcttacagttttaactacccaacaaatgtgtgtcagatttctgttataagctaatagttatctagggcttactgtgtggtaggccctgttacaagtgtcctaagtacgttaacaacccttgagataggtattgtttttctccccttcttctttctttttacagatgtggaaactgaggcacaaagcccaaggtcaaacaactagtaatgcgagagccaaaatttgaactaggagcctgggtctggaatcagtagtaactctcagccacccacctgcgaatgtaaagggcttagccaggcttcagtcaagggcaactcctattgatacttacatttatttttccctaagtaactactccttgctcccagtttctgcagaagagatgcttttagttctacaagtgattcaactttactcaaggctttgtgattcagtatgtatttctattgtagtctctgttatttttaaaatcttgtgctaggcctcagtgatcttgcctctggggacagggaaatagtctttatcagatctgtgaacccctttcaaatatatgatgtcatttttacttttttttttgatacttttgtagagatggggttttgccatgttgcccaggctggttttgaactcctgagctcaagtgatccacccacctcagcctcccaaagtgctgggattacaggtgtgagctactgtggccagcctgatttcatattcatctgcaaaagtgcattattctgggggagagaatctgtagctttcttcagattcttacgtggtcacccatggtggaaagaaagtcattattcaccattttattctaataatctcattttacaaatgaggctaccaaggcccaatggagaggcagaataacttaatctgaactacacagctaattagaggtaaaaacgggactcaaactcaggttcctgaacttccagtctcatattctttccattatagcctgatagttccctgtggattaagtggtgccagatcaatcaattacgaattgccagagacccccagctctctcaccaagctgtccaatgcatgaggccagcaaagctgcctggaagtgcctgtcaaaatacgacatcgtttggcatgtgatcctgttagctgagccactttactctgatttggtatgggaatctacaactcggagagatgtgagccaggaaaagaaaagctgtttggggagaagaagaggaatgttgcagacatgcattggttgaggcacaggcagccattcagacctcttggtagaattgtcgtattggaaagtttttgctaagagatttagaaattcaaacaaaattccctgggccgggtgtggtggcgcatgcctgtagtcccagttacttaagaggctgaggtgggaggatcgcttgagcccaggaggttgaggctgcagtgagctgtgattgcaccattgtactgcagcctgcacaacagaattagactctgtctcataaataaataaataaatacaaataacccccaaattccctgaagtctgagatttttgcatagtatgtggctcactgggaagtaagccatctcctggctgaagggtgatgctccaacgacaaaagaagactaaaagagttgggttctggtggctcacacctgtaattttagtgactgaggaggctgaggtgggaggattgcttgaggtcaagactttgagaccagcttgggcaaaagctgggtgtggcggcacacacctgtagtcctagcttcttgggaggtcgaggtaggaggatcacttgggcctaggagctggaggctgcagtgagccatgatctcaccactatactccagcctcggtgacacagtgagaccccaactctaaaaagaaatactaataataagaaaaataagaaaagcctaagaggtaatgagacctttaatagtttaggccagacttttaacacgacttaaattttacaaactgataataataaagcttacctggaaaatagatttgtacttgtaggcaatacatttttgaaaaagaatattgaggagaggcttgttcagccagctatcaaaatatatcaggtaggtaggacgtggtggctcacgcctgtaatcttagtgctttgggaggctgaagctgaggattgcttgaggccaggagttcaagacaagcctgggcaacatagaccccatgtctaaaaaaaattttagaaagtatatatcatttgggactatgaatagaaagtcgagaaatggttccattgtaaagacaggaattgagtgtatgataaaatggactgttactaagtcttgggaaaattgcctctcaatttggaaaagattagatccctgactcataccattcacaaaagtaaattccatttaaagattaaatgtcaaaaccaaaattataaatattaaaatatatgtaaatatagaagatggttttaaagagctttttgttgttttgagacggagtctcgctctgtcgcccaagctggagtgcagtggcacaatctcagctcactgcaacctctgcctcctgggttcaataagttctctgcatcagcctcccaagtaactggggttataggcacccatcatcatgcctggctaattttcttacttttagtagagacagggtttcaccgtcttggccaggctggtcttgaactcctgacctcgtgacccgcccgtctcggcctcccaaagtgctgggattacaggaataaggcaccgcagctggccagaagatggtttttagaaataactttggtgtaggaaagacctcaagtttaataaaattcagagaccataaaggaaaatattgatagacctaatttcatgaaagattatacttcatgtctagtagtttatttgaacatgaactttggctacatttcccatcttcacagctcaggcacccccaatctgtccttccccactgcagactggcaggtgggatttcccccaggtcatcctccttccttctttcctcacatctttcttcctctgcaggaaacagatttttcagggccttccatacctgcccctttgtttgtctctccttagttataagtaatatttttagaaatacatgtaaaatatcaagaaataatggctgcacctctgccgcctctctctcacctcttatttcataaagctggctctatatgttgctttatgtgccttagtatatgcttatggatattatatatattatagatatatatgtaacacattttttaaaaagtaaggaagaatatattaataccataaacaaagttaaaaggcagatgacagggctgggcgcggtggctcacgcctgtaatcccagcactttgggaggccgaggcaggtggatcacttgaggtcaggagttcgagaccagcctggccaacatggtgaaagcccatctttactgaaaatacaaaaattagctgggcatggtggcaggtgcctgtaatccaagttactgaggcaagagaatcacttgaactcgggaggtggaggttgcatgagccgagatcgtgccattgcactccagcttgggcaacagagcaagactcagtctcaaaaaaaagggcagatgacaaaggagtaaagcaaatagttgcaatatctataacaggcatgaactcttagaaatcaataggaaaaacaatccagcaggaatatgggcaaaggctattcataggtaattcacatatatatgtaaaaatgcttaatcttattaataatcagataagtgtggattaaaaaccatgaaacctttttgcttaggtttgtaatatccagtgttgacgaaggtgtgggaaaatagattgtcactatatatggcggagagtgtaaattggtaccatctcttggaaaggcacgttagcagtatttataacattttaaagtttgcatactttctgatcagtacttccacttctaggaccttatccctctgaaatacttgcctacttgaaaaaaggaagttgctccaaatgagccaaaatggaaaatgttcattatgcattatgttagtcagtttgggctgccataacaaaatgccatagactgggtggcttaaacaacagaagtttatttcttagggttttggaggctgggaaatgcaggctgatttgtttcctactgagagttctctccctggcttgcagacagccgccttcgtgctgcgtcctcacatggtggaaaaagagagaaagagaacaagctcttggtatctccgcttggtgtctcaccagtcccatcacgagggccccacccttttaacctcatctaaacctaatcaccccatcagaggccctgtttccaaataccaacacactgggggttagggctttactatatgcattttggcaggacacaattcaacctatactgtatattaagtaatgaaagcaaagtggaagaacagtgggagaaatacaatcttattttttgaaaaaatctggaaggatgatatgcccctaattgtagacagtcattacctgtggagagtgagattagaaagggaaagggaatggcattatggaggatttcagcaattttttttttttgagatggagtctcgctctgttgcccaggctggagtgcggtggtgcgatctcggctcactgcaacttctgcctcccgggttcaagcgattcttctgcctcagcctcctgagtagctgggattacaggcatgtgccaccacactcagctaatttttgtatttttagtagagacggggtttcaccatgttggtcaggctggtggaccttgtgatccacctgcctcagcctcccaaagtgctgggattacaggtgtgagccactgtgcctggcctctgattttttttttcagctcactgcgacctctgcctcccaagttcaagcagttcttctgccttagcctccccagtagctgggattacaggtgagcaccaccatacccagataatttttatatttttagtagagacagggtttcaccgtgttggctggtctcgaactcgtgacctcgtgatctgcccgccttggcctcccaaactgctgggattacaggtgtgagccaccgcatctggcctatatttctatttttttccccaaactttgaaataattttaaagtataaaaagtgcaggctgtgtgcagtggctcacacctgtaatcccagccctttgggaggctgaggtgggaggattgcttgagcctgggaatttgagatcagcctgggcaacatagtgagaccctgtctctgttttcaaaaaaacttttaaaaagaatagaaaagccgggcatggtggctcacgcctgtaatcccagcactttgggaggccgaggcgagtggatctcctgaggtcaggagttcaagaccaggctggccagcatggtgaaaccctatctctactaaaaatacaaaaattagctgggcatggtggtgcatgcctgtaatctcagccactcgggaggctgaggcaggagaattgcttaaacctgggaggcagaggttgcagtgagcagagattatgccactgcactctagcctgggcaacagagcgagactctgtctcaaaaataaataaaaataaaacaaagtgccaaaataataatttttttttttttggcttaggggagtagggactgtgtcttgctgtgttgcccaggctggtctcagactcctggcctcaagggatcctcctgccttggctcccaaagggtttaggattacaggcatgagccactacatctagccctaaatcttttatttttaaagataataagtctgttatcctgaaataaaataatacttaagacctgtggaaaaaaataacaaaatgatttgaagtattaacagggccctcctgcctagagcctcccagctgaactgcctagggaggggtggtctctgctagagtggaagacctggtcctctgaatttccaggtgagtgttcccagttgccttttctgctacttattttaaaaggtttatcccagcctccatctctgaaggcaggatgtatgcagcaagagtattgcttaattcagaagggtgatttaccctggatttcgtggtctttaagtgctttaaaagaattaggccgagcaccgtgtctctcactgtaatctcagcattttgggatgctaaggtgggtgaatcactggagctcaggagttcgagaccagcctggccaacatggcgaaaccccatctctactaaaaatacaaaaattagccaggtgtggtggcgagcacctgtagtcccagctactcgggaggctgcgatgggagaatcacttgagcctgggaggtggaggtggcagtgagccgagattgtaccactgcactccaacctgggtgacagagtgatactctgtctccaaaaaaaaaaaaaaaaaaaaaaaaagccatcatctctcagtttagttgtgttttctgagtatagcttaaaactagttatgttacttcatcattggtattcattggtgttttctcagcatcactatcccttcccaaatccccccaaaaaccacacacagagtgtatgtctaaccaggctttctggcattaacaaggccagatcttatgttactcattggtatagttaaatgtgtatattctcttgtgctcaagaaaggtggctggcaaggcagaatttataatgaactacagatgtcatgtccttgattttttcttttccctatgtggtccgaatcccttaggaagataggaaagggaagtcttgagctcctttttagattcaggctggaaatgcctactaaattcctaatagcttccaaggtgctgtgccttaagaagccttggattcctggggatgagagaacaaaaaagagggtgagggggaaccaaagggggcaccaaaggccaaagacagacttcacccaggacaagtcctgtgtccaaggagtgtgacaaggctttctgacatgcttccaggaacattttgtgtttatttggcatggcatgttttaggaaggagatggaaacatctatttagtactcaaccatgtaccacacactgtcctgggtacttcagtttacattatctcattattcctgtgatataggagatgctacagacattttcgacaattcagagatatttcatgacttgaacaaatggaggagacaggatttgagccacagctgttcccatacccatttttttttccagtactttattttaagagtcccaccattgagtttgcttttagagtcaaaatgcactctctctgatttaaaagttttttattaagggaaaaatttaaaagtcatactgggtacatcgttaggcataggactctgaggttaccacttctgatcctcaaacataatccatgtagattataaaaggctgtaacttggggactgggtcatacgttttttcccttataccatagacaaccagggctttgtaaaatacctcagagcattttaactttgacatcagtggtgtgaggttattttcatctcctttttttccaatctcccttcccattttccatctcaggtgtgcattttccttctttgtgcctttttatgcttccttgattctgcaaaggtccctttagcatgtggtcaaagttctctgggtatcagagaaacagaaagacccatctcaagctgtgtgggcccagaatcttacacagctctcatcagtgtagggcacttgccctgacgtgaccttgagagccaactcctttgcaggcaggagatggactctacgcaggctggcaccagcagtgacaatgggggccacctctgcagccccaagacaaccccacctcagcactgtgtttccattcacatggtctccctctgtgtgcagcaagcctcctctttcacgtttttgtacagcttctctcttaagcacagtacgccccagcctggcctacgtattgcccaggaccctcgggtaataccttactcgtcttgtgtgttgtgcactcttattctttgttttcaccagcgtggctgctttctgcggggtgcaccctcggtttctggtactccctgctccctggtgaccacttttgctgcatacccacaaaggctgggcttggagttctgaccccagttttgccatcactaggcaaaatctatttctggcctggcagggtggttcatgcctgtaatcccagcactttgggaggccgaggcgggtggatcacctgaggcccggagtttgagaccagcatggccaacatgatgggagggcgacggaggttgcagtgagccgaaatcacactgcattccagcctgggcgacagagtgagactccatctaaaaacaaaaacaaaaacaaaaacaaaaaacctgtttctgatggtctcagaaatgagagagagaatgagaggaccctaaaggaagggagatcagaggtaacacattgattaagaatcctcctcagctaaaatcagctactaagaattagaatgcgttagcttcaactctgttggtggcagatcccctaaagtctttgaaaggctttgtcatgattctttcaagattacagtattcttgcaaattcatccctttgtgcttcagctgttgctggttttaaagaagagaaactttcctaagttagcattggagttgggggcttaatgtaaggatactgcagacaactcaaaggcaactgcttggaactggaaagtcaaaaactgaagctgcactttcactcctctcccaaggcccaagtcctctaactccccgtcgctgtttctctggctggggcttctctacttgcacatggttcagtgtggcctgcctggccctgcctgcacacagcttcccatccaagggctcattgccctctgatgcagtctttcaggctcctccgaccctctttgtacatttttgtcttcatcatgccgaactcctcacctttcctctactcatctggccactctgctccattcccttgcttgtttctctggtttctctgattcctccaattgacagctccttggggcctgttctgagccctcttcttttctctatgttttctccctagatctgtggttttccaacatttctgtgcataggaattatctgcaaaacttgttaaggcagatttctgggtctcagtattccaattcagtagttctaggatgagacctagggacttgtatcttattcctgggtgatccagaggctatgacacactcaggacaagctggtttcattctatgactttaagtgttgttaataaactactaattccctggtgtggatatctagctctcttgagagctccaggtttagatatttaacattgaatttgactgtggcttcttgggtttgtcacagacatttcatattaacttgcccaatacttgatcctctccccagttttgtaagggcctaacacttacatagtttggggtcctctgtaagaaaaggaacatagaattgagaatacaaagcgagatgtgggaacgtggtggtgcactgtgcagattagggcttggaaacttggcttctgtagccttgggtcactcctcctcggcttgcctactcaccccagcaccgtctcctccagccttccccatctgaatgaaggcctatgccttccatttgtttgtttagaccagaaacctaggagccgtttctcatcttcagcccacttctgagctctctgaaggtcttgcttgattctccaattcagtacccccttgccccgaatctcaggttgccattgttactttcctattagcttctgatcgagtctctctggttccactttgttcccctccgatccaatttccagaagcagacagagcagtcttttaaagtacatcagaacgtgtcactccagtcctgccatgtgtccatagaaatggctgagtctggtggcagggccaggggtgtgggcagatgggagagggtcaggggggattacaccgcacaagcttgactgtcctggaaccttgaaagaagtgggggtgtgtctggggaggtatgcaagaattatcaactgcagttgtttgtttcagtcccactttaccacatttcattggaagaacttgagctgtataaggcctgtgaacacaaatggggatgggtactccctaattctttgcttttcagtgcattcctgtggcatttgatgctaaatagtgcaatcaaactgtttaattacttttggggaagaatcacacattcttttttaaccccggtgtcatcttttaactccgggttccttaatctccttagagagctgattaagcttggtgagaacccacaggtccatggcccaggtaaatccaaagcccggcccagggaaatccaaagccctgcccaggttttctgcgaattccctggaggagggggtggatgggggaggcctcatgtgctttcttttttaccttggtgtcagccccgacacaaactcagccccttccctcatggatggagaaatccaccaccactactaccatgtgttttgttagttgagtggacttcactggagtcccctgtggggctcctgatcttgcatagtctcctgggtccctctttcctcctctcatccctacccctcactccatccccctcacttgtccgtgagctccagtcttcttcctctgtaactatggatactccccagttcctctcttcaacttacaaacccaagtcaaagtacagggcagaacaacgggctttatatgtagggaaccaacactccttagaagttataaatacaaacacacacaaaagagttttctatcacactgtaattatcttcccctttctcactgatgtagcagctcttattgtagagtggcgtttggaagagctggggagaagatgtgctcttcctgctgcccccgaaggtcactgtctggattagggggcaggcagtgttactgtagctctgggctctggaatctcacagcaaacaacttggggtctcttcatcagcttgtctgcagatgatcagaccctgagaaactgagctctttctgtctaaacacacaggaaacttcctatgttgggaaatcagcttaaagatttacaaccagacgcagaccggatgctgcgatttgctagtcaccttgcttcactagtggttgggaaaccttgaaaaacggtggcgtctattttgaggactttgccaaactgagtctgtagacagacacatgtcaaatgcccttggattacagtcattattgccagcaagtaagagtttaagaataataactttggcatttcacccacttctgttattttaaaaattatttatttattttagacagaatctctctctctgtcgcccaagctggagtgcagtggcgcaatcgtgggtcactgcaacctctgcctcccagggttaaacgattctcgtgcctcagcctctggagtagttgggactacaggcatgagccaccacacctggctaaattttttgtatttttttttttttgtagagacgggttttcgccaggttggccaggctggtctcgaactcctgagctgaagcgatccacccgcattggcctcccaaagtgctgggattgcagacgtgacccactgcacctggccacatttcacccactttttaaaaggactttcttgtgttacttatcttaggcttcttagatcaaggccaggcattggacatccgtgagtaaatgatccaactcttgcagggagtggccacagtgtggctgagtttcagagcatttagatttaaaatattctgctccctaaacattattatcctatctgacaaaaaagatgcttgaagagaatttttttttttttttttgagacagggtcttgttttgtcactcaggctggagtgtagtgatatgatcatggctcactgcagcttcctgagctcaggtgatctcttacctcagcctcctgagtggctgagactacaggcacgcaccaccatgcctggctaatgtttttgtatttttgtagagatgggtttcgtcatgttgcccaggtctcgaactcctgggctcaagtgatccacccgcctcagcctcccaaagcactgggattacaggcatgagccaccgtgcccagacagaaaatttttgtaaaggaacaaatgctctgtgatcatgaggaaggcacctcagcatttttcatattgggggtcctgggaaagtctgagaatgaacagtgactgcagctggcacagtcggagccaggcacaggcctccatgcttgctcatttgatctttacagtagatcatgaagcaggcagttatctcctcttacagatgagaacactgaagcacagagatgaagtaatttgggaaagggcagaatgtgaattcacaaccaggtggtctggagtcaaatgcctcacactacttttaccactcactgtgctcatcctgctcactttaggggggcattcccctctaaactgctcctcagcagtggatcttcatgacagaggcaccgtgaaggaaagagggttatttccagtgagttgcgatgcttttcctttagaaaagagaatttctctctctgtttaaaagcagaacattaaatgttgaatttttttctctcatctgcatccctgtatcctttccttatctcagccccaagctgctctccagacgcctaaagactgtctctcccgtctggatgtccccaacaccctaacatgttccagtttctttcttacctctcaaaacagccccccttttccaacttccccattctgggaacaccagtcttcttccagtcacccggcctgtgagtcatccttgactcccttttctcaatcatgccctgtgtccaagtttttcttgttgtttattcatttatttgtattctttgagacaggatctcactctgtcacccagactggagtgtagtggcacgatctcagctcgctgcaacctctgcctcccaggctcaagccatcctccaacctcagcctcctgagtagctgggactatgggtgcgtgccatgaaacccagctaatttttgcatttttttttgtttttgttccagagatggggttttgccatgttgcccaggctagcattctttttttttttttaatagtctttattttttagagcagttttagattcacagcaaaaatgaaagtacagagcttccctgctccccataacccacctctcccattatcaacatcagcaccgtgggggtacattggtaacagttgatgaacctgcactgatacattatcatcacccaaagtggacagtctgtagtttaccttcatcagtcttttgatgaagctcatggcttgtaatttctctccctggcaatccttccaacacccatcccagatgaatcactgccatcatgtcaagcttccacttactccatccctgccttccaacaggatagaagtccaaattcctccttttgttcttcagggacttcccaatcctaaaatgcttaccacagcctgtgatattatgatatatatgttggttttgtccacagttcctggcccataaatcccatagcccttgttacagtgtttgggtgttttaggcctcagaagcaggcctcagaaaacagtacctcttgctgactttctcctgttctcccttcaacctgctcctttttctccccaaggctaatcttcccctgtgtttccataaagaaattctcagacttaccttgtctgattgtagatcataagaccctcatttcaggaggggttctgccctttaccctgggggaagcaatgttgcaccaagcggcccagaagaatctgaacagacaggcctttctgggttccccactcagtctgttagtattgggtcatgtcctttttgtccaatcatatttctgcatggttgcccctgcttcagtcatccctgttcaatgaagtctgtgtaaaaggcccaagaggacagggtttggagggcttctggaaggctgaacacgtggaggttcctggggggtggtgcacctggggaggtatgggagctccatacccataccttgtcctgtgcgtctccatctgtgtcctttgtactatcctttataataaaccagtaataagttttgtgagccgctctagcaaattaatcaaacccaaggaggaggtcatgggatccccagtttatagccagtgagtcagaagcacaggcgaaacagcctggggcttgagatgggcactttaagtgggggcagtcatttgggtctgagcctcaacctctgggatctgataatgtccccaggtaggtagggtcagaattgaactgggttggaggacacccagctggtatctactgcagaattgattgcttgcttgttggtgggaagaagtccccacacacttggtcacagcaatcttctatgttgatcgattgtctttgagtaagagaattaaaaaaaatgctttgagtttgagtttctcagacagctcttcagacaaacccccttgtgatattctgccagcacagccctccattcatgggggactgggcccctcacttctcccaaactcattactgcctcttaatcaccacaggctggtcctgttttctctgcctgtcctaatgcgagcatcaagacctagtcaagccttgccttctccatgaagcctccccctccattcttccggttagccctgctatcagtgcagttcttctggcacatcacagtgagcattgcgttagaagtggcctgtttcatatctgagtcttgacatctttaggtattagaactcaaggagtgttacttaatcatccaaaaaaaaaaaaaaaatccctcaccaggaccaaacctggaacgctcacccagtcggttctcagtgattatgtactggactgacttgccactgtcctctgcttagccttaggtggcccttcatagctagtgaccctaaccaggtctgccgagtgaatgcactgcacttttctcagtattacctcttttcggaagataagtattacgtcttttcaggtatccggctgttggcttctcccgggttcatgtatgtgggaagaactctacccccaaccttcatccctaaagcatttgagccgttagtaactcactttgggttggtatttttcactcactgctgtcttttaagcatttatttctaagggggatgcttgggtgccctgttggatgtaggggtaccttgtggtgagggtgagggctcctctgagtctggctgcctgggccgcgatcctggcttcttcacttgatcagctgcacagccttaggtgccttttccttatttgcaaaattgaagtaataatgatacctggcctctggggcccttaccaggattagatgagataatacatgttgcaagctttgcacggtgtctgggacatagtaaacaattttttttggccttattgctattttggatttttaatggcataattttaacattattccccagtctcatcctccacagtccagtggagttagtttaggaggaaagatagaaaacagaggccacttcactctgcgttgttgctggctaaatgctttctttcctcacaagacgaatgattaaccatgagtgggctcacaggtgggctggcccgagaggcgggcgactgtcaacccatcttcccttcccaggtggttgggcggcttagaaacttgatggagatgcagaaatggagaaaaccagctggaactcattcaatcaaatttaatatactgcatattttctgggcactgacaatatgccaggcactgtgctaagtgctaaagttgtaaagcataaataattgggcaaggtccctgccctcaagggacttttcagaggacatataatcctcaagaaaatagattaatagataaataataaattaatatagactgcgacaaagtccgaggagaaaatgaaaggatagagttcctaggggagtctgctttagtgggtggttagggaaccctctttggggaggtggcctttaaaccaagatctgaagctgggaaggagccaccttggtgagttgggggtggggaggtggaaaggggagaatgtcgagagtacagcagcacgaggggactgaggaaggatctggcgaggaacaattttttttttttttttgagacagagtctcgctctgtctcccaggctggagtgcagtggcgccatctcggctcactgcaagctccgcctcctggggttcacgccattctcctgtctcagcctcccgagtagctggaactacaggcgcctgccaccacggctggctaatttttttgtatttttagtagagatggcgtttcaccgtgttagccaggatggtctcaatctccggacctcgtgatccgcccacctcggcctcccaaagtgctgggattacaggcgtgagccaccgtgcctggccaagctgaggaactattaatagtctggtctctgtgaaaagacacctggagtgtacagaagagcttggctgagggggtggccagggaaccgaaggggcgaggcttatagggattgtgtaagtgcataccccgttatctgggacagtggtttaacatttttaaattaaattctttttctttttatttttgagacagggtctcgctctgtcgcccaggctggaatgcagtgtcaggatctcagctcagtacaacctccgcctctcgggttcaaggattctcatgccttagcctcccaagtagctgggactacaggcttgcgccactaggcctggctaatttttaatatttttagtagagagggggtttcactgtattgcccaggctggtctggagcccctgggctcaagcgattctcccgcctcggcctccaaaagtgccactgcacctggccagtggcttaaaatttttttctatcattgacatacttgagaaggcataagatactcttgtagtgtagggctgttgcactggggggagggaattgtcagggtgtgtggggttgaaaagagcccctggtgatttagacataccttgccttccatctcttcaaattgagaaacacagctcttcacagaatccatgggcatctgggaacatttacatctcttacttttcaattaaattttgaagggttatagaggcacactataggaacatggaattctgtcaattgatgagaacattggctcagccctctgaggctgagtcactgtttaattggattactgtgtggcccacttaaataaatactgttttggaatagaaaagttattttattttgaaattgtatgaacaagactttggagacatcctttaagattttcacgcacgtggatgttgcccttttgttgagagaggcagtgtcgaggagataagagaacagctggcattgcatttgtgtctgcaccaggctctgtggctttgggcagtgatttaacttctctggtaaagtaggacaaataagtcttgcactgcctgcctcgtcagctgtcatggaacagtgctttataaattacacaatatcagaaaacaaaagttacttcaaaaaaatttagtttctgtacattatggcccatagcacattatggcaaggatgtaattcatgaccatggaacagaacttttcactgttcacagatgactggtctctagaaaaatctaaaggagaatatttttataactttggagtaggagtggtctttgtaaggatggtgcaaagcctggaagccataaggaaaaccttcataaaattcattatctaataaaaagtattggcatagcaaccaccataagcaaaacaaacagattacaaaccagaaaaatatacttgaactttatgttatgtattaaggattaacttccctaatacaaaaagaactcctatgaaccaataaggaaaagaacaggaactctgtaagaaaatgattgaaagacataaacaatttgtataaaagaaaatagtggtgccgggcatggtggctcaagcctgtaatcccagcactttgggaggccgaggctgtcggatcacaaggtcaggcgttcgagaccagcctggccaatatggtgaaaccccgtctctactaaaaatacaaaaattagccaggcgtgttggcgcttgcctgtaatcccagctactcaagaggctgaggcaagagaatcgcttgaacccgggaggcggaggttgcagtgagccgagatcacgccactgcactccagcctgggtgacagagtgagactccgtctcaaaaaaaagaaaatagtggcacctaaacacatgaaaaatgcttgctcttatgcataattgaaaaaaaatactaattaaatcacattgaaataagccattttttgcctatctaggattgacaaagataaaacattttgcaaacggatcatgttagggaagatacaggaaaacaacccactcatttgtaaatacgttgctttgccaatatcttgatgattcagatgatatggcttgatccagcaattccacttacagaaatttactcatgcaggtatttactgcgtactgttcatagtagcacgagaatgtcttatcagtgggtgctggtgaaatgaagtgtgttgcattcacatcatggaatagtacacagccacaaaaagagaacgaggctaactaaaaaccatttagcagatacctgcccccactttttaaaaaaagaacattttattgtgattagaatactcaccaggagacctaccctcttaacaaactttccagtgtataatacagtattgttagccataggcgcaatgttgtacagcagatctttagagctgcttaattaatctagtggactcctgatcttgttagaacctgtaaactgatgtctttcttcccaatgctgttgcttcactacctgatgcaccttttttggctgagtttgcttaactgagctttttgtgattgttttgccagcatgggaggacctactatatctgggactctatgcaaagaatattcagaggaatgatatgcctttaaaggctgcctgttaacaaagggttaaataatttaggcattagacgaattgggggccctgccaaatgagtgtggctaaagtctgtccttttcctgaacattcatgtaagaaaaccccaccccctgtttgtccccacattctctctcctcctaaggatcattgttcccttgtggcataataattaaaaaaaaatgtgaaattgagccgtcatcagactggtaatgaaatcctgagtgctgaagaacctgaatttcttttttctttttcttttctttttctgagatggagactcactctatcgccaggctgaagtgcagtggaggcgcgatctcggctcactgcaacctccgcttcctgggttcaagtgattctcctgtctcagcctcccgagtagctggggaggctacaggcacatgccactaccccacctaatttttgtatttttagtagagacggggtttccccatgttggccaggctgatctcgaactcctgacctcaggtgatcctcccacctcagtctcctttcaaagtgctgggattacaggtgtgagccgccacgcctggcccaagaacctgaatttctgacaggtaacaaataccattttctttttaaaaaagttattcctttttaatcttgttagactgaaatggcttgtctgtcaatatattttcaaagggtagtccattcttgtaaaggacataatgtgcctactgttcaatttttttttttgagatggagtctcactctgttgcccaggctggagtgcagtggtggtatctcagctcactgcaacctctgcctccattcaaacgattctcctgcctcagcctcccgagtagctgggattacaggcgtgtgtcaccatgcctggctaattttttgaatttttagtagatggagttttaccatgttagccagactggcaatatttttatattatgactaagtataatatgggtcctgtgtggcttgtttaaaacacattgctctgaaacccttgggcttttagttgttatattgacttgtgaatttgctgagatttagcaactatttccgtagtatatgcagttccctttttttctagtggctttcagtttcatagttgagtatcaagaatatagcctgtgaactgcatgggattctgcataaagtattttaagaaaaaagaacaggccaggcgtggtggctcatgcctgtaatcccagcactttgggaggctgaggcgggcggatcacttgaggtcagagtttgagaccagcctggccaacaggtgaaaccctgtctttactgaaaatacaaagattagctgtgtgtagtggcacacacctgtagtcccagctactcgggaggctgaggcatgagaatcacttgaacccgaaaggcagaggttgcagtgaactgagattgtgccactgtactccagcctgggtgaccaagtgagactgtctcaaaacaaaacaaaaaaacaaccaaggaagggactagaaagcagattaaaatagcaggaaaaagaatcaaaatagaagccatatgtagtgaaaagagtccaccaaaatgaatcagaaaagcaatttaaacaaaatgtattaattggattggtcaggagtaaataatgaatttgtatgtttgggtgcacagaaaaccctatagatgtgatcatagaaatatttgtttacaagagttgaacctaggaagaaaggcatttttctagataactataatgccattatcatatcctggaaatttaactttatacagtacattatctaataaacagggtcacattaatctatccccattgtcccaaaagtgtcatagctttttaaaaatcacaaaatatggctgggtgtggtggctcatgcctgtaatcccagcactttggaaggctgaggtgggcggatcacaaggtcaggagatagagaccatcctggctaacatggtgaaaccccgtctctactaaaaatacaaaaaattagcagggcctggtggtgggagcctgtaatcccagctactcgggaggctgaggcaggagaatggcatgaacccaggaggcggaggttgcagtgagctgaggtttcgccactgcacttctagcctgggcgacagagtgagactccatctcaaaaaaaaaaaaattgcaaaatacttgatagggttttaaaactgcaagatagcgaatataatacaaaatgaagtgaatttatattttctattagaaaagcagttttaaagggggtgctttcttttatgtaaataaaattgaagctgacaaatttgagattttatatttttatcaaatttgtatttagaaggtatcttttgcaacttatttgcttaaaattatacctagagttggctgggcgcgatggctcactcctgtaatcccagcactttgggaggctgaggtgggtggatcacgaggtcaggagatcgagaccatcctggctaacatggtgaaaccccgtctctactaaacaaaatacaaaaactagccgggcgtggtggcaggcgcctgtagtcccagctacttgagaggccgaggcaggagaatggcgtgaaccccagaggcagagcttgcagtgagccgagatcgcaccactgcactccagcctgggagacagagcgagactgtctcaaaaaaaaaaaaaaaacaaaaaacctagagtaaaaaaaatgggatctcatttccttgcagcagatgacaactttggattcttggtctagcttaattagtaaattggcttagaatcacatgatttcagacctgacagcaacccaggattttccagaaacccaaggttatggatgggaacaatgaatcattggtgtgattacattatcctttaaccgtaatgggtttgccttgcattaagtaaccagagggaaagaaagcacctgttccttaactcttgtggcatttccacactcatcttcactgagcttgtgctagtggggaaaacaaatgacaaactgtagttctgttttttggttttaagcctaataataataattaatggcagcaattactatgtgcttgttatgagccaggctttaggccaggtgttttatacatattaacttctttgtactttgtaataattatatagaattaggttctgttgttgatcactgttttatagatgaggataccgaggcgcacagagggtaagcaggtggaccagggtcacttagcaggatttgagcccagggaggatgaacactgggcagcccatgcttcatcagtgcagtgccctaagctgctgagtatttttgggcgctttttttctccatttattcatgctgtctgtgcgaatgtgtatggaaaactccaagcaattggagtatgcccagaatatactagaattttaagatgcaaatgttagatcacatcgcctacatttctgatggtagtcaatcttgaatagccaggctaatgcatatttcctgtatgcgttacatacctgatactaccaagatcgaggccggagatgctaaataaacaagaatagtgaggagccatgccatttgtaatttacggtttggtggggcacagacattaattcagcatttacccaaataagggtaatgatatttttattctcagaataatcttttattcttatgataagagttacagaggaagatgatggtacaagggaagctacctagggagagctgaccttgttggagggagtgagagcaagcgccctgggtagtgagattgtaaccaagatttgaaaagtgagtagggttaactagtgacagatggatttgaattccagcattgcccttgagcacgttggtcactttgtggtgatgaccttgaacaagttactttacctctctaagccttagtatcttcatctgtaaaatgggtgattgtgagaattaacaacatacaacatactcagcacaaggccgatacatagtcatcagtagtggcagtttttattactgttggcattttctgttcattttactgggaacttagaagagacacttatttaagtctcttactctgtagcaagggccaccaaatacctgggaataattaacttggaaaaatggaagcctgaatgaatattgaatatttaatggtgatcttctttgatctttttttttttttttttttttgagacagagtctcactctgttgcccaggctggagtgcagtggcacgatctcggctcactggaacctctgcctcttgggttcaagcgattctcctgcctcagcctcctgcatagctgagattaaaggcacatactaccacgcccagctaatttttttatttttagtagagatggggtttcaccatattggccaggctggtcttgaactcctgacttcataatctgcctgcctcggcctctcaaagtgctgggattacagacgtgagccaccacgcccggctttcatggtgatcttctaataggccaaatgtcttcggcatctaggatatgggaaaggcctttatgggactgttggtttgaagacacattcagaatggagcttacttgaaagcaattggagtatgcccagaatatactagaattttaagacgcaaatgttagatcacatcgcctacatttctgatggtagtcaatcttgaatagccaggctaacgcatatttcctgtaccaatagccgtacactatttgcccagtgattttttttttccacagtgtttgcaggtatatgtggttatttcttatagctaagtgtgcagggatccttgtgcatcctttgagaaaggcgagtcttgcttttgtctctctggtctgtgaagatgtacatgtatatgcagatatccaatccagcttttttattggaataatatcgttttttacaccttccattgttcttatattttgaagaaaaaagtaccaataattcagccagtggtcatacttatttattattgttattattattatttgagacagggtttcactctgttgcccaggttggagtgcaatggcgagatcatggctcactgcaatctctgcctcctgggctcaaacagtcttcccatcttagcctcccgggtagctgggattataggtgcctgccgaaaaaaatgcttcgctaatttttgtgtttattgtacacatggggttttgccatgttgcccaggctgctttcgaacttgagactcaagtgatctgtttgccttggcctcccaaattgctgggattacaggcatgagccactacacccagcccatacttaatttttcttgtatacttaatttttcttgtatacttcctaagtgctttaagtacattatctgatttaatccttctagtagctgtatgaaagagtcactttttctccacatgagatccctttttctccaagagaatattgaggctttctcggagaggttaagtaacttgttcaaggtcacacagccatgagtggcatagttggggatttgaaccgagatatgaatgactccaaacctgaactctaaactttgatgctgcctttcaagctagttattggagatgatcaaacccctgtgtcagtggaggaagggaggtctgtgtcaagagatttattgtacttctgtggtcataagagtggcttgtgaacaatgtcatgtctgaaaagcattgggaagcttgttgaatttagatttattcactgaatcagtagacgtagatattgtagcagtatctttctaggctattatctcctccttgaggaactctggtatataacaactgaaaattaaatatacttatgaaatgttaggagtttatgtttaaaatagcatttttacttcttcctcattcttgccatttctgttcttcagtttctatgttaactgctttgccattttcaggtcaactactgtttgttgccttaaatctatctgggagctgcttcaaatccatttggaagcaaggggaggatacattataaataaatgatatgttcagagatgggcagagttggaaagacatttcagtgagacggaaggccagtaaagcttttgtctatcagcatctgatatcattacaaacatattggtctgggcttagcttgcttctagaccatctggatttatcttcagctgagctaaacccaggaaaaaagacaaaaaaaacccatttggatttgctctgcagttcttattttgtttttcttctaacgcaaaccctgcttcaaaaattaagtgttgattttgactgatgataacaaaacaaaaatacaacctgatgtgctagctaaggcgggggggaaatgacaaaagcctcagagagcaggagccaagtgttcacttctccaggacgtttccttccctagtactggtttttcctaattcagcaaaagaggaagaaagaagtgtggggctcttctttattttatatatctatatgtatatatatgttacttgtatttatatatttgtttatatttttaattaattaatttatttattttgagacagagtctcactctgttgcccaggccagagtgcagtggtgcaatctcggctcactgcaacctccacctcccgggttcaagcgattcttctgcctcagcctctcgagtagctgggattacaggtgcccaccagcacaaccggctagttttcatatttttagtagagacacggtttcaccttgttggccaggctggtccccaactcttgacctcaagtgatctgcctgcctcgccctcccaaagtattgagattacaggtgtgagcccctgctcccggcctatatttttaaatcacaaaaataatatataaaaaaaagttgttaatcctggaatgtacaaagtaaaaaaatgaaagccccctcacccatcccacttctgtttaccttggcatatattttctggaatcttcttctttttttaatttattttattttatttttattttttgagatggagtctcactctgttgcccgggctggagtgcagtggtgcgatctctgctcactgcaatctctgcttcccgggtccaagtgatttctcctgcctcagcctcccgagtagctgggactacaggcgcccgccaccacgccctgctaatttttgtatttttactagagacgggggtttcaccatattggccaggctggtcttgaactcctgaccttttgatccgcctgcctcggcctcccaaagtgctgggattacaggcatgagccaccgcacccagcctggaatcatcttctatgcatacaagcatgtatacacatatgtacacacttaatggaatcatgctgctattgttcagccatttgctgtttcctgtttgtgcagcatggacatctctctatcccaggatttacagattcacctctttcctttgaattacaaggtattccatgactacatcctgctttatttaatcgtttccttaccaaggggcatttgggttatcttaactcttccagttataaacatggctcagtgagcagctgacacatgtggctttacctctgggtgctgatctttctgaaggatacctgcctagaggtagggatgctgagccaaaggttatgtgaactctggacttgtcagtagccctgcgtttggatcagggtgaaagtgtgaacattggcctgtttcaaatggagccatttcttcttgtggccattttctgtttccataaggtaggccgagtagcatggagctcacagcccggtgtgtaggcagagttatttgatggggatgacaatttctgcctatttcatccttttgaaatttatgaaggtaaaagctttttcctcttgaatcttgcttcattccagatgtactcacagagaactctaatatgttaagtctgctcctggaataaagccagtcttggttttctttcccactccccaagtgcatttgttttccttctggatattttgttcatctttggactttgatttacttacaggatcacaagattagctttctttgaagaagactcctgttggctttctttaatttggtcagtgttgagcccttcccactgagctctttcctggcctgcctgccttggccacgtgttcctttccaggtcaggtgcactgcagactctggatgtaatggcttgagcactgacagcttcccaaggttttgttcaggcaggaaatgaatcacatgccaggagggagtgagtgaaccctgctgactgctggacaccctccttacttcattatcttctccatcaggggctgagcaaatcattaaattttttcactttaccagtttttttttttccttaagagatggggtcttgctgtgttgcccaggctggcctcaaactcctggcctcaagatatcctcttgagtctcagcatcctgagtagctggaactacaggcacatgccactgtgcctggctcccaaatcattttaatattgggctatgatacatattaggccacagcttacctttgtcagctgcattgctcatgccactctcccatgcctttattccccaagtccttactaccctccttcccatgatggcagacatcactaattgatcctgttcttttgaacatgatccagtgagccagacaagcccttgggatctttcttgataccccaggcagcccgtcctaccagactggagttggtacaactaagggcccaggaaaaccctttcaggattcatacttgagaagggttttggggaatgctgagtggtacccagatttgtggaattcttggattactaaaatgtaaaaaagaacattgggagtcttgcacaggattgctaactttttgctctttatatgaaaggcattaacacctccccaaacctatcagatctactctctgccattttataaaagaaagaatattttgtcaccctcccaaaataagaaagacataatctcagaataaaggggagtcctttaaattgagagattctagctacataaaaagtccagtgcattgtctttcttttccccaatttgttattaaaaacttggtcatagacctaagtactgtttaggaacccgtgtcgtaagtttcagactgccagagatttttttctttatatttttacaaagccaaaatttaattccttgaatccaggtgatactgcttattggcgttgatgttgtgtactcagatgaacattttattttattatttccacttaatagtataaaatggtcattttgcagaataaacaaaaaaggttttgtattcttggaggttggaataaagatctgttctcttagtggctctcttgtccagtgttggctcattcattctgcagttatttattgcccacctgcgattatgtgccgagcactggggcactgcagtgaaaagcaaatgtctctaccctcttggagctcacaatacaggaaaaataattaaaaacaaataaatagtatagattcaggttgtgttaagtgctgctaagaagataaaatagtggaccgggtacggtggctcatgactgtaatctcagcactttgggagttcgaggcagaaggatcacttgggcccaggagttcaagactagcctgggcaacatagtgagatattatctctataaaaaaataacaaaaattagccaagtgtggcggtgtgagcctgtagtgccagctacttgggaggctgaggtgggaggatcacttgagcctgggaggtggaggttgcagtgagccaggatcacgccactgcactccagcctgggtgacagagtgagatcctgtctcaaaaccaaacaaaacaaaacaaaaataaataaaatagtgtaaaacttaggggaaaaacttaggggaaaaacgagttatggtattgcagcaaagatgactttggaaacatgagctgaggacacagctaaaaaacagtctagggaaaaagcattccaagaagagggcatagtagatgcgaaggccctgggatgagatgcacttggtgcgtgggacagctttttgctctttatataaaaagggacagagagaagacgaggcagcggaacacagaggagaggaagagagtggaaggaggcacccaggaggcggcaggggtggttggggaagaggggccttgttagtcatggcaagggatttaccgtttatttcttttgcagtgggaagccattggagggctttacgtagaaaaggggtttgatctgaattttaccttgagaagatcactctgagcgcatggagaatggatcgtgtggggcaagactgcagagtcattaggagactatcttagcagtctggctgatgcatggtggtaaccaggagtagggtttcagcaataaagttggtgatgagatttaggatacatttggaagtagtgccaacaggacatgtatctccagatagcacctgccatggtgcctgaagcaaatcagtgctccgtaaataagggctgaatgagggaatccagttggtttagaatgcaacagaggactgccgtgttcatgaaaggaatttgtaaaatttcctcctaatagtaattgtatttttgtcacgccctcacttaggttgaaatttctcttgaagtttatatactggtcctataggtacctcacaaatacactttctttaaaatgatcctgaagcagcctgaatgctcaacaatacaggtaacatccactcagttgaataagataaccccttattcagaaacatagatatttttgttgtaatgagattgaagaagagaaaatgtaggcttgtgaaaacgcttatgattatatcaattaaaaaaatgtgtgtgagaaaaaaaccgtaaggaagtaaaattgtgataatgattgttcattgtggtggtttatggttaaggtgaccaggaataatttattatggaaataatgacactttgtttctgaggcagggtcttgcagtgtcacccaggctagaatgcagtggtgtgatcatggctcactgtagcctcaatcattctgtctcacgtgatcttcccacctcagcctcccaagtaactgggactacaggtgcacataccacacctggataatttttaaattgtttttgtagagatgaggcctcactatgttgcccaggctggtcttgaactcctggcctcaagtgatcctcctgtctcggcctcccaacatcctgggattacaggtgtgagccactgtgcctggcctcaatcatagcacttccaagcaccgttcaaatgactgagtggggaatgaaggtgctatgaataattatacatactgtgatgacaagagaaaaccaagactgtcctgaacaacccaggccatgtggtcaccctagttatgggcaatattttacttctctgtttttcaaatttcctgaattatattatttaaacattaatttaaatttaaaaatacgtaaaaagaatgatcttgctttagaatatttgctttcagaggtcacagaacatttctttggctctttcaccaagcacttaaatgtctcctgccttttaaagtgatagggataccgtggagacattggtctcagaggatgggtggtctcagaggttggggataatccagctgggaggctttgaagctgtgatcatccccctctgccctctaccattctcatgaaagaacgggctagcatagcacctacagactccaagatgacctttttctgtgactaataagattaggatcctagtacgttcaaaatgtcctaaggatttgcttagatcacttgacaggcctgttctcctttgcctttcccaaagcaatgttacagttaaaggttagtttgtgggatctggatttgaatttttttctactgaagtttgcaaaatatatatatatatatatatatttgagatggagtctcgctgtgttgcccaggccagaagtgcagtggcacgatcttggatcactgcaacctcagcctcccaggttcaagcaattctcctgcctcagcctactgagtagctgggactacaggtgcacaccaccacacccgctaattttttatatttttggttgtgacggggtttcaccatgttggccaggctggtctcgaactcctaactttcctaacttcaagtgatccgcctgcctcggcctcccaaagtgctgggattatatgtgtgagccactgcacccagccatcaaatataaatttgtttgacggatttgtgtgtagcttcatggtaatggggcatacaagtgacagttttattggctcacatttgaagtatacgaaacaaaattagagattttttttttttttgagatggagtctcactctgttgcccaggctggagtgcagtggtgtgatctcagctcactgcaacctctacctcctgggttccagcgattctcctgcctcagcctcccgagtagctgatactacaggtgttcaccaccacacctggctaatttttgtatttttagtagagacagggttttgccatgttggccaggctggtctcgaactcctgacctcaggtgatctaccagccctggtgccccaaagtgatgagattgcaggcatgagccaccgtgcctggccaaaattagagattttaaaaatacgttatgaatagtcttttacaactaaaactgtattaaaagtaaataccaaggggtcagggtgccgatatttatctccatggactgtgggggaggttatgccatttcgttaacgagaaaacgtcgaacaaattagttcttcccttgcttttttagtttttctacctacaaaaaggagagaactaaataccttggctaagaaaacagtgaacacttccttgtaactgttcactaccttgtgaaagataaaggcactttaaatctcaaataagacaatcatgtggtcctggactaggtgcacgaagcctcatgtctgagtctatcatttctctagagcctcattttcctctaccctccccatccgagtccagtgaatcacttcctgatcccacacatggcttgcatcttcttgcctccctacatggatcatactgtactctgcacctggaacccatgcctcccatattacctccttcattaatgcaatgaaaggttttagtgatggccaactgggacaccagagcaaggctgcctgggttcaagtcccaattctgtcgcttaaagctatatgacctttgacacattacctgttaacttttccatttctctgtttgcttcactgtgaaatgggaataatattagtacctatcatttttgtttttgttttttaaatataattttatttttccatattttttgaaagagatggggtcttgctatgttacccaggctggtcttgaactcttcagtttaagtgatcctcctgcctcagcctcccaaagttctgggattacaggtgtgagccactgcacccagatgaactgaccatttttgtgaggatatatgtaaagtgcttagaacagcgattatcctttagaagcactgtctctgtgttaattatctttttttttttttttttttgagacggagtctcgctctgtcacccaggctggagtgcaaaggtgtgatcgcagctcactgcaacctctgcctcctgggttcaagcggttcttgtgcctcagcctccagagtagctgggattacaggtgtgcgccaccatccctggctaatttttgtatttttagtagagatggggttttgccatgttggctaggcttgtctcaaactccttacctcagatcatccacctgccttagcttcccaaagtgctgggattacaggcgtgaaccactgcgcccgggtcttgttaattatcttttgaagtgcagcccttccagtaagcatatgtccactagccaccacacgatttgtggcctactgacctaggtttgagtctgaaccctgctactttgtgttggatgacaggggacagttattcaacttctttgaacgttagtgtcttcatctggagtgcaatatatcacctggttgctgggcatgtcatttgtgatactgtgtgaactgcactgtctatgaagtgcctggtttagcacttgacagctggtagatgctcagcaaatgttagtttctttggtttgcatttgcctccctttgtaacactgtgtttgttgcctgatgcttgtacctgcttggttgcatctcctccattaggctgaatatgttttaattttctttgtctctgcacataaaaatttttttggtttattcattgatttcatcactcatttgttcattgtattcattcatgcattcttttctttttttttttttttttttttgagatggtgtctcgctctatcccccaggctggtgtacagtggtatgatctcggctcactgcaagctccgcctcccgggttcacgccattctcctgcctcagcctcctgagtagctgggactacaggtgcctgccaccacacccagctattttttttttgtatttttagtagaggcagggtttcaccgtgttagccaggatggttcagatctcctgacttcatggtccacccacctcagcctcccaaagtgctgggattacaggcgtgaggtgcccggccacattctttttcttgtttattcaaaaatcatttactgaaccacttgctaagtatgttgggccctaccaatggaatgtacccttcttccagctagagtcaagagtagaactgatgagagctcgaactaggccagtgacactggaggctgagagacaggaatggacttaggaggtgtttagagagaggactgtaagggctggctgaccagttgggtttggaaaggaatcaatgacagtttccaggattcttgcttgagccaccgtgtggatgctgacatcattaattaaaatgggcaacatagaagatagtagaattgtctagggtgtggatgggcagggagaaggtatcatgtgtctaccagcctggtttggacacagtaagtttgaggtgtgtgcagaatgtccgcatgaagagaccgctaggaggtggccagttcaccctcaaaggcagttctgattctggacacctttgtacatgatatgggagtggaagtagccaaaccagagaatgagtgtagagtggaagggaagagggctgccagtggcccactggggaagtgccctgattaaagtggaaggcaacagggaatctgtggcttctgctaggaagccacatgtgatgcctcaccactgaaactgcccatgtgccccaccaagaatatgccactgtctgtgcacttcaaggccagcccttgggtaggcagtacagaagtggggagaatgccttctttcccatcatgggcctcgctgcaggccccaggctgcatggaatgtttgtctccttctcctgcaacatgtctcacagagaattcttcttgaatgcatgctatggttcctctctccttatagctgcccatcctcatttttctcccctccactggataagcataagtgaggaaacacgccaatacctccttccccttgtacacacctccactgctgcttctcagtctggaccaccatcacctctggcctgcaccattagtcatctccaaacaggtctccctgcttctgctttggccccctacagtctgttccacacccagcagccagagggatcctgttaaaacataagtcaggttaggtcatgcacctgctgaaagtgccccagtggcttccacattcctcactgtggtccacaggcccggtgtgacccggcccacatctctctttctgagatcctctccctcatcccccatactccagcacactggtttccttctgttctccagatataccaggctctttcggccttggctttggcacacactgcccactcttcccgcagtgttccttccccagactgttttgtccctggtttcctttcttctgtcgggtttcagctcaaatgtcacctcctctgagaagccttccctgaccacccacatatgaagtagtcctcaccgagtcctggtagtcactctcaaaaacatcacccagttttgtttttctcattaagcttgttcattatcttgttcatttatttgcttagatgtttactttgtgttctctcactattatgtaagtgatgagtctgctgggatcttctctcctgaaccctggattcccactcaacaagcgttagtttgcttagtttgcatcctcctccctttgtaacgtggtgtttgttgctgataccgtgtacctgcttgaggaacctgcttgaggaacaaggcatcaggcaatgatcacagcgttacaaagggaggaggatgcaaactagtaacctggtcatggagccagtcacagacgtggcgggatttttcttcagtggtgggcggcacaggagagaaaataggggagacaaatgttaggttgatccaggttcagggccctgagatacaagtggctcgtgtggcagtgggacagggagctgagggtgcagagggagggcatgtgacacagtggaaggacgggaggtccacagggagatgggaagggtgggtcagggctctagtggtttcattcaagtggaacagccgattgggtgagaatgaggaagtgcgatcaggaagggcaggccctggtggtcagagggaacttctagccttacatttcatggccagggctgtggccacatgggggttggtaagcagagggttaggtaacaggaatgaaggaggtaggctaaggcaagagcccggaatgttagggctttactcatgatcaaggccctccttgtaggaggtcagaaaaagtggggaagtcagtgtggaggggtcggcaaagccacaggcatgaggagcaggaagctggagagaagcaggtcttgctaggaaatgagggggaggaggttggtcacattcctaggttctaggtacttcttggtaggttattgtctggagataacagtgaccaggacaatttgggttctgctggtcctgggatagaggggagcacatgaggattgagcagccggtacttgggagagttaccagggaggggcgggtggagaagccggggtgcagctaagatgaagctgctgagatgggtgtgaattggggcatttgcagccctggcatgagttcccgaggcatagtggaaggaagggttagaagaggagagggcagaggaaggacggagtcagatccaggtagagatgagagaaccccagaggatggatgttgcttggaggcccttcagcctgggcagacattgtggctcataggaggagggtgttttggacatgagggttgtgaatgaaatgggtgaggccaggcatagtggcatgcacctgtagtcgcagctactcgggaggctgaggcaggagaatcgctcgagccctggagtttgagaccaggccgggcaacatagcaagacctttctcaaaaaaacagaactaagctgagtgcggtggctcacgcctataatcccgatactttggtaggtcaagacaggaggatcacttgagccctggaattcaagaccagcctggacaacatggcaaaacctcatctctacaaaaaaacttaagaattatctggtcatggtggcatgcacttatagtcccagctatttggaaggctgaggtgggaggattgcttgagcctgggaggttgaggctgcagtgagctgtgatcacaccactgcactccagcctgggtggcagagtgagacctgtctctaataaaaaaagagaactaaaaaaaaaaaaaaagtagatgtattaacataaagaaatgggttaggcttcgggtttcaggtagcatgtttttaaaacagctttattgatacatgatccacatatagtacattcacccatttaaaatgtgcatacaggccgggcgtggtggctcactcctgtaatcccagctcttcgcaaggccaaggcagatacatcacttaagcccaggagttccagaccagtgtgggcaacatggtgaaaccctgtctctacaaaaaatataaaaattagctgggcatggtggcccatgcctgtagcccctgcaacttgaggggctgtggtaggtggatcacttgggcctgggaggtcgaggctgctgtgagctgtgctcgtgtcactgcactccagcctgggtgacaaagctagaccctgtctcaaaaaataaataaataaaataaaatataaataaaatgcatacagctcactggtgtttggtatattcacagatatgtgcacttatcaccaaagtcacttttagagtattttcatgacctcaaaaagcagcaactctgtaccttttggctgtctctcccctacccaccaagttcttctcccagtcccagtcccagtagctacaagcaaccagtagtctatgttccatctctgtagaagtttctattctggactttcatgtgaatggagtcatatgatatgtagactgttgtgaccggtttctttcacttattgtaatgttttcagggtttatccaagttgtaacatgtatcagaacttcattcctttatattgttgaataatactccattgagtagatataccgcattttgtttgcctgttgataggcaattggattgtttctacttttcactgttattaattatgctgctgtgaatagtcatatacaagtttttatttctcttggatatatataccccggagttgaattgccaagtcaaatggtgactgtatatttaattcttcaagaaactgccagacttttcgcaaggggctgcacaattttttatttccaccagtagtgtatgaaggttctgattgctttacctccttggcagcatttgttattatttgactttttaattctaaccagactagtaggagtagagtggtatcttaccatggtttagatttgcatttctctggtaactaatgatatcaagcatcttttcatttgcttattcaccatttgtatatcttccttggagaaattgctcaggatactttgcttgttattgagtggggtaatttgtgtttttcttattaagttgtaagagttcttgatatagtttagacacagtcccttagatatatgatatgcaaatattttctcattctgtgggttgtctctgatggtggcatttgaagcacaaaagttttacatttttatgaagcctaatttacctatttttttgttgttgttgctcatgcttttggtgccatatcaaagaatcctttgccaaatccaaggccatagagactaactgctgtgttttcgtctatgagttttatagttttttgctcttacaaaatggtatttgatccattttcagtcaatatttgtatgtggtataaggtaggagctcaacttcattcttttgcgtgtggctatctacttgtcccagcaccatttgttgaaaggatgattctttccccattgagtggtttcggtgcccttgttggggaaatcaattgactagacagaaataaacctatgggtttatttctcaattctgttcctttgatctgtttgtttgtacttgtgccaataccacaatgccttgagtgctgttgctttgtagtaagttgaaattgggaagtgggaatcctcctgctttattcttctttttcaggattgttttggctatttggagtctcttgcaattcctatgaattttaaaatcagcttgtcagtttgtacaaagaagacatctgggattctgatagtgatcgtgcttgaatccatagatcactttgggcagtgttgccattttaagatgttaaattgtcttccagttcatgaacatggtatgtttttctgtttattttgatctcttaattttttccaacaatgttttgtggttttcagagtatacattttgtacttcttttgttaaatgtaatcctaggtattttattcttttttttttttttttttttgagacagagtctggctctgtcgcccaggctggagtgcagtggcgtgatctccgctcactgcaagctccacctcccgggttcacaccattctcctgcctcagcctctgagtagctgggactacaggtgcccgccaccgcacccggctaatttttttgtatttttagtagagatggggtttcaccatgttagctaggatggtcttgatctcctgacctcatgatccgcccgtctcggcctcccaaagtgctgggattacaggcgtgagccaccgcacccgactattttattcttttgatgctatatttaggtagtactttgatgggaagttgtgatagtacttcttactcttaccaggtgaaggggtagagtgagtagaattgaaaaaatgttttgttggcaggagagagggcagggcattttctgctgttcttcaggaggttgtgttctcaggtttttcacaatccttgggtaaggcatcgaggaatacatcagccttcaaagaatttcatgcacccagctaccaatgatttcccccttttcccatcataatcaaaaccctgtgtggtggaaagggatgactgatgagtgagtagctgaagatagctcctggttaatacaaaggcaatccgattggactaattaacactaatatttaaatcactaataccactcccccagcttctgagatttatctgctgttccaaaagatgaaaattattagcacaaacaaatcactaattaaaagaaccttggtagcataagcaaagtgggaggtgggaaaaatgcttttggatttggcctgggatgtcaaggtagttttttgttttttgtctttttaaacttgctgtatcatagttatatgtatttttgaggtacatgtgacattttgatacatatgtacaatgtgtaatgatcagatcagggtaactgggatatccatcacctcaagcatttaaggacagtttttgaagagagagaatgtcacagtacgagttaggaagcacctgtgccagtggtcatttcctctctctcatatgtaatttttcacagcttctttccttttattctgtttagtaactgggttgcttcttagtgtgagtgagtacaaagggaggtggaggtcagggccaacatgcacatgcaggtatgttctcagtgtctgcatctcaggtagcactttttcaaaatgacattcaaataattgtgaggttaaaattctgtaattttttttgtttcttggattttaaaccctaaatttggcctactatcaagttcatgaccataaatggaacttgtatgtcatagagattagcaagttagtggtttctttgatttatgtcctatgaaccagtatttttttagattgctataaactttaaaaaaagatgtgctgtcatatcctctttttttcttttgtgatgaatggtggaaaaacttaaatgcaattttatttgtgtttctaactttaactgaatatcagagttctgctgtttttccatcttggtttgccttttctagttctaatctgggactgagggagacaatttgggcctggtttgcagatggttctgcttgctctgcaggccctccccaaaagcgtacggctgcctgccttcagcccagctttcatgttttggtgcagctctaatttctttttctttttgtttgagttcctttgattgcccaaactggggtcaccttcaagccaccttgagtaaagggatgcttatgttaaggacactgtgcacagggaacctcagagatgctggacacggaagccactgggaaagtggccccaggcaggcctgcacacttcagcaaccgaagctggctcctgtgattcagcttgtctggtggccaatttctgtggcctttagtgtcttttatctacatcatggctcatatatacttgtgttatacgggtataacacaagaacctctggtccctcagaaccccagctgtgatgtcattatctctccagtttctctttcatcactttccagcctccattcttaaagaaccaccaaatgtagtaatatttcctaggttcaagtacgaggagggagccattgcccagccctttcttctttttgtgccaggctgtgccctaggtaccctctagcctgtggactgacttctttcgagtcagacatccatccctgatcctccctactgtgtctggggagggtcatgacagccagccgcctgtagatctgccctaggagcaggaccttggtaggctcttccccagcagatctgggagggccctggcaccaccacagatgtgtccagtgcagagccaagggcataggtagtattgagagcagatacgggaaaacttggcacagaactaaacattgaatttaaaataacctcgcagatggaatattcttttttttttttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgctgggattacaggcgtgagccaccgcgcccggcctggaatattcttaagagatgaaagtaaggagtcagtgattttttttatttaaatagaaaaatagctgaacattgtgggaggaagtgaaacacagagtgaaattaacttgactgctgtttgttttttgtggggagggaataataaaagtaactgagcacattaggttttactttcttttaaaaaacatgttttgttcttaaactttaacaaatgcactgtaatcttttggcgaaatacagaaaaaaaggaagtaaaaatcagtcataatcctaccacttagaaatgactactgttaattcttaattttattgtgcataagctccagttcttaagtaaatatgtaaaaaaaaaaaaaagtgcttttaaaaaatcacttaataatactgtttgaggccgggcatagtggctcacgcctgtaatccctacactttgagaggctgaagtgagtggatgacttgaggtcaggagttcaagaccagcctggccaacatggtgaaaccccgtctctactaaaaatacaaaaaaattagccgggcttggtgtgcacacctgtagtcccacctaccggggaggctgaggcacgaaaatcccttgaacccaggaggcggaggttgcagtgagctgagattgtgccaccgcactccagcctgggtgacagagcgagactgtctcaaaaaataacaacaaaaaatcaacaatactgtttgaacagccccgatcatttaatattcttttataacaatttataatggctatgaggtagtctgtcatgcagatggaacataattcattttttttctactccgcttatggacgtttaggtttccattttctttgattgtttcttaaaaacactgcattttgaacattctttcctgtacaaatattttgcacatgtagcactgatatttttttagattgagttcccagaggtcaaattatcgagttaaagaatataaacaatttatattgttgcttttgaaatatatggccaaattatctttcagaaatattgaaatagctcacattcctaccaacagtatttagttcccatttctcatgatccttgccagcagtggatattattacagaaatttctaattttaaagaaaaaaatatggtacttgtttttatttgcacttctgttaatagcaagatgaaacatttaagtagattattgaccttctttcaaaaactttatttttaattgtggtaagaaacacatgaaatttgcaatcttacccatttttattatttttttcacatggtctacaccatactagtgtatagaccttaccactttttaaatgtacacttcagtagcgttaagtgtattcacattgttgtacaatagatctctagatctttttcattcacagaagtgaaactctgtatcagtaaacaagaatgttccatttcccccttaaatgctcctttcaccctttcctctagcccttggcaaccaccattctactttgtctttatcaatttaatttccttgaaaacctcatgtaagtggaataataaaggatttgtctttttatgattggattatttcatttagcataatgtccttaaggttcgtcctcttttgtagcatgtggcagaatttccttcccttttaaggttgaatggtacccattgtatggagagaccacattttgctcatccattacatttcattgatggacacttaggttacttccacctcttggctattgtgaataatactgctgtggatgtggacccacaaatagctctttgagagcctgctttcagctcttttggatggatatctggaagtggaattcctggatcatgtggtagttttctgtaattttttgaggaactgctatactgttttctatagcagctgcaccattttacattgctgccaacagaagggttccgatttctccatatcctcctcaatgcttttttggttttttgtttcttggatctatcctaacgggtgtgagttaatttctcattgtggattagtgatgttgagcatgttttcatatgtttattggccctttgcacgtcatctttggagaaacgtctatcaattcctttgtccttttttttttttttttttttctgtgagacagagtcttactctgtcacccaggctggagtgcagtggcatggtcttggctcactgcagcctctgcctccctggctcaagcagccctacaacaccagcctcccgagtggcctggatttcaggcacatgccaccatgtctggctaatttttgtgtattttgtagaggtgggatagtaacttcccaatgagttcaccttgcccactgcctagacagagccaatttataaagacgggaattgaaacggcgagagagtaatttacgcagaccccgctgtgtgggagaccagcgttgttgctgttgttttgagactgcatctcgctctgttgcccaggcctggagtgcagtggcgtgatcttggttcacgccattctcctacgtcagcctcccgagtagctgggactacaggcgcccgccaccacacctggctaattttttgtatttttagtagagacggggtttcaccgtgttgttagccaggatggtctcgatctcctgacctcgtgatccgcccacctcggcctcccaaagtgctgggattacaggtgtgagccactgggcccggccggattagagtttttaaagacaatttggcgggtaggagcttaggaagtagggagtgctgattggtcaggttggagatggaatcgtaggggggtcaaaatgaggttttcttcctgtcttctgtgcctgggtgggatggcagaactgcttgagccagattaccactctgggtgatatcagctgatccttccagtgcagttgcagggtctgcaaagtatctaaagcatggatcttaggttttgcaataacgatgttatccccaggagcaatttaggaaggttcagacccttggagccagagactacatggcccctaaattgtaatttctaatcttgtagctaatttgttagttctgcaaaggcagactggaccccaggcaagaaaggggtcttttcgggaaagggctgttaccagttttgtttcagagtcaaaccatgaactgaattccttcccgaagttagttcagcttatgcccaggaatgaataaggacatcttaagcgttagaagcaagatggagtcggttaggtctgatttctttcactgccataatttcctcagttataattttgcaaaggcggtttcaggatttcgccatgccgcccagactggtctcaaactttgaggtcaagtgatcctcccacctcagcatcccaaagtgctgggattacaggcatgtgcccggtcttgcatattttttaaatcggattttttatttgtataaatttatggggttcaagtgcaattttcttacatgccaggttgcacagtggtgaagtcaggcatttagggtttttttctttgtttttgtttgttgttgttgagcttgatcttttttttttttcttttttttttgacagagtctcactcacccaggttggagtgcagtggcatgatctcggctcactgtaacctctgcctcccaagtttaagcgattctcctgcctcagcctcccgagtagctggaattacagggtagctgggattacaggcgcctgccaccatgcctggctaatttttctatttttagtagagacggggtttcaccatattggccagggtggagtctcgaactcctgaccttgtgatccacctgccttggcctcccaaagtactgggattacaggcgtgagtcaccccacctggccgatcttttttttttttttttaaatagttggttctgagactttgatcttgccaaaagaaaaagttacaaaaaattttgtttaaaaattaaattggcttttattagtgattcatgaatcagggagcacctgatctaaagatttagaaaaagtctttgccgttttttttttaaataatgatataaaccatacttgttattccttatttcatcatttgaaaaaatatgtgatcctttctcactccttacatgtatagtccacaaacttttggtcagtagtttacttgtcagtgagatctcccataggcatatagaccaagcctagcattgcaaatgttttggcctgttgacctcagaaaggtattattaaggtatagtatatataagtactgaaggcacagtaatggcttgctctgtagtaggggtctgcaaactactgccaccagtttttgtagataaagtttaactggaacccagccatgttcattcagttaggcatctgtgagtgccttttcactatgcactgcagacttgagtaggagatgcagagaccctgtggcctacaaaacctcaaatatttactatctgaccctctacagaaaaagattgccaagtggtactttatagaattttatctttgcttcatagatattttgcattttatagaaaaagtattccaaggtagaaaatagaggaagctttctcctcgagttttcggtttgggcagatctgtgtaccatgctctcagggcagtggggttgtgaagagatacacgagtctctcagatgagtcttcaggactgccatgtttcccaggaaggggataacccatgtgtctgctgcctgtgtgtatccagctgtaatgtcaccagcaggtttgagaaatcattcctgttgtttgatgtggttgtgcgattttatcttttttcatttgtttattttagagacagagtctcgctctgttgtctaggctggagtgtagtggtgcaaatagctcactgcagcctaacctcctgggctgaagggatcctcccacctcagcctcctgagtagttaggaatacaggtgtgcaccaccatccctggctgattttttgttttaaaatgaaaaattcaaacaatgtggaaaccaagccacgcccagcttgattgtgagatttaatgattcttggaatgggctgggtgcgatgactcacacctgttattgagcactttgggaggctgaggcaggaggatggcttgaggccaggagttcgagaccagcctgggcaacatagggatataccatctctacaaaaatttaaaaaaattagtcaggcatggtggcttgttcctgtagtctcggctgctagggaggctgaggtgggaggatcacttgagcctaggaatctgaggcaacagtgagctataattgtgccactgcattctagcctgggtgacagtgagaccctgtctctaaaatgaaataaaataaaaataataattcttacaatgaaggtaagagagaaggagaatgggtggccatccaggtgtgatgggggttcttcattggtggaagagagagaatactctagagacagcctagcagaggacactgggaggcagatatccatacttggcataacagtctttcagtgagacaagaattctctatgtgcatttttttttttttgagatggagtctcgctctgttgtccaggctggagtgcagtggtgtgatcttgactcactgcaaccttggcttcctgggttcaagcagttctcctgtctcagcctcccaagtagctgtttatgccagcatgcccggctaatttttgtattttcagtagagacagggtttcaccatattggtcaggctggtcttgaactcctgacctcaaattatctatctgcttcagcctcccaaagtgctgggattacaggcatgagccaccacacccagccctctatgtgcattattatgacagacacataaggtagcctggggagtttggaaatctatacaaacctaaaattttccaactcacctaaagggcttagttttgtcagggagcaatttctttttctctctctttctctttctgtccttctcccttcccttcccttccctcccctcccctctttctctgtttctcttctttctctctctctctctctttctttctttccttctttcctttcttctttcttttttttttttttttagatgcagtcttgctcttgttgcccaggctggagtgcagtggcacgatcttggctcactgcaacctgcacctcccaagttcaagtgattctcctgcctcagcctcccaagtagctgggattataggcatgtgccaccatacccggctgatttttgtatttttagtagagacggggtttcaccatgtttgccaggctggtctcaaactcctgacctcaggtgatatggctgcctaggcctcccaaagtgttgggattacaggcgtgagccactgcgcctggcctcagggagcaatttctgattggcagctttggtttgctaaattatagacagttgaccttttatctcaaaccatacaattgcgctgtcattgaatttccttctccccaccagtaaatgccatggcaagttctagtaccaaatgatactttctcttgtgtcataaaggtagcatctcttaatacatttgaatttgctatttattttacatgaaataaaaataatttatgttaaaattactattctgagagcattatgctatttactgtatttaaaataattattactttaaaaagtttaaaattaatgttactaggaaaattcagacaatatggaagtgtatagagcttagaaaatgacatgatcaccattttcactgtacagatttacagtattagaggttgaccatgatagttcactgtgatgttttggaacaactggttgaaactgctttcaactttcccaagtttcctattttcttttttattttcttttttatattttgagacagggtctcactgtaacccaggctggagtgcagtggcatgatcatggctcaccgcagcgttgacctcccaggctcaagcagtcctcccacctcagcctcccaagtagtagctgggaccacaggcgcatgctatcatgcccagctaatttttgtattttttgtagagatggggtttcgccatgttatccaggctggtcttgaactcctaagtgatctgcccgcctcaacctcccaaagtgctgagattacaggtgtgagcccccggggccagtttcctacttcatagttggacttggtctgtagcatcttaaggtggccaattatcagactcctattagatagaactgcagagttctgcctggctgggaaaagctcaagccctttggggaaatttaagaccccaactttgaaccatttgttcacattacagagtcatggaggcagcctgtggcattggaaggccaccctagggaagcagactggctttggttgcagtggaacttgagcacttgcactctttcatagtgtgaccttgggcaacttaaccccttaacccctctgaccttccgctttcttgtgaagtggggatattcaaatcctcacaggacagttgtgaagtttaattacacaaggaaacacagctatgccctggtggagaaattcagtcaaatgggagagacagagggtatctaaacatcatgatgcaagcgaagttaatggcaccaggggactgcacagcacgcggttgtgtaatggggcagagagcccgggaagtgatttctgtgcagaatcctggcagagtttgctggtgcctggaaagggtgaaagtatgagggtagaggttcagccgtgtggagcacgtgatgtgtgtggggagcatgggcagatcctgagatggtggaacccaccggctaacttggctctggtgcaggaatcccatgataaccggacttgagccgctcctcctcctggcctcctccccttggcatgacccaggccttctgtgtagagggcctttttccttttgctttcctggctatctcacaccatcctttaggcctcagcggaagtgccattttctcagtaaaccctctccacccccacttagtccctccattctttaaagttttgttttaaatggtaaaaaacacacaacctaaaatgtaccatctgatccatttctaggtgtacagttcagtggtgtgaaggatgttcacattgttgtgccgttgatctcctgaactcttttcatcttgcacaactgaaactctgtacccactcagctgccccccaccccctctccctcccatacttggcagccaccattctactttctgtctctgaattttttttttttttttttttgagatgaggtctctcactcaagctggagtgcagtagcacagtctcagctcactgcaacttttgcttcccaggctcaagtgatcctcctacctcagcctcctgagtagctgagaccacgggcgtgccatgactcccggataagtttttgtttttggtagagttggggttttgccctgttggccaggctggtctctaactcctgacctcaggtaatctgcttgccttggcctcccaaagtgctaggattacaggtgtgagccaccacctggcctctgcctctgaatgtgactgctcttggtacttcatacaagtggaatcatacggtgtctgtctttttgtgactggcttatttcatttggcctgtgtcctccaggtttatccctgttgtgtgtttttccattcctatcacacggtgtcctttcctatcagttccacattataattaggaagtcgcctccaaagctctgagcctgctgtgtactccaccgtgtgtcctgcttgcacctcagcccatggcacatagcaggagctccacaaagagtgactgaacggaatctccagttccaaccccagtctgtctttccaacctaatctcgactggtcccctcttgactagcttcttatagctgcggcaataagttaccacaagcttgatatttagaacagcagaaatttattctgttacaatttgggatgctggaagtccaaaatccaggtggcagcagagccctgctcccctgcagaggccctagggcagaatccccgccttgcttcttccagccccaggggctccatggctgggggctgcatccctccccctcctccgtcttcgtcttcacatgttcttctctgtgttctcctctctttctcttatatgggcacttgccatcagatttagggttcactccagtcatccaggatgattttatcttgagattcttaattatgtctccaaagactcttttttcaaataaagtcacattcacaggttctgtggatcaggacatggacctatctttatggcagccacaattccaccccactacaccctctgagaaccctgtcccccagctgatctggcctggtcacgatctctggaccatagggcacgcttttcaccaggctctgtgggtgttgttgttgctcctccgctcccctggaggtcctgctttttttccttgaacactgcgatcccctgctctcccattccctctccatgggtcctctgactgctccaggggagagggactcccttcctcttggaaagcttcctgctgctgctcgggtgcagctcgcttgccccttccagaggccctgtggggtctctcgtctgcacctccacacggccctggaagcggagcctgtgttcctgcttccctgtgttccctatggtgccagtgacatgagtatagagactctgggaatacgtgtgggggataatagggacccggaaagtgggctcagacacatactgatattatcaaagtgaaggcaaatagtagacctgcagtcatagtcaccctcagttgtaagaatacatatgtgtggatataggcagggaatttaaatttgctttttgtttttggcagggagcaggtgttaaatctaatgagcttacataccaagtgggtttaaagaacaattgacaaccccagagacatgcagggcctggaatcaaacaacaggctggctgcactgctcagaaggtcagagtcaaggtcctggctttatcccgctgagggccacaccatctcttatgtgacctctggagtaatataagtgtcacaggaagggcctgatcccagaaggtttgagtttccggtaaaagcgtcagggctgcctctggtggtggatctctctgcgcgtcttttccagccagcatccccccgcacatggcttctgctccccggcatctccagcttcctcgccaattcactaaggctccagccccagcctgactggctggccttgcggtttgaaggtctgtcatcatccagctgccttggactctttggggtccagactcctaacccctggtgtggactgatgttcaccttggtcctgccagcaggagagggcagcgtgggaggagcagaggctcacatgtcagggactgtggggcggggggggctctgtcaggggatttgggtgggaggccatgagtggtgtatccactccagtttggaggttccaaatgacccagtgtggatatcttatttttcagattgatcgtgtcctgtgctgaagatgtttccggaacaacagaaagaggtatgtcatcacaaatccaaaaataaataacccacttattttgattcacacaggttagttcttcatttgcgaaccataaacccatgggttgcttgaggaggtttcatgaaagaccaaaggcccaccctcctgtacctgctcctctactcccaccattggtgcctgcatagccttcattttgggttccagtgactcagctgtggagcacattcccacccacagctcgtgactcagaattctcccaggctctgcctcccaccccttggcttggagcagtatccatccagtctgccttcctgcttttttactccattgactcatccctgaattctccttccttcaggtagcagcccaggggaatttctgccattagtttcaggtttgccccacttgttgcctgggcttggtttcatacaacactggcaaaactggcccttctgcctgcagcctggcttcccaggcctccatgcccgccccctgagcctctccctgactgggaggagcgtaggacagccctcatgccagccccggctgagtgtccctcctttggcagtacgcattgccctgcctgctgtggtgcagtgcacatcatcacttggtgaggctgatgaagtggagaagcagcacaggggcctgtctagggagtgtgcacacacacgtgcacacacatgcacacgagtcacacattcacacagtcacatggtcccagctcaccctgcacaagtggaaagcatgaaaccatttatttcagagaatctttccagaaagtcctttgctagctctcacatctttaatttcagccctatctttggcttcaggttcttctcagcagtccagccttgcttgcatcccttaactctaggctgggcttccccattttcaaaggcagtgttttggtttgttttttaacttttaaaaattgggctagacgggcatggtggcctgtgcctgtggtcctatgtactcaggaggctgaggtgggaggattgcttgagcctgggagccagaggttgcagtgagccaagattacgccaccacacttcagccccggcgacagagcaagaccctgtctcaaacgaaaaaccaaaaaccaaaataattggctgggcaccatgactcatgcctgtaatcccagcactttgggagaccgaggtggttggattacttgaggtcaggagttcgagaccagcctgtccaacatggggaaaccccatctctactaaaaataccaaaattagctgggcgtagtggcatgcgtctgtagttccagctacttgggaggctgaggcacaagaatctcttgaacctgggaggtggaggttgcagtgggctgagatcatgccactgcactccagcctgggtgacaaagcgagactctgtctcagaaaaaacccacaaaaaacaaaaaaattgggctataatatgtatagtaaaatgcataaagtgttccaatcttatgtatgtagctcaatggatttttgtctttttgttttagtagagacagggtctctctttgttgcctagattggtctcgaacttctggcttcaagcagtcctcctgcctcagcctcccaaagagctgggattgcagacatgagccactgatcatggcctaaatggatttttatatacctgtgtaactaccactcagatcaaagtatagatgtttctggctccccagaaggtaccgtgtgcccttttccagtcagtccccctcacttccacccctagaggtgaccttccacaatacctataccaggcatgcttttttccatctcattttaagtaatcctgagaccaagctgcttgttccgggaaatacccgcccatgaagttaatgaaactgcaaggttaagggcatagttcccacaggactgcccttgtcttcaacaccaattgcaagcttggggctttcctgaaccaccttcaagtttaataattcacaagaaaaactcacagaactcagagctattatcctcacagacgctgctttttatagagaaagaacacaaacgagaaccagccaaagcaagagctggacgcatgggcagtcaggtggggtccaaggacagagcttctggtcgtcctcccaaaggagccatgggcggagttatcctcccagcacccatgtgtggcagtgtgcagagtcacttggtgtagctggaatgatcgcctggcgtcaaatccattgcccttagaacaaagtcaaaacacctgcacgtggtctctagcactctgcaggatccaaacctccttctttctccagacttctttcctgtgccccacctaccactccagtgcacttcttgttccttatttcagagcttattttagagccttgaatgctccatgcactctgacccccatggacttttacagatgtttttttccactgcctggaataatctcttcccctagcctttgtactgtgttgactggctaacttctacttatccttcaggcattggcttagaagtcaagaagaagctttctaaacctttaactataaaagatatttttatctaatcagctcctcaacagcaccctgtagtcaatgccagttagaaatagagaaggtttaggtcaagcctttcatatcctagtgtctggttgtttagtggaaagtaattcaggttccacctaatcgaatatgtaaggaccaaatgcagtatgactgattgttttggaatctagaccaagggtacagtgagtatggaagcacttttctctcagtacccacagcaaacattactaattaatcatgaggttggcacgtgaattgagatttatttaccatcctcgtaacaagattcatacagcctgggagtgacatcttggttctgtctaaatggtagtactgaccttaaaatttagtaattttttttttttttttacattttgggggtgaggaatcaaatgtagtctctcttgttaaaacagctttatgactgtaataaatctagaaagaggagaaaagggagtgagaatctcccttgttagttaagcatgttccatttgcacattggtttgaattcccaggagagcagtatccgagctgatggatcttctccataaaaaggccttggcattgggccattgtgaaattaaaatgaattcagagtcattcatgcatgcaactttaatttacaattaaaatattatggttacatattttaataagaataattagatggacccaactgaatcaactcttctgtttaatgagacagaacccagactccaaatggaaaggcaggtggctgtgacaggaagcgcatttcagacagtgtcttttgtggagctaggcatttttattctttttatattcgaatgtccagagtgagctgtttgatttttctacactactcaggatgcttgcctcagccttgctgaactcatcttgtggggtgtatgagtgagcatttgctccagctgcacacagtccctttcatggagtcggacattcttgcccaagcgcctgctccctcctccataagggcactgggctctttccttggcacagggctcacttggtgtaactagactgttcctccctgtgtgatgtgacctgaagtgtgggctgaaaccccttttgaatgtatgtgtgcatgcgtgcatatctcccctgctctcctggatcatgatggctgcattctacttttagagattcatccctttaggataactgattttccccttcccaaatgcacatgcttcatactaggtataacagcagcttctaggcaactccagttattgacaccttagcgatgatatatccatcacttctttggcagggaatatcctgagtaggacaggccgaagtgggccccagagagttgcacaaaccatgaggaccccaccactgagggaggagatggggcactatggggagagccggcagggagggatgtgttgccattttggatgagcagcccctaaggttaatattaatatgtctaagatatgcttatgctgacccatggtaatattttggacttcctctaggaaagcatgcttttgatattcggaaactgactggaaactgactggtctggaactgatgaatacctttaacaaataaataatattagctaggatcctgtgatgctgggtactttgatgggaagcaacaagacagaacattttctcactccccaaaacctaaatttgttgttcctctctccctcctttcttcctccctttttcccctcccaccctccctccctccatttttctcagtctctgttatactcagttattaagtgttcctgtttgaaaaaatagttaagtttccataagaggcaatttacagtcttctgtaagcaaagaaaggcagctgggaatattgtcttcacacatacacaccaggtttcagagaaggctgttaccattctgagcgctacattagtgttacaggtactgtgaggactctgatatttttttctgagcttgtcccagagaaagatcttcattccttttttttttcttaactcttcttccagattttaaaataattgttcactgcagaacatttttggaaaagtatacaggaaaaaataaaactttgagctatttctttctagtctttttctatatatatgtatatgtcatttttagaaaattgagatcatacagaatttatagtttaatatctcactcttccagctcagtgttctaacacatttcaagaaatacttcaccagctctgattaaattagaagtggcttaggaaaagaaagaattagtaaacataaattcatctttgaattgttaagaaatgaacaaagaataactttacagtggagaaatctgacaaacacttcctcagccaggtgatcactgttaacacccacagtgatgttatgttgctagcatgtggaagtgatatcacctggaagtgataaaaatggcactttaccctctgaaataggtagccttccttccaaaaacctataacaccaatctaatcatgagacaaacatcagacaaatctgcagaatacctgcgagggctcctcaaattgtcaaggtcatgaaaaacaaggaatgcctgagaagctgtcatagccaagaggagcccaaggaaacacaatgaccaaatataatgtatctcgagtgggatcctggaacaacagattaatgacattaggtgaaaactaaagcaatcaagcagtctggttttttttttttgtttttttttttttttgagaccgagtctctctctgtcgcccaggctggagtgcagtggtgcgatctcgactcactgcaagctccacctcccgggttcacaccattctcctgcctcagcctcctgagtagctgggactacaggtgcctgccaccacgcccagccaattttttgtatttttagtagaggcggggtttcaccatgttagccaggatggtctagatctcctgacctcgtgatccgcccgcctcggcctcccaaagtgctgggattacaggtgtgagccactgtgcccgaccagcaatcttaatgaagtatggacttcagttaataataacatgtcaatattgattaatgaattgttacaaaggcagcatgctaatataaaatgttaataataggggaagctgggtgtgggatatgtaggaccactctgtactatcttcataatttctctatatctaaaactgtttaaaataaaaagtttattttaaaacaaatatcattgacatatatatgctcacataaaaagattctgaaagattgtatagtgaataaaccaataaacaaaatagtatttataaatgtaggttatgctcctgtttgtgttaaaaaattgcataaagctgggtgtgttggtgcatgcatgtaattccagctacttggccaaggcgagatcacttgagcccaggagttcaaggctgcattgagcgatcatcaatagccacaacattccaccctatgcaatggagtaagaccttgcctcttcaacccccaaaacaaaaaaatacgcaaggtagagatgataataaaatgaacccccatatgtgtacctaccaaccagcttcaacaatttactaactcattattaactcatagccgagctatatccccaccccacctatttcctcctgctaccacagtcaattatttggaaacaaattctagatattatataatttcatctgtaaatatttcagtatgcatttctaacaaatgacctttttaaaaaatgaaccacataatcacatgttaaataattaaacaattccttcatatcatcaaatattcaatgtgcaaattaccttgattattttgaaaaaaattatatacttggttgttctaattctctatttaattaggattcagataaggaccacacattgcatttggttgatacattgtttaaagtctttaattctctcttttcccccttttgcaatttatttgtggaagaaattgcatcttttgccttatggaggttttcacattctagattttgctgattgcatccttgtggatgccaattatttcttactgcagaagaggaggttttttttttctgcacttttcctgatgtgttacaagatatgaaaaggtaactcgctgatttgggatactacttgtgtaaagaaacttgcaacattgtgagctattataagtcatgtaaaaggcaggtctagctaaatctcattcacagttgtttatcctgaagtaataaaagcttctcaaaaaatcatcattcagtaccaccagaggatggtatttaaacatactccatgctgtagagtggcaagtaatatcccttgtcatatgtctcttaagttatttgttacagctgttattaggaaataaagaaaggttgcttgatatattccttttgcccttctattttgttatttgtaaagaatatagtatatgaaatgtgctagattttagttgtgaaattgttatatgggggtcctgaatagcactctggtgattaacacactggtaaatgctttttttttttttttttttttttggtggggagacagagtcttggtctgtcggccaggctggagtgcagtggcacgatctcagttgctcactgcaacctccgcctcccagactcacgcaattctcctgcctcagcctcccgagtagctgggattacaagtgtgtgccaccacacctggctaatttttgtatttttagcagagacggggtttcaccatgttggccaggctgttctcaaactcctcacctcaggtaatctgcctgccttggcctcccaaagtgctgggattataggcttgagccaccacgcccagcccacactggtaaattctataatcattagttgtatggaaaagtacctagcgcattgttgttgcacaatatattttaagtgaatgaatgagtctccagtgtaaatacatgaacatgtaaaacactactttgaaataggaaaaaaaatgtcccaagaaaaagaacaaactgagacaagtttacatttttatgttagaaaattctcatcaaagctatgaaaaattagtattcacttaacacctagacattctgctttattagctttcgtcttttgtgatctttctgtaatctaagtaaatatttttacagttaacacctactcatctttactgtgctacaaagattcaaactaagctatgatggaaaattttaaaaaacacacctatcacaatggctaaaataaaaaatagtgataatccccctggaaactgtaataggtatgtatgatatatcattgtagggttaattgtatttccctagtggttaacgatgtcgaacatctttctacgtgcttgtttgccatctgtatgccctatttgggtgaaatgtctcttcatatcttttgcttgttttctaattgaattctattttttaaataagagtaagtgaatgagtgttttgagacagggtctctcttgttgaggctggagtgcagtggtgtgatctcagctcactgcaacctcccacccacccaccaggctcaagcaatcctcccacctcagcttcctgagtagctgggactacaagtgtgagccagtacactcagctaatttttaattagtttttaaatgtttgtttaaatgtttgtttaattagtttttaaatgtttcaccatgtttcccaggctggtcttgaactcctgagctcaagtgatcctcccaccttggcctcccaaagtgctgggattacaggagagagccacctcacccgtctgatagttttgtttttttttaaaatatattctagatgcaagtcctttatgggatgtgtagtttgcaaatatttcttcaatctttaatttgcccttttaaccttattcacggcatcttttgcaaagcaaagatttttagtttggtgaagcctaattgatcactttttccttatgtggattgcccttttgagataagttgaagaactcttctcctagtcctaggccgaaagattttctttgattttttttttttctaaaagtttttctaaaagttttctctgatgttttgtgtttgacatttacatctgtggtttggttggtgttgatttttgtataaggtgcacgctttaggttgaggttcatctcttggcctgtggatgtccagttgttccataatcatttgttgagaggcttttccttctcctttgaattgtttttgcacctttgtcaaaaatcaggtgggcgtatttgtgtaggtctccctctgggttttctgttctctttcactgatcttctgtgtctatccctctctaggactccattgtcttgctgctgtagccttaacattgggaagaaggcttcctcccactttattctttttcaaaaattttttggctattctaagacatttccctttccatataaattttagaataagcccatctatgtcttcaaaaaaagtcttgctgagattttttataggaattgtgttaaacctacagatcaatttggggagaatttctctctttactatgttgcgtcttccaatttatgaacatagtgtgtctctgctttgattcctttcaatagcatcttagattttcagcatagaggacctctgctttttaaaaaatcttgtcaatcagttggttaattctgaaacatttaatatgcacttactatgtgctagtaccatgcttggtgctagaaatacaaaaatgaaatacaaagctttaagaagccagaaggacagagtttgagaagagcatgttgtctgaactggcattttagctaataaaagcagaaaaaacttccccctccaaaacaatacaattacagtgaaattggaaattgcctaatatttattattagtaaaagaatcacgagatagaacatgtttgagagtacagtctttggaacaaggcagatctgagtttgaaacttagctcaggctggtcatttgactttgggccagttgcttaagctttagaagcctcatttaaaaaatctgtaaagtaggatgagaatatactgagctctgagggttgttgtaaagattgaagaaaacatttgtgaaacggtataatgcctgccacatgtcaagtgccctggtataatacaatacagttatttttattattagtttcatctcacttaagggctaaggaaaaaaatgatagggtagaagtggataatggtcaaacctggggtgtggggatgggggaaaaacagggaacattgaaatcaaaggctgattattataggataacacaggaattagatcttcaaagagtctaggagtctttctttagaagtctgttttcacatggagaacagcagggacagttagtctaaatttttaattccactctgcctggctttctcatactacatatagtcattaggcccaagaagtcattaaagtgtttaataaggttattaaattgactaactgcagctgctgaagcaattttcctaggaaatccatatgattctaggtaaggggctgtggaactgtcctctgtggctgacagcctgtcaacattcctttgaaggatggcgggcagtgtcgtgagggatgcgtctaattaagagattagaggtgaaccttggcttcctgggtgtgctatttgtagctgagagtatggggaaacttcactaattcctactaattgcagagtgggggaggaggagacccatgtgaattatagaatattttaaaataaatgtacttttattactttcaagtacatattttaactcccactaggccaacaaattgttgcctggtacaagtcttaggggactaagttactgaagctatcagaaggattttcaattatttctatgtaaataggtgcttctggagttctttagggtgctagaaaacagtttgttctcccagatcttaaacattgctcttggatccttatgctgttaattggcacatccttagaggaaggggtttgttaaattaagataaacttagaccagctgctaaataacttatcattaattcatggagcccaagaacccaagtagatgaggttttaatttcaagtgaagtttgattttcctttcctgaaggcagtttgtttattcctacaggcatttatttattcattaaatgatactaatggaaggcattggatgtatgaggcattcaagtcttacaagacagcctaagctgccctacaggagcttagcgtctgctagaggaggcctacaggtaattacaatacagcacagtaggatgtggtgagtagggactatgcccaaggcaatcccagagacattaggggcccagaggagggtcaaataagtcatactgggtgaatctgagaagggttcccagaaaaagtggtgaccgagttgcatttgaaaaatgaattggagttggcaaaaaatagtagaagaaaagagaagattaaaaaaaaaaaaaaaaaaaggcagtagggtggcctagcaatccaggcagagaacagcttagttaaaggcatggaagtgtgaagtggcatgttgcttatggggacctatgcttagcctttgaagataagcagagtgaaaatcatgaaaggctgtattgtgctagctgaggagtttgaacttgaaggttatggggcaacctttgaaggattttcagaaggaaagcaacatcatcagatacgtgttttggagccattcttgtcttcatgtggggaatgcactggatatgggccccgaaataaattagcagttcttgcattaatgttgggcaagaggtccttgaaccaaggcagtagcagagggaatagttgtcagtggttccaaggagaatgactatgaaggacttggtctgtgtggatttggggaatgagtcaaacagaggggtctaggagaactgggtttctagctggggttggtgggagatgctcttcactgagaaggggagcaggatgctgtgggaagggtatggacatggcgtgctcaagggacttctaggtggatcaggctagaggctggatccatgggagaggtgcctgcactgggatggagctttgggtggggtccatcagctcatgggagggggttgaatgtgtttggatgaggtcaccctagaattgcaatagtgtgcaaagaacaacagcctgggttggctctcaggcacagaaacgtttcaggatgcagagagggaagaagtttgccatccacaagagaatagtgatatttagcactccaaccaaattaaagattttcaggattgaaacaatatgtggagtcttagtgctgcaatgaattttgagtgtgcatttaaaagtttaagagacacacacacatacacggtgacaagagatggaggtgaaaagcataggccaagagcagagtacctggatttttgcttctgtttccatccctgggcagaatctgctttatcacactgtgattaggggatattatggatatttggtttaaaaatggtttttaaatccctcttataatttagaatgtgcttttaagaaatgatggttgtctcttaatgcgcatgaaaaaaataaagaaatagagaagaagaaatactggctggggcacagtggctcatgcctataatcccagcactttgggaggctgaggcaggggtgttgcttgagcctaggagttcagaatcagcctgggcaacatagcaagaccccatctctaaaaaaattaaaaaattagctgggcatggtggcacccgcctgtagtccagctactgggggcggggttggctaaggtaggaggatcattttagccctggagtttgaggctgcagtgagctgagatcgtaccactgcactccagtctgggtgacagagtgagaccctatctcaaaaaacagaaaaaagaaaagaaataatggccaaagagcatcactatagtgttatcttgtgtttttttttttttttttttgaccaagtcttgctgttgttggcccgggctggagtgcatttagtggcgtgatcttgctgcaacctccgcctcctgggttccagcaattttcctgcctcagcctcctgagtagctgagattacaggcgcccaacaccatgcccagctaatttttgtatttttagtagagatggggtttcactatgttggccaggctggtctcgaacacccgacctctggtgatccacccgcctcagcctcccaaagtgctgggattacaggtgtgagccctgcctatcttgttcttattctatcccctaaatgattttaaaaatacacaatgaaaatattttaaaagaagactttttggaacagtaattcataatccctgtctactaaagacaagtagtgggacagaagtctccagtgcaaggacaaagtgttgccctagaaggtgaaacttgataggggcaaaagttattttcagagtgtggtgtatttttttgattaaaaaaaatcctctatgatgaagagtctcatttaattatctgcatgattcaatggaggtgctttgtccagaaagcccccgatctctctttttcttctgctctcaagcgttcatagcctgcctctcagatgtgccccaacaagcaataagaaatgcctgaattccagcattgaactcccaatcttatcaaaaagctctaatatttaaaatcaaactcagttagcaagtttatgatcactgagtaaataagttatacttaaaaacttatgtgaaacatgatagttttttgctgtacattttcaaatttttaaactaaacctatttagtaaagagcacctgttaaaaagtattgttttaattttttttttttttgagacggagacttgctctgtcgccaggctggagtgcagtgatgcgatctcggctcactgcaaccaccgcttcctgagttaaagcgattctcctgcctcacaagtagctgggactacaggcacacgccaccacgcccagctgatttttgtagttttagtagagacagtgtttcaccatgttggccaggatgggctcaatctcttgaccttgtgatctgcccgcctcggcctcccaaagtgctgggattacaggcgtaagccactgcgcccggcctattgttttaaattttgccccatgttttctattcttattatctttataaaagaacaaaattatctactgtatatgatttttaatatccctaacttctatgtataacacaaaggtattatgaagatgaaatgatttaatgtaggggaaatgtattttaaaaatagaaaagtattatgtaaaagaaggtgttcctctttctattaataagttattatcgcttattctcatgtggctgggatgcatgcacaaagtcaacttcaaccctctttgcttacttttcccatgagctttggtgtcctttctttttcttcttttgatacagggtctcgctcttttgcccaggctggagtgcagtggcacaatcaaggctcactgtagccttgacctcctgggctcaagtgatccaccctcctcagcctcctgagtagctgggactacaggcatgcaccacactgcgcctggctaattttgtattttttgtagagatggggtttcaccatgttgcctaggctggtctcaaactcctgggctcaagagatccttccaaagtgctgggattacaggtgtgagccaccctgcttggcctggtgcctttcttatttgtgtcctaggaagcaccttacccagaagggcccattgtttcagtttagagagatgaagaaagtaagaaatgatcactttttaaatttgaaaaaaacctgaaccaattatttaagattaaaaattaaaaatcagttttacagtatactttgtcttcagataaccagtaaaactatccagaagtgctcccacctcagtgttgcattattttaaaaattccattatgtggcaaaagtgtgttctagatttgctcgtggtgcctgattcattaactttacttcttgttttttaaaggattacaagtaccacattggttaaagctcatttcagttttgttttagtgcagtcgttttgttcagttctttccagtcctacttgcagttctgaagaatatttctttgtttatgatgccattacaggaatttgtaagtgtctgggttcgagatcctaggattcagaaggaggacttctggcattcttacattgactatgagatatgtattcatgtaagtatgtagtcagtagaaatagtaattttgagggacttttatgggatacattttatgggataaagttgacacttgtaaaagtttttctcattcaaataactgaatttgaatgattacaactaatgcttttatcttacatgaactagtaagatggttcctaaagttgaaaaattacttatttgaatcccttattgttcctttgttaatattaacattttaatgtttattgccttcacatgtgaagatgtgcacgcatctaaaatgcatgggtaaagagtacttatagctcattaatggcatttcttatgatctgctatagcatatttctggataatataatgcctgataaccttcaagtttgagaggatatagagttctttggaaaagagatgtgtggtgttttatatatagaatcagaaggtgggaaatggatatgtgcaattattgtgattaatttatctagaatctgagtaattaatgtaacgagtaagcaactagaaatgatgtgccttgcgtggatgctactgtatcacaatctcttgaaaatgttgtgtggtgtgtggccttctgtgaccatcttaaacaagggtaagcaaacttctctgtaaaggtagtaaatatcttcagtttgtgggccatacagtttctgtcgagactactcatttctgctgttgcaggtgaaaagcagccacagacagtgcataaatgaatgagcataattgtattccaataaaactttatgtgcaaagacaggtgtcagaccagatttggccctcaggctgtagtttattggccccgattttgaggataatactctttgcatctaaaccagatgcatatcagatgcaaactaaattagttcaactggggagcatagcaattgacccagattgtatccgtgacttcatagcacaagtgaagtaaaatttagccattatttaatcttcccattgtaaatagctaacttggtatattggacacccaaacaccagctgtagaacttttctttttttaaattctcctttcttctcttttttctttgaagtttccccaactttgaaaataaaagaaaaactcagaactgcttttttgattgtgttgtaaagccattccaggatatgccatgtattttgattctgttttggttttacttataagctcacactagagttgcattctgtgtggaaaattatgactatataagaataagcatttgaagtaaaatgaaatagttttagttgccttctaactttctgtaaaaaaattgtgcgtccttatcacacacttcatgataggcatgaaatttaattattcccaggaattaatgaaagtatagattctgctctgctctataaatagcctgatgtaaattcagaaatctccatctggagccagaaatgatgggttccacaaatactatttgatggtgtcctggcacttttctgaaatgctaataaattgacaatggataagccttggcttggtggacagcaaaaacaagcaaatagatttattagaggaacttaatcagttagtgatctcagtatcctctaatcttgaagagacttccacctgtcatacaattaaaagtggatggcagagctagggagttctggttggcttctcttagttgttaacccatagagctttggaggtagagaagctggtctttaacttgtttaaattaacctcaagggagatgatgtcacacaactctgggatcttaacatttacttggaattttaaattagtagaccctagagctgggtagccatcataaatactcccctgaacctgccctgcaaatgaaggacttatggatcgaccttagtctggtgtaggtaccaggtggatttttagttattgacaaccatggtggttgtgagcagagaaattaaagggaatttaaatggacccagcctgtgtgtgagatgtcaggaatccctgtggtggtctgggattctttagggagagggtaccgggaagataacctgctcaagccttgttaggggactagttctggtataacatggtctgcaaacctagtccccaaggagcacagtagagtgaggccctggtgtgttataagtccacccacaggatgttatttgccacaaactccttccagcgggttttgctgccatatcgttaaagataatgggatttagaccagtggctaccttggggataagccttttaacctgtctacattctgaagttttctgaactttacaaagcataagcataccaggaaccatgtcatatatttcatgagaacagtttgagagctaatgcacataattacttagatttcccaaggaaaacaatcgctgggcatattaagtgatagaataataatttttgaaatagtactgatcttgggggtaaagaattgtttctcatttagattagaaaatcggattttgaaatacagagactagagatactcatattttcaaaaatcaggagaaacaaatattttggtagtcgcttgttttactcaaaggagaatatttactctcgtcttatgtttactcaaaggagaatatttactctcgtcttatgtttacgcaaaggagaatatttactctcgtcttatgtttacccaaaggagaagcattgtggctgagcttagcatggggacaccatcggtggctttttccaagtctgccttaggatagctggaaggaaaccaacacttagtaactaacagtattattaatagataacattggtcaagtgcttattatcaatcctcacaaccaccctgtgaattagatatatactagttcatcccattttagtactgaggaaactgaagtttgagtgacttgccctgtagcagaaccaggactggaattccggtcggcctgtcctctatgccagatgtttatccccacgtaccacggtcattctctggctcggacggacacgctccctctcacatacagtagagaagggaatgctgttctctaggatttctggtgatttgtatgatctgcagggtggccatgtcaaggagatgaagatttctgcaatgtctcataaagggtcatgaggaggtgtctctaagccccaaagtttcctccagcttacgtggatggtggtaaaatgcaacggatgaacctgagctcctacctgtcatttatatgttaggatttattttttatgatttattcttgaaagcagtgctcataggtgagtaggaggctccttcaggatgcagggagtggccaggtcatacctcaccctggggcaacactgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctttgaagggaatgtttataaaggagtatttggtggcgtgtgaacagtctcagtgagttattaactctggattactctgtgatggtgggtattgccgttaaagctgcctgagttcacactaccagtgatttccctcccccaatccactctctggaatgctggaatacccagaatgctagaggccatatagcacgctgatttacacctagactccgaggccaggctacctgagttcagatcctcgctctgccacttactagctgggggcttgggcagatcatttacctcctctgcctgtgtcttcccatctataaaatggggtaatcatagtacctacctcatagggttgttgagaagattagacaagttagtgactgtaaagcactcatgacagtgtctggcatgcagtgtgtgctatcttcatgttggctgttattatcttaatgcacttagacatgagacagcttttgctttcctaatttccaattttgtagataaggaaataggctgagtcatatgactactagttactgacaggacccagtctcctgaactgtttctttttctagtagtttcaggatctgaagtcatctcctttggggttcactaaataggaccttagagctagcctgaaataaatatactgcctcctccccatttggctctctcataaagggtttggatattaagtatgcacattaatattaatatttatttctattagattgacttagtgccttttctttgaaggtgtcctagaggcatacagaaagatccaagattataaattgagggagagtgggccaatgaagagaagccagaggaataaacatggcaagagaccagaagaactgattagcagagccaagtcctccgaaaacatttcattgtatttttggggggtatcacaggcatggcaggacagagacctggccaagtttttcctgccctttcccctagaggaggcctctgattttaattgttgtctctatgaggcccaggtggctgatggcctctcccttgagatgtggtccctgccacacaattctacagaattgcctgtcactctagtgtaggacatgttgtcctcggggagctgtggcatcttgtcttctgtagggaagtcttatttcaggtcagaaggcagcacgtacctctgaattatattgctggttaagtgcagggtatgtgtttttgaccaggaattacttcgttgttttgaacacaacctttctatccacagttgatctacccaaatgaatgaccctgtgagtgtcattcagccatagtggggttatgcttgtgccaggttatttttgcatagtgcatggtttgactgtttgctggttgtgtttgatgcagatgtcatagtagaaagtgtcctggttcaggaactcaaggagccgggttctaggtctcccataatcatggttcctggttttttttctagctgcatgtgagccttggaacagtcacttcattccttttaagcctttgtttgctatagagtgggataatagtacccacacatagccaacctcactgggtggttgtgtcctacagatgaaaaggacttgaaaaaaactctaaaaaccatgcagcgatccttcattcaatagatgtttattaagtgaatgctttgggccaggctgcgtgccacggacataggactgcacagaatgaacaagtccttgtcctgacacttccttctagggggagcactgtgtacacatccagggctacggctagattcattaacactgaatctggattgtcatccgattggattgtcaaatcatggaattggcagggggttctcttgtgatatcatttgttcccctgtggtatgtgaacatttgtctacaagttaatatttcactttaaaaatgaaagctggtgcttccacacagcctaaacctgaaggaagtgaggagtcaaataccacagggctggcttcaggcctgaactgagctctgcggcccctgctgaccctccccagcctcccttctgtgtccctcagatctgtgcttgcccgggttgtgtaaggtagtaccctccatgtctttgcccctggtgccccctcccctcacccaaccagggtccactctagggaactggatgtgatgtgtaccttggcactgtgtcttggccccagtttgacatcctctgagcccccactggttacctgttaagtagggccagccatcaatagcctgtaccttgtttgtagaggaattttaggaaccacagcattaaaacatggaaacatgcttgtattgtaggtttttcgcatgcatttttaaagcctggttttcatgtgagttttgaagttatgaaccagaagcactaaatatgttcaaaccttttgaaaccacaatgtctttgtatatgtgtatatatacctatttttctttaaggtcatttgtgaaatgatacatatgtaataagaaagtactgatctttgtagaggaattggaaaattgtttctttgactaggtgccaaataagaataatttctaccatttatcgaacactttctacgtgtttggcattttacatgttttagtctcagtactaaaaatcttaggagttgggtattatctcagttttatagataaagaaattataggaaagatggacatactatatgaatcccagaacctggcaaatttaaaattagcagtactcttaaatgctggctaaatttggtatgattgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 2028 - DNA, 82435 bp, Homo sapiens; identical to SEQ ID NO: 2027

SEQ ID NO: 2029 - DNA, 13446 bp, Homo sapiens
agttttgttttagtgcagtcgttttgttcagttctttccagtcctacttgcagttctgaagaatatttctttgtttatgatgccattacaggaatttgtaagtgtctgggttcgagatcctaggattcagaaggaggacttctggcattcttacattgactatgagatatgtattcatgtaagtatgtagtcagtagaaatagtaattttgagggacttttatgggatacattttatgggataaagttgacacttgtaaaagtttttctcattcaaataactgaatttgaatgattacaactaatgcttttatcttacatgaactagtaagatggttcctaaagttgaaaaattacttatttgaatcccttattgttcctttgttaatattaacattttaatgtttattgccttcacatgtgaagatgtgcacgcatctaaaatgcatgggtaaagagtacttatagctcattaatggcatttcttatgatctgctatagcatatttctggataatataatgcctgataaccttcaagtttgagaggatatagagttctttggaaaagagatgtgtggtgttttatatatagaatcagaaggtgggaaatggatatgtgcaattattgtgattaatttatctagaatctgagtaattaatgtaacgagtaagcaactagaaatgatgtgccttgcgtggatgctactgtatcacaatctcttgaaaatgttgtgtggtgtgtggccttctgtgaccatcttaaacaagggtaagcaaacttctctgtaaaggtagtaaatatcttcagtttgtgggccatacagtttctgtcgagactactcatttctgctgttgcaggtgaaaagcagccacagacagtgcataaatgaatgagcataattgtattccaataaaactttatgtgcaaagacaggtgtcagaccagatttggccctcaggctgtagtttattggccccgattttgaggataatactctttgcatctaaaccagatgcatatcagatgcaaactaaattagttcaactggggagcatagcaattgacccagattgtatccgtgacttcatagcacaagtgaagtaaaatttagccattatttaatcttcccattgtaaatagctaacttggtatattggacacccaaacaccagctgtagaacttttctttttttaaattctcctttcttctcttttttctttgaagtttccccaactttgaaaataaaagaaaaactcagaactgcttttttgattgtgttgtaaagccattccaggatatgccatgtattttgattctgttttggttttacttataagctcacactagagttgcattctgtgtggaaaattatgactatataagaataagcatttgaagtaaaatgaaatagttttagttgccttctaactttctgtaaaaaaattgtgcgtccttatcacacacttcatgataggcatgaaatttaattattcccaggaattaatgaaagtatagattctgctctgctctataaatagcctgatgtaaattcagaaatctccatctggagccagaaatgatgggttccacaaatactatttgatggtgtcctggcacttttctgaaatgctaataaattgacaatggataagccttggcttggtggacagcaaaaacaagcaaatagatttattagaggaacttaatcagttagtgatctcagtatcctctaatcttgaagagacttccacctgtcatacaattaaaagtggatggcagagctagggagttctggttggcttctcttagttgttaacccatagagctttggaggtagagaagctggtctttaacttgtttaaattaacctcaagggagatgatgtcacacaactctgggatcttaacatttacttggaattttaaattagtagaccctagagctgggtagccatcataaatactcccctgaacctgccctgcaaatgaaggacttatggatcgaccttagtctggtgtaggtaccaggtggatttttagttattgacaaccatggtggttgtgagcagagaaattaaagggaatttaaatggacccagcctgtgtgtgagatgtcaggaatccctgtggtggtctgggattctttagggagagggtaccgggaagataacctgctcaagccttgttaggggactagttctggtataacatggtctgcaaacctagtccccaaggagcacagtagagtgaggccctggtgtgttataagtccacccacaggatgttatttgccacaaactccttccagcgggttttgctgccatatcgttaaagataatgggatttagaccagtggctaccttggggataagccttttaacctgtctacattctgaagttttctgaactttacaaagcataagcataccaggaaccatgtcatatatttcatgagaacagtttgagagctaatgcacataattacttagatttcccaaggaaaacaatcgctgggcatattaagtgatagaataataatttttgaaatagtactgatcttgggggtaaagaattgtttctcatttagattagaaaatcggattttgaaatacagagactagagatactcatattttcaaaaatcaggagaaacaaatattttggtagtcgcttgttttactcaaaggagaatatttactctcgtcttatgtttactcaaaggagaatatttactctcgtcttatgtttacgcaaaggagaatatttactctcgtcttatgtttacccaaaggagaagcattgtggctgagcttagcatggggacaccatcggtggctttttccaagtctgccttaggatagctggaaggaaaccaacacttagtaactaacagtattattaatagataacattggtcaagtgcttattatcaatcctcacaaccaccctgtgaattagatatatactagttcatcccattttagtactgaggaaactgaagtttgagtgacttgccctgtagcagaaccaggactggaattccggtcggcctgtcctctatgccagatgtttatccccacgtaccacggtcattctctggctcggacggacacgctccctctcacatacagtagagaagggaatgctgttctctaggatttctggtgatttgtatgatctgcagggtggccatgtcaaggagatgaagatttctgcaatgtctcataaagggtcatgaggaggtgtctctaagccccaaagtttcctccagcttacgtggatggtggtaaaatgcaacggatgaacctgagctcctacctgtcatttatatgttaggatttattttttatgatttattcttgaaagcagtgctcataggtgagtaggaggctccttcaggatgcagggagtggccaggtcatacctcaccctggggcaacactgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctttgaagggaatgtttataaaggagtatttggtggcgtgtgaacagtctcagtgagttattaactctggattactctgtgatggtgggtattgccgttaaagctgcctgagttcacactaccagtgatttccctcccccaatccactctctggaatgctggaatacccagaatgctagaggccatatagcacgctgatttacacctagactccgaggccaggctacctgagttcagatcctcgctctgccacttactagctgggggcttgggcagatcatttacctcctctgcctgtgtcttcccatctataaaatggggtaatcatagtacctacctcatagggttgttgagaagattagacaagttagtgactgtaaagcactcatgacagtgtctggcatgcagtgtgtgctatcttcatgttggctgttattatcttaatgcacttagacatgagacagcttttgctttcctaatttccaattttgtagataaggaaataggctgagtcatatgactactagttactgacaggacccagtctcctgaactgtttctttttctagtagtttcaggatctgaagtcatctcctttggggttcactaaataggaccttagagctagcctgaaataaatatactgcctcctccccatttggctctctcataaagggtttggatattaagtatgcacattaatattaatatttatttctattagattgacttagtgccttttctttgaaggtgtcctagaggcatacagaaagatccaagattataaattgagggagagtgggccaatgaagagaagccagaggaataaacatggcaagagaccagaagaactgattagcagagccaagtcctccgaaaacatttcattgtatttttggggggtatcacaggcatggcaggacagagacctggccaagtttttcctgccctttcccctagaggaggcctctgattttaattgttgtctctatgaggcccaggtggctgatggcctctcccttgagatgtggtccctgccacacaattctacagaattgcctgtcactctagtgtaggacatgttgtcctcggggagctgtggcatcttgtcttctgtagggaagtcttatttcaggtcagaaggcagcacgtacctctgaattatattgctggttaagtgcagggtatgtgtttttgaccaggaattacttcgttgttttgaacacaacctttctatccacagttgatctacccaaatgaatgaccctgtgagtgtcattcagccatagtggggttatgcttgtgccaggttatttttgcatagtgcatggtttgactgtttgctggttgtgtttgatgcagatgtcatagtagaaagtgtcctggttcaggaactcaaggagccgggttctaggtctcccataatcatggttcctggttttttttctagctgcatgtgagccttggaacagtcacttcattccttttaagcctttgtttgctatagagtgggataatagtacccacacatagccaacctcactgggtggttgtgtcctacagatgaaaaggacttgaaaaaaactctaaaaaccatgcagcgatccttcattcaatagatgtttattaagtgaatgctttgggccaggctgcgtgccacggacataggactgcacagaatgaacaagtccttgtcctgacacttccttctagggggagcactgtgtacacatccagggctacggctagattcattaacactgaatctggattgtcatccgattggattgtcaaatcatggaattggcagggggttctcttgtgatatcatttgttcccctgtggtatgtgaacatttgtctacaagttaatatttcactttaaaaatgaaagctggtgcttccacacagcctaaacctgaaggaagtgaggagtcaaataccacagggctggcttcaggcctgaactgagctctgcggcccctgctgaccctccccagcctcccttctgtgtccctcagatctgtgcttgcccgggttgtgtaaggtagtaccctccatgtctttgcccctggtgccccctcccctcacccaaccagggtccactctagggaactggatgtgatgtgtaccttggcactgtgtcttggccccagtttgacatcctctgagcccccactggttacctgttaagtagggccagccatcaatagcctgtaccttgtttgtagaggaattttaggaaccacagcattaaaacatggaaacatgcttgtattgtaggtttttcgcatgcatttttaaagcctggttttcatgtgagttttgaagttatgaaccagaagcactaaatatgttcaaaccttttgaaaccacaatgtctttgtatatgtgtatatatacctatttttctttaaggtcatttgtgaaatgatacatatgtaataagaaagtactgatctttgtagaggaattggaaaattgtttctttgactaggtgccaaataagaataatttctaccatttatcgaacactttctacgtgtttggcattttacatgttttagtctcagtactaaaaatcttaggagttgggtattatctcagttttatagataaagaaattataggaaagatggacatactatatgaatcccagaacctggcaaatttaaaattagcagtactcttaaatgctggctaaatttggtatgattgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 2030 - DNA, 10005 bp, Homo sapiens
actgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcaggtaagactcatttttctactttctctgtacagactaatagcatgtgttttacaatgaaaacatcctgtgtacgaagaagatatagagaattcgtgtggctgaggcagagactccaaagtaatgcgttgctggtgtaagtgatttagagtatactgtggagactttgtcattatattcagtatttaaaattgacgttcattaagatatataagatatgaaggatttttataggcttttgccttgattacaatatgtagctttagtttcttagctactgcatctgaatttaaaatttatcacttaaatttcaccaactttgatgggtataggccatgaaaggcctcagaaatgtttaaagatgggtttttctttaagctgacttcctgatacccttattatataactatataatgtataatcataattatagaataactgtgtgataataatcatcatacataatttgccttcactttgagggatttctgtaacagaagcaccttgagttaatcatttaaaaacattgttttttctttctcctaagacaactgccagaacttccatctaaaaacctgtttttcaacatgaacaatcgccagcacgtggatcagcgtcgccagggtctggaagatttcctcagaaagtgagtgtccagaaacttttgtggccagacaaggggtgtgagcaagtgctttacaagagctgcatggtggtgtggggaagagtgttcctgtttctgaaatgcaaataatctgcactagagcaaaacccagtggcccatttcctatattagagcaccatcttgtggctcacatcatctcgtacatatttgggaccaagtcttctagaaagaaaacaatgaacaaattgaattaaatatctggtcctttaagctgtcaagcagatctaaattacctgggcgtttagctgacaaaagtaaaaatttgccaggaaacaaatatgcctaatcatcaaaaggcacttcttaaaaactgtctttctttacaatgcttagaatttacagaccaaaatcagctcagtaacgggctgctaatatccttctgggttcctctaatagtttaacgctgatctttgaagggaatgtttataaaggagtatttggtggcgtgtgaacagtctcagtgagttattaactctggattactctgtgatggtgggtattgccgttaaagctgcctgagttcacactaccagtgatttccctcccccaatccactctctggaatgctggaatacccagaatgctagaggccatatagcacgctgatttacacctagactccgaggccaggctacctgagttcagatcctcgctctgccacttactagctgggggcttgggcagatcatttacctcctctgcctgtgtcttcccatctataaaatggggtaatcatagtacctacctcatagggttgttgagaagattagacaagttagtgactgtaaagcactcatgacagtgtctggcatgcagtgtgtgctatcttcatgttggctgttattatcttaatgcacttagacatgagacagcttttgctttcctaatttccaattttgtagataaggaaataggctgagtcatatgactactagttactgacaggacccagtctcctgaactgtttctttttctagtagtttcaggatctgaagtcatctcctttggggttcactaaataggaccttagagctagcctgaaataaatatactgcctcctccccatttggctctctcataaagggtttggatattaagtatgcacattaatattaatatttatttctattagattgacttagtgccttttctttgaaggtgtcctagaggcatacagaaagatccaagattataaattgagggagagtgggccaatgaagagaagccagaggaataaacatggcaagagaccagaagaactgattagcagagccaagtcctccgaaaacatttcattgtatttttggggggtatcacaggcatggcaggacagagacctggccaagtttttcctgccctttcccctagaggaggcctctgattttaattgttgtctctatgaggcccaggtggctgatggcctctcccttgagatgtggtccctgccacacaattctacagaattgcctgtcactctagtgtaggacatgttgtcctcggggagctgtggcatcttgtcttctgtagggaagtcttatttcaggtcagaaggcagcacgtacctctgaattatattgctggttaagtgcagggtatgtgtttttgaccaggaattacttcgttgttttgaacacaacctttctatccacagttgatctacccaaatgaatgaccctgtgagtgtcattcagccatagtggggttatgcttgtgccaggttatttttgcatagtgcatggtttgactgtttgctggttgtgtttgatgcagatgtcatagtagaaagtgtcctggttcaggaactcaaggagccgggttctaggtctcccataatcatggttcctggttttttttctagctgcatgtgagccttggaacagtcacttcattccttttaagcctttgtttgctatagagtgggataatagtacccacacatagccaacctcactgggtggttgtgtcctacagatgaaaaggacttgaaaaaaactctaaaaaccatgcagcgatccttcattcaatagatgtttattaagtgaatgctttgggccaggctgcgtgccacggacataggactgcacagaatgaacaagtccttgtcctgacacttccttctagggggagcactgtgtacacatccagggctacggctagattcattaacactgaatctggattgtcatccgattggattgtcaaatcatggaattggcagggggttctcttgtgatatcatttgttcccctgtggtatgtgaacatttgtctacaagttaatatttcactttaaaaatgaaagctggtgcttccacacagcctaaacctgaaggaagtgaggagtcaaataccacagggctggcttcaggcctgaactgagctctgcggcccctgctgaccctccccagcctcccttctgtgtccctcagatctgtgcttgcccgggttgtgtaaggtagtaccctccatgtctttgcccctggtgccccctcccctcacccaaccagggtccactctagggaactggatgtgatgtgtaccttggcactgtgtcttggccccagtttgacatcctctgagcccccactggttacctgttaagtagggccagccatcaatagcctgtaccttgtttgtagaggaattttaggaaccacagcattaaaacatggaaacatgcttgtattgtaggtttttcgcatgcatttttaaagcctggttttcatgtgagttttgaagttatgaaccagaagcactaaatatgttcaaaccttttgaaaccacaatgtctttgtatatgtgtatatatacctatttttctttaaggtcatttgtgaaatgatacatatgtaataagaaagtactgatctttgtagaggaattggaaaattgtttctttgactaggtgccaaataagaataatttctaccatttatcgaacactttctacgtgtttggcattttacatgttttagtctcagtactaaaaatcttaggagttgggtattatctcagttttatagataaagaaattataggaaagatggacatactatatgaatcccagaacctggcaaatttaaaattagcagtactcttaaatgctggctaaatttggtatgattgtgagatttttcaaatatattcatttttcttcagtcttaactataatctcccttttgtattcttgcccctgagtaattataaacttaaagtcccttctaatagttatgaaaagaaagttataggctaaaaaatataaactcagtaagtctctaactatgaaaaatggaattcctactaatttttaggtttgaatgggattttcaatttaggtttgaatagatttgttcatgactgggagccgcttcccttctttactgaattcatcccattaatacaactacatttaccctacagtttagactttagtatcatggttttgtatttcttcaaatattaaggaatattaaagattttttacaaaaggctagtgttgaaccatgacagctagttttacacacacacgatttttatgtctttgtgttcaatagagggcaccacagcatagatcatgaatgtcttcaatgaagatttgtaggttttattttttcttatagtaagagctaaacaggctgagttaattttttttttctacatcaaactgctaaccttccatgtactatgcagttatgtatatatatcattgtattgggttcagcagacccaggacatccttagttaggatgaaatgattttgcatagctatatattctcagctaaaccagcatataatacatctaataaaatcatgttgaggaaaactgtgcttttcaactgtgtccagtttagggaaaaaaaacagattttgctttgtttagtctaaaactgttatggggaaaggaataacttctgatttgcactataaatatctttctagaaattcttttaaaatcctagaggctattttttattccttttataaaggtttgaaaatcatatactttttaaatggaggtttctacaaatgacattttattgactgttttacaaagtactctttatattaggtttgaaattgattttgggctattagatttgtttgtggaaaatatggcacaaacatgactaaggaaaaaatagtatttaatattatgatggtggcagtcacagccctctctgatagtaagccaaatagtactcaaaataaattaattatgctcacctaaccagatgggaaaacactctcaaaaattttcattttaaatttcagaatgaactatctgactaaaataagcatataaatacatttaaaaattatttttgcttatttaaaactcatggagtatggtggcatgaatttagccagagaaacagaggagattccaaaaaccaaaactgtacctagccgactcactggtttgaactctaggcctgggggagtgttcagatgtcccctccccagccacatctttctggctctttggaattgtgagctgggtgagcctggctccttctcttttcatctgtgtgtcctccagatggcagtattgagcagaaaaagaaaacgctgggaaataatgagtctaatgtacagtaaaattggaaattgaattatagctcaagaaaaaggacagtagccttgaggtcccgatcaacctggactctgatcacttttgtttgctgtacccatgtgttaagttactagcaagttaataacaacacgtgagcagttcaaggctcagtagaattgcttcagacatgaaataaagctaaaatgaatttgtgtccaatatcattggcattagtgctcattactgttgtggtgtaatgcctcaaaccatctaaaatcaattttaaagattacccattattttataaagaaaataaaacacatttccaacagaaacaaagccacgagtacaatcccatgaacagttccttgtacttatggcaggcaggaaaccgctgacagaggccacaggaaacactctgctcagacttcacagacttcacgatccaagttcgtattaatggattgttgctctataactcttctcttaatctgaagtatttaaaaacaagaatggtgaatatttgtaaatgtagaaaataaatctcaaagagtagtaagagggatttactacttagctacttgtacttggtaaattaatcattatcatgtgacatggtcatcttttgggaggacccagggcggaggacacagagggaaaaagaaggatttagctgctttgcttgaggttttgccttttaaaaagcacaaaggttttacttttccttctaatagaccagtaaagaatattttctcaaactgtaaacctgctgaagcaaaggggacagctagattttggttttaatactgtgcatttttaggcatttttgcctttgttaagaaataattgttttattttgtagaaaaggatttggtattataatgaccttggattttcactaaattgatattaatggccaaaagagatttactttccttattacttgtttaaacaagcagaatataaggtaaggttcatttggtctgaaatacatgatctatttttcacagatcgttatatcggaaaaatcttatgttggacaaaattctacttgggttttagtgtgttagttttgtcccctgtatctggtcttagtgtctcctcttacataattattgaactatcagtagagactaaatgatcatatgtcaacatctttgctaaaagataaaccagtttttatttaaatataaaggtatactttgatttgatttcatattctaagatgtgcatttcagagaaaacacattcactaatatgaatttgagcatctgtagattttgctacaggatagtttttaatcttccatgtagttctgatgccctggttgaaatctgttctgtctttgtaaactttgatcttaaatgtgggaagagcagtatgtattcatcacaaaattatcatattttaattatatatatggtaaagttggctgggatcaattttatttggttgctcattttgacaacacagagattcagtgctcctaaagattttggagaaatttacagttaaccttaagtattaaaaaaagccatctctctcatgagctgtcgtaaacatgcccttaagtatataactgtaaagttttaaaatgtaaaatatgctgagaattgtattttcttcatataatttttaatagtagttgaaagttttgatgtttcatgacagcctatcccataaagatcactgaattgacatgctgttggcagtaaattttttaaagtagaataactttctatgactatataagcaaaatatttccataattaatccacatggtaataagagatgggtaaattgaagaaatgtccttgaagttattcttttaacagatgttcttaactattagcttcatgtttttacccacctaaatttccaaataattgaataaaagttaacatatgctttcctccccttaatgggcagagcccataattgatacaaagtttaccacagtagagaaattaccttcagtggtacttttctaatgtttttctttcttctaccctatcactgaccatcctgttcaccaattatttttccttttttttttaatatagagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaaggtatttccttgcattttgatttaatgtatatgtatttatataatacatagtatgcacatatgcacgtgtatagatatatatacacacttcacttttttgttgatataatactaagataatgaaaaaattaattgactgagattttattgagctgtgacagctcatcatagtagtcttcacacacacctccacactgaattaatgaatgcagtagaaattcaattatttgcattctgattatgtgactttcatttagtcagacttgaattattcgcgtttaaattatctagctaaaaaaatacccaactgcactccaaatggctaattaaaagtccaaatttcctgtctctctttgtgactggagataattaaagttctcctctgttactcaggctttgagtgtgttgtgaaaaccaatttcctctttttattattttccccctctcttcttttccagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 2031 - DNA, 82435 bp, Homo sapiens; identical to SEQ ID NO: 2027

SEQ ID NO: 2032 - DNA, 51182 bp, Homo sapiens
ttagtgtagatatagacttttaaaggtaaaaagaaagaataaagatggagggtgtgataatcctatgaagtgtctgggtttgggtcctgagggcagccaattacatcccagactcactggcaatcaacagtccaagccagggtcccatcagctgaatcctgaggtggggatgcttcagtctttacagaacagggtcaaggaagagtccagaaaccgccgtcattggcttcatgaaaaccgagcacgtctttgagatctttttcaaattctgcctctaagtcaagtcctacctggccaaagtcagaagcctgaaagagaaaaaagcaaacaaacacattgaaggatgaaggattacagccatcaaatcactcatacttttttttgtgtttttgtttttgagtcagggtctttccccgtcacccaggctgtggtgcagtggcaccgtcatggctcactgcagccttgaattcctgggctcatgtgatcctcccacctcagctcctgagaagctgaaactacaggcacatgccactatgcccaaagttttaaaacatttttttctctttcagagatcggggtgaggaggccttgctatgttgctcaggctggtctcaaactcctggcctcagatgattccctcacctcggactcccaaaaagctgggattacagatgtgagtcaccatgcccagcctcactcttatttttttaggagcccagcagtaaggcagaatggatggggagatgctgctactaaaatgttgaaaagcatgagactccagctggttgttaatttccacctgacaggcgatttagactgaagggttagttttgatcatggcaaatctgagcatgatgcaaaatagcttaacaatttttgtaaatgcatttcttggaagcccactcgctgaggaaggatgaccctctgttctccaggactacggatatgccaggcactgagtggctctctggtcaaccctttctccctgcagctccatgaatgggtaccagtttacaatctgtggtttgtgaacatgccaactcctggcatggaagaagggaaggaagctgggtggagatgaaaatcttccttaggtacctcccaagaaatatctgtacaagtgaggataaaaatcaggaaaaaccaaagttacaaatgtctgggattgcaggatagctcaaccagctgtccctccctagtaaaggaggatgaaaccaacattggatctgaaggcaattccagatgtttgagtccaatgagaaatttatgtgtaaaaatatgcaagcctgattatccaggaagtttaattgattttatgttgtttacttatttattttcatatttctgaggcaggaagaacaatgtaggcataaactgcctttccttccagtttgaacaaagaggctggatgccatttactgctctcgttgggagcgagctgccgatctgggaacagagcatggtttttttcagcttctgttccagagatccctcccctgtcctgcttgctgttctttttgccactcactccttgcctccaggaatgccgaggtggttttttttctgtaatccttgtcttgtttgagctctccccaggctgaaactgagtgtaatacttgcaaaattctgctgtcccagaaattaggggaaagtagaaaagacgcaaaaaggaagcaggaaatgctctttaccttgtaaaatgttttatggttgcgaaacatcaggcgcatgtctcgcacaaaccatgccaccgtgtacatttccgtaatcagcctttccttaaccaggtccaaccacattgcttcctgaaagggctcaccgtaatctcgaatcttggggacaaagccaccagaggtgacgttagcacagctgtcatcactggaatggatccaacttaaatacaatccaagccttcatttccagggtcataatgataataccatttgacctctttaagccagctattgttctaggcactagataaactaaattctaagccaagtatatgaatatgtaatctccacatttatgggtaccataaataataatgcccatttcatagatgaggaaaccgagggatggagaggtcaaggaacctacccaagatgtctcagcaagaaagtggtagagctgagatgggaacccacacagtttggcatctatgactcttttttttcttttgagatggagtcttgctttgtcacccaggctggagtgcagtggtgcgatcttggctcaccgcaacctctgcttcctgggttcaagcgattctcctgcctcagcctcctgagtagctgggattagaggtgcctgccaccatgcctggctaattttgtatttttagtagagatggggttttgccatgttggccaagctggtctcaaactcctgacttcaagtgatctgcccgccttggcctcccaaagtgctgggattacaggcgtgagccgctgagcccagctggcatctgtgactcttaatctctagtaggaaagacattcttcctaaagagaagatgaaacagatacacaggaggagaagcaacttgcccggtatcccagagcccgtgagcagtggggtggagtttgaaccaggtagtccctctccagagtgtgcagcaaaatccctgctgccccgctccactgctgccacgctgcccttctcttctgttctccagcttcctgagcaaactgcagcacctgccagatcagcccccaaatttctccaaatgcattttatgcaagagaaccgtaaaatgtgacttacattaaatgggatgcccgtaaaaaaggagctttgtggatgacagtaggccttcaagaggaggaactcacatttctgtaaaatgtgaagagggcttgaaagtgaaatgcagcttagaaacagtgaagccaggcgagtgtctagacatgcacacggatggggcagccaagcccagtcagcattccagccatgcttcccaaggcgcacagggtgtgtgggattttgtttagactctgagtttgggcattaaatcgtcatcctttaaagggagacattgaaggctccctttggtacattgccctgaccctgtgcctgtttgtgcttctcgtgtgagaagggaaaagtataggtttggggtttgcatccaactcaccagctggtcctgaggctgcatctgcctctccagggtcttagatacatgatggcactgttggcttcctgaagacctcttcatcctgcagaaggtgcaactccacagcatcctgagaggttggacacaaggtgagcagagggcaaagcccctggaaatggccaccattcctgtggctgccactgtcttccctcaggaaggatgggctcagccatgagggtgggacacctcccagagtgtccaagatccccacatggggtctccagcattggcccttccctcgcatcagtggtagcggcaggcgggcagcctgaggaaggtggtgtcactgttaagtgtgggctctcttttccctgtctgagctgctgggagcacaaaggaaccctgcctgccaggcttgagtgtcagaatctgggctttcacctgcagggacctcaggcctccatcagccaggtgagactatggtgaaatgtgtgacaagccgtgcttcctgtctttcctcaacaggcacagaacataagctggcttttcccgtcccctcctccttttggacaggagtccctgctgtccagggaatagcatactaggaaagggcacttccaggggcagaagcagtgtggggccaagaggctcactggcagtctcagagacccagagaggcccagagtctctggcaccagactgctctgcgtcacaccctcgtccccgacgctcacaggtcctgccctttccatctggaggtgagtgctgtgtgcccgaggcggggctgcatcccactcacctcttggcttccacaggggggatgtgacagtcctcatggaagactcgtggacaagtaccgcagcagagaagttgtcccccttgacagcacacctcgcattcatccgagtttttccgctgcaagggcagataacgtgggcaccgctaggaccatggagacccacgaatgctgaccctgtggggttctagaacacatcatttttgtgtgtgccagagtggatatccaaacccaatttttgatggggggagctgatgccacctccctgggggaaattgcaagacaaatggcacaacaagcagagagtctgggtggtgaccgccgccaccaggacttttcttctctggctgtggcttgccaacaggttctgctgcgttttgagctgtgctgctgcctgctggcaagcttgtgctttgagctgggccactctgggcgcatttgctgagcccaccaggcctctattaatagatctgactgaccaaagtaagaaatgatgataactggcatttgggtgcaggagtatgggaactgttgttcctggtgccttgcctaactgccccatggtcgtaacataacatggccctaaaatgttccacagtgggcatggatgctatgacccagtaaataacacattaaaataattaaaattaagttacctttggcacttacaattggctttacaaaatggaactctatggaccttctctgttaaaatatttaatactgatcaatatgaattaaaacacggctttcaaggattgaaactcattatggaagatctatttagagaaagggtgattatccccactgtttctccatttaacagcccaatttggtctgttcttaggcttggaaagaatgaatggtgcctctcggtgaattactacaacctgaatcctgtgaccccacctgtgatggcccaatgttattgaaattactgactccatccacttagcaagtggtaaatactctgcaggcatagatttgactaatgtgttctgttcagcgcctatttcaacagatctcagctgcaggttgctttcacccccgaagggacacaatagaccgttatctggctaccacggggtacctcgacagttctgccaccatacacaatctttgcaggcaggatttgaactgcatctgacattctctaggagtacaggtgtaacatcaccctgaagacacccttctttcagcaaattcatttgacacactcaggacattactcacaaagaactcatagaaaaggatggggtttgtgtttccacatggtgggattaaactaaaacaaaaaagtatgggccactgccccaggcatagtacagggatccacaccaatttctggccattgtctggtcagttgagggatgctccatccctgacactgtcaaaaaataattattgaccctctgagtactcacagtgttctaataaacctcccagcatccttcaggcctcttgagttcaaggaaacacatccttcatttgtagattttaggtaagcccatttacgctgttacttgcaaaataagcccactttgaatggggccccttctaacaaaaggttctagaatctgtcaaattgcaatacagcagacattagtgccctcctgagtctcattcactgtggaagctttggcaacctcctctcatgcctcctggcatctctggaccacccatgatggccatgggcttctgatacaaaaaaaaaccaaaaccccaaaagctgttctcctcagcctcacactatatgctgatagagtggcaactgctggctgcatccaagcccttctggagacggaggctctcacaggccaagtctgtggctctttacaccagctgcccatcatgtgtgggtcatggaggcagcacgctgcagggcaaccacaaaacacattttgggagtaccagcatcggtctctttgttgtacacatacataagtgagactgcagtggagacagacggacgtgctgccgagcagcagtgacactggatgatggggctgagggcaaggcccgcactggctcattctcagtcgggtaaaccttcatcttattctcccaacctggccctggaaggtgggactgagaggctgggtcaagcatgcccctggctattatgagctgacatgtggcattaggagagttagagggtattaccatgttggggctattaattaatgatctggattttaaagatttttttttttctggttgcaaaagtaacaaatggtcattatagtaattccaattgtacataaaggtataatacagaaggcatatgtccctgtgatctcatctcaaaataagtgcagttgattcttttggctattttttcactcatagacctacctacacgttcacataagcaacaatgggttccttccccacacgtcacaactagcattaagtgtcctgaagctctcctgaccacaaaaccatttggtggctttccattgattgaaggataactccatacttatgaatccatgtatttaaacaaatatctatatcaaaggtctaatattctataagaaaagtttaaaaaaaaaccattctgtagctgtatcagtttattctgcaatactgatagaacttgtgttcgtccctaattttttgctattatgatgttacactgagcacccctgattctcagggtatttcagaccagcatgggaaagatgatttatataatagatggcattgggagaccagtgccttaaactttgaatgaatccagcctggtcaggccagcctccagggcaagatgggggaggcaccattgtctctgctggaagttcacaactaacgggaagctcatgagtggagctgatgtgtctggagaacacatctaagcaagtagaggaggttgaggagggggagttagtgcagccaatagatgactgccatttccagctgtagggatgccctgtagagacaaagctcagttcaaaggcgtcattccatcctggtgctaccaataagaagcatggaggattcagcaatactcagtatgcaatcatggatgatcctcttgtcctttcatatactgttcctgtctatttcaatgccttttcttttgcttttcatgctgcagcattcttttttttttttttctgagacagggtcttgctctgttgccccagctggagtgcagtggcatgatctcgcctcactgcaacctctgcctccagagctcaagtgatcctcccacctcagcctcctgagtagctgggactacaggtgcatgccaccatgcctggctaatttttgtatgttttgtaaagaaggggttttgtcctgttgcccaggctggtctcaaactcctgggctcaagggatccacccaccttggtctcccaaagtgctgggattacatcgctctgtatagcaatacagagtctcactatatcactcaggctggtcttgaactcctgggctcaagcaatcctcctacctcagccttagctgggactacaggtgcacaccaccattcctagttgattaaaaaaaaatttgttagagatggggtcttgctatgttgcctaggcttagagcattttatttctgacacctttggtttatagccatccaaatatccagatctttttctaaaacacatggacatgatgagctttttcatttaatttttattttagagtcatttgcttccccatcccaaattaactatgcaaattaattgttttgaagatgccatgcccaaatgtggaggtgactcagagcttggaaactcagaagctctaaggtgagcctccagacagggaaagtctgcaacatggtgactgagagggtagtagaaattcacttgctatttaactctctcttgagatttattcttggaggacagagcaaaagtccactctgaaagacagaaggagtcaatgaatgaggttattctggaggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagaggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcattccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacacgggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgacttaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggtgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggagtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccaggaacccggtgggggatgcttggggctctctaacggcagctggcttgtttgaaaggtgagctgcagcagcggtgagtttaggtccccattaggaagcatgagcaaacaatgaggagcctgctgtgaaaagcaagcaattagagaacagagagctcagggaaaggaaaagcaaggtggagaaaactaagaagaaaagcctaatcgagatgaggaatagcggcatggtaaaaaacgaattcataatccagaagaccaactccaggaattcctacagaacatgaggaaggagcacaaggtggaaattatgcatggaaagaccacaggcctggggagtgatttgggagctctatgatgtatacatgaggggtctggggaggggatgattgggggtggagatggggcggtgggaggaaaagtgatagtcaaggaaacagtaagagcagcagatgcactgtgtcatctatccgcataacaatgtgtaagaaagagaaggcaatgactgtcctcattttatagatgagggacttggggtcagatgtggagagagaattgccggtggtcaccatattacatgaggtggagctggcactggaatttacacatgccagacccagtatctagcgctctttccacatcatcagaaatgccacgagactgcacatcatacaagcaacaacagcacagatactctgcatttaatgagaagttacagacagtgcagaagggagaagaaactgatgctgagggacaactgtcaacgtttgccggggctcctgcctccaccagtgtttgagagtaggtgctttctaggttcatttacatttttagtgtaaaggaaaaagggcttgaaattggaacacataggttgattttagctcattcaagtcttttgccctttaattgaatctgtaaaatgggctgataacactcacttattatggtaattaaatggcaaaatgtagatcaaagtgctttgccaactgtgaagtaatgtacacatttatatggttatcaggaccactgcatgaagttgtatgggttgtgccctgagcaaggactccacctttaaggggtgctctaattcatattagaaacagaatcagtttacctgcttagtacaacaatcttccagcagaaggcagaaaagggtttggtttcaagaattggctctgacagatgaggtagtgaattgaggaaggggcacctttttctaactcacacacatgcatcagataggcccagatactggtattcatacttgaagaagtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaagcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagcactattcacaatagcaaagacatgggctcaacctaaatatccatgaattatagactggataaagaatatgtggtacatatacaccacggaatactatgcagccataaaaaggaacaaggtcatgtcctttgcaggggcatgattacagctggaagccattatcctcagcaaactaatgcaggaacggaaaactaaacaccacatgggttctcacttataagtgggagttaaacaatgagaacacatggacacagggaggagaacagcacacattggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacgaggtgggagcattcggtatctggtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggtttacaagctccttattcttgtagacctgccaagcagcatgcttgtagatggcaccagtctggggaccccaccttgggtagcacctattatactttgataatgaataaaaagggccagtgtggctggcgcctaaaaaaggaagagagggtgacaagaaatgatgctgaagaagcaaggtataaaagcagaagaaaaataaatgcaagaagaggagtgggagggagaggacagagatgcaaagagggccgagggtgcagagaggctgaagcaagcccagggtcccaaccaacacaggaaaaggaacgagaacactgtcaggctgtgcttgaataagggtttcctttaattcctagaatggaagacatagaagttcattttagaatttgacttaaaggtttagtgatcatccttaatcatttttgggtctttgtatagctctgtgttaaagaatccttccaagtatggaaatggccaccatgcacaagggggtgggttaggctggcagcactcctgatgcacccaattcagctggtacccatgacggtggagaacaactttggaggagaagggagagagaagaaggagagggcgggtggagcttccagcagaggccagggctctggggagcccagtggggaggcgctgtggcttgcttgcttacctcttcggtgaatatttttctgaaatctcctttttgagcttgaacagatatctttctcctttttcttttctaaacacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatgtatttcaagccctccagtggatgcctgaaaccatgggtagtgcccacccctgcagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatcacataggaagggctttttaaggaggaagtaatgggcataaagcagtggttaacactgggtgattttgctctcaggggatatctggcaatgtttggaaatctatttgtttgtcaggacggggaagcagctgctactggcatctaatgggtagaggccagagatgtcgctaaacatcccatgacacacacgacagcctccgaagcaaagaattattcagtccaaaatgtcaataatgccaagattgagaaactctggcataaaccatactgctaaaggtaaactgatttgtctatctaactaagcaaatggctccacaaccaaaagcttcttaagttcaaagacagaaaccaaatcagaaaaactaataattataacaaagggttaatttccctaacggatttaacaaaaaaaaatggccagtcttatagaaaaatgggcaaattcaaacagatgaccctcaaaagaaaaaattccaatgtcaaatttatttaaaaaacaggtaaattggtaacgataggctaggtaatgctgtggtaattcacgatcctcccaaatctcagtggtttattacaggtgtcagcaaactatggtctaagggccaaattggcctactgcctgtttatgtaaataaagttttattggaatacagccacgcccatttgtttacgtatttgcctctggctgctgtcacgctacaaaggcagagtcgagtagttgcatcttctggtcctttttggaaaaaatttgccaagctctggtttacaatggcaaaggtttacttctctctcatgctgtttgttcatcataaattagatgaggctcagccctacatcactgacactcatggcttctgcagacagagcagcctctgtctagaacatccctggtcttgggcagagagaaagaagacaaaggggctcttaaagccttggcctgaaagtggctctctaacttgggtccacatttctttcgctaagttatcacatgggcattcctgagtccacaggcagggctgtagacttctgaggaggtggggcactggaacactggagaaccgtaatacaagctaccacagcatgtttgatcacctgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcaatctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttctctttttcaagtcctcattttgtttagtaattacaggtgtatcaattagaatgcaagctccactagtgtagggatttgtgtctgtcttgctcactgctgagttcccaggacctaggacagatacctggcccacaccttacactccactgctgaatgaatgtttaataggcactaaagttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatgttaacatctatttttttttgacttcttaataatggccattcttgcaggagtaaggtggtatctcattgtggttttaatcttcatttccctgatgattagtgatgttgagcattttttcagatgtttcttggccatttgaatatcttcttttgaaatatgtctattaatgtcatttgcccactttttgtgggatttttttctataatgtttgagtttcttgtagacgctggatattaattcttcattggatgcataatttgcaaatattttctcccattctgtgggttgtctgtttactctgatgtttatttcctttgctacgaagaagcgtttcagtttaattaagtcccatttatttatttttgtttttgttgcatttgcttttggggtctcagtcatgaattctttgcctaggccaatgtccagaagagtttttcctaggttttcttatagaatttttctggtttcaggtcttaggtttaaatttttgatccatcttgagttaatttttgtataaggtgggaaatagggatccagttttattcttttacatgtggctaaccagttttcccagcaccatttattaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgatatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttagtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcatggtttctatttattcccaatttaatctaggaggggtgtatgtctccaggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctagttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagttttgatttgcaattctctgatgatcagtgatgttgagcgtttttccatatgtttgttggctacgtaaatttttttttttttgagaagtgtctgttcatatcctttgcccattttttgatggagttgtttgtttttttcttgtaaatatgtttaagttccttgtaaattctggatattaaacctttgtcagatgggtggattgcaaaatttttctcccattctgtaggttgcctgttcactctatttctagtttcttttgctgtgctgtagctgtttagtttaattaattcccatttgtcaatcttggcttttgttgtaatagcttttggcttttttatcatgaagactttgcccatgcctatgtcttgaatgatattgcttcagttttcttctagggtttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccaggaagaagttgaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagagacacaacaaaaaaaaagaaaatttcaggccaatatccctgatgaacatcaatacgaaaatcctcaataaaataatggcaagccaaatccagcagcacatcaaaaaacttattcaccatgatcaagtcggtttcatctctgagatgcaaggttggttcaacatacacaaatcaataagcataatccatcacataaacagaaccaagacaaaaaccacatgattatcttgatagatgcagaaaaggcctttgataaaattctacatcccttcatgttaaaaactctcaataaactaggtattgatggaacatatctcaaaataataagagctatttatgacaaacccacagccaatatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagtatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgttttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttatagaccttgtgagttttatgctttcaagagtttgtattctggtgcatatcaatctttcgtttcaagagttagaactccttttggcatttcttataaagctggtctggtagtgacaaattccctcagcatttgtttgtctaaaaatgactttatttctccttcattcataaaacttagctttgccagatacaaaattcttggctgagagttattctgtttaaggagactaaagataagactccaatcccttccagcttgtaaggtttctgctgaggaatcatgtatttttcatccttgcaaatagtaaagatttccctgactattacatcaataggtttcagggggagggcagatgcttgctagaattgagaagccactgctcagttggggccattttggcaagcttagacaaaatcttgaagcacagtatttgttgggagcaaagaggaatttataaattccaaaaattacctgtacctatcaaaagaaaactttggaggtctgaatgtcaagttttcctataagtcattggtagtgaacactcagcaaatgacagagagtatgtttcctccagcctagggaggcagtggggtggggaactaggaagaagaggccagggaggggaagtgcaagcaggcagatatgactttccttctaggccaaaccccaagattgaggcatgctgggaacaagcagaaaaattagagggctttccaaagcagtgagcctcatgtcctaattcatgtttgggagctgggacaagatctcttcccaggctggctcccataaaggtacagaatccaagagaatccccactgaccggcatatcttaggccctttgtgaataattttgagtaaaagaataaagaaaaaggggccaggtgcaggggctcacacctgtatccgagaactttgggaggctagggcaagaggatcacttgaggccaggatttcaagaccagcctggacaacatagcaagacctggtctatacaaaaaatttacaaaataaattaaaaaaagaaaaagggaaaaagaaaggaacagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcttggggatttaggtttcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctgtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattaggggattgaataaagatggatcaggaatatactagaggactaacatttaatatatgtcatttaaaaagttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgcatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatccatgtccctacaaaggacatgaactcatcattttttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttgggtatatacccggtaatgggatggctgggtcaaatggtatttctagtcccagatccctgaggaatcaccacaccgatttccacaatggttgaactagtgtacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccatgttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctccctcttccacacacttccacaggcgggaaaagaatgtggagagctgcaatgggctcttacatgctgtgacccagaagtgacacccatctctctggcttatttgccagagctagtatagcagagctgcctcctgcaagggggatgataatggagctttccaagtgtctgggaaggggagaagaattggaactagaggagggcagtcataatgcccaccataaacatgggcagggtgagcactgctagttgttcctctttctctggtctccctttttctttagtaataaagcccctgattctgagccccttattcttatagattaaagattacatttcccagcctcctttgaagtcaggtgtggccgtgcaaccagtcctggcaataaaatgatagaatttttttttcttttttgagatggagtcttgctctgttgcccaggctggagtgcagtggcatgatcttggctcactgcaacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatggtgacagcacactgcttttagaaaagtccaggaacttttctatgttgaaaaaaagtgaaatcatgattttaaaaagcataacgctttttctggcttggatgtcttttatggcctagaatggcataataacagtaaggtaacatcaatccacaccacagagaccaaatagtttcttcttcacacttatgctctgccctgggagattttcccagagagagtttatttccattatccataggatcttggaagtaatgagaaagtaatttttgaataagcagttttctattttgggcaatagtgaattgacaaaggtttgacagtattctttctgccccttcctttctatggagaacgatggctcctgaaaagagttcctggggaccaggttgttaacccggtggcagccagcccttacccaggggatcctgaaaaaaatccattaatcctttccatatcttaatttcctcatctgctaaattggaataggtcattcaatcttctccaagggtggttgtgaaaataaaataaaattatccatgagaaaagttgaaatactactagataagccagtgcaatataggagaaactgttaaaatgataatttagattttaaggtggtaaaatttaatccatttttcctgacaataattagatatttgttgtttgaaaatcacatttgtcatgtgagagttctgtgatttttgtgacaatgaccatatcaccagcaaacagacgaatatctagctgttttttcccctctaaggatagtgttatcaacttactccagaaatgtgaataatggtagcgatagtgaggggtgaattaacatgcacaattttaccagcacatgcccacaactccaccagttgtacatgctcagtcatagtgtcacatgtgtgttttaatgagtttttcgcttctcaattttctcagaaaggccacatgagaaatatggagattggaattctaggaaaaagcttgatccatgggttggatcaagctgcactttcgacaagctgtactttcagtatagtaccatgaatatacttaggacactcattctcagtaatggtgatattgctgccagtagtggaaaaactcattcttgagtgctgagaaaaatcttatatagtgcagatatacatacatacatatggacacattacataaaatggacatatatttgtagtagtaaatatcatgggaagggtcttgattaagaaaaaaaaatccagaagggctctctagcacagtaataatgaaaaaaaaaagttaagaaatattgcctcagtgtaagacagctctgaatttagattcctggtgactgtactctgagaccagcaatctccaagttttaccttgtgtgacccttcgtggtgtactaggcgtcttctgggacctctttccttcattcatttctgaagtgccatcaatgatctctggaaaatgaaagatcttagtaaatgccccttgggaaacaccatggagaatctcccagagacccaggaaggcccttgcacactctgaagttgagtcttggaggctccaggtcttaccctcctaacaatgcatctaccaagagatttggtgctgctcatgacactgtgcctgtctgccactcaggggaggagcagaccgcagttggttagcagtggttactctaccaatggagacatccacagtggggtgcagccatctgaaccccttggccagagtctctcaaagtaaggtctgtgagcccctagggggtctgtcaaaccgtttcagaaaatttgcaaggtcaaattgttttcataatatgatgttatttgcctttttcactatttcaacctttgtacagattgagcaagagcaatggcagataaaactgctggtgccttaagacacatcaaagcagtgtccccaaatctcagcaggaatcactgcatcctttattgccacctactcactgtaccaaaaaaaataaaaataaaagcaagattcacttgagaatgtttttggtgagccagtaaaaattattaattttattaaatttctacccttgagtacatatctgacatcttaatattctatgtgaaaaactgaagagcacatataaagcacttctattgcatcctgaagtaccacagtggcctcaagaaaacacttgtgtgattgagatacaagctcactgtataattccaaatgtatattttccaaacagctgtactattataaaatcttgcattagtagaaggtccattcaaaatgcaaggtggattaatgtattttattgtaacagagtatgaagttaattgatatggtttcaaattttacattacaactaatatttaagaaactatcacttgttgagtgttggtgtagtattaaaggtgaatatccacagatatctcaaaagactgttaaattacctcacccttttaaactagatatctgtgtaaggccagattttctttctatccttcaatcaaagcaacatatcacaactgaatgcagaaacagttgtaggaatccagctgtctttttataaagctcactcacaatcaaagagatttgcacaaacataaaatgatgtcactcttttcactaattttttttgttttagaaaatatatttacttttcataaaataatgctatttatgttaacaggcaattggtttattattgttacttttacatgaattaatattttaaaattattagttttaatttctaatcaggtacatgtagatagacataaacaacataaacagaagctccttagggtcctcaataatttttgagagcataaaggagtcctgagaccaaaaaatttgagagctgctgccccaggccacagctgtccctgtgaacacgtctgtttcttccacaaaacttttcagatgcaacagatgcttgctctctttgttcctcttgttataccccatcctcattctctgtactttttccttttactattgactttacatatctacttaactctgtacctgcttcaggagagaccctcccacactgagccattcaaatggcagattccatcatcagccttaccctctgatctcgactttcgggcacattcagttctcgccttttgggcccttgtctctaccgtggagttacaagttgagtcatctttcttttgaggaacctgatccacccttttgagcttcttttggattccgtgtctagatgaggctgtccctggaccaaataatgacttgttaatagtttaaattggggtcttcagtgagcctcctacagtcccaatcagtgacttcccttctcatgcccctaactcccactctttcagatctctgtacccctgtacctcacttttctcctcctacttctctataattatatccttcttcttatgtgtacctttctttgcctccccaaattaccatctgctttcactcctggtatgacctgttgcaatcaactagataaagctggggaaatcctagagcttatttcctgattttcgtttgtgtcggcctgcaccacgaggtggccacacagtctcgtctaggtggagaggaggtgtcttataaagcacctctccaggttcccccacggcctgtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagaggtgagtttgcttcattgtggaaaaagaacacaattttcaccggctgttgactttagaagctgatcccacaggatgaccgctgtcctgttgaacaagaacgtttctctgcaggttagaaaggacacagagtgtgcagccatgcttcccgcacgcaagtgcggtgatatccgcaggccacttccggaggaaaaggcatgggtgaacccttaagagggggcggaagcgaaagcccggtgggacccagggctggcgggaagttcaaacacggaagttactgaatatttatccagaagaggtggggcagcctgatagagcctaaaacttgcctttcattgccaagtttagggttttttttctgcataactaaaggagggtttcggagatgagaacacttacagaaaatatgagagtgtggtatgtatattttcagcactactatatatatttttctcttacaattttgaaacatctttttatgtgttttgttttgtaaaaaataaagctgattaattaaatgtaaaataatatgactcttaaaaatatctctgttgggctgcgggcagggaggaatggggagttgtttaatgggtacagggttttagttttacaagataaaagagtcctggagatggatggtggtgatggttgcacaacattgtgaatgtattttaataccattgagctatgcacctaaaaatggttgagatgataaattttatgtcatgtgtattttacccaggtaaaaaattggaaaattggaaaaaagaaaattaaaagcacatcatctgtcacatttaaaataaaacgattcttttaaaaaacctgaaaaatttcatttaaatacaatatgaagaaaggcaaatctggaagggactggagtctactcctttcggtagcttggcagagagatgtcaaaaggtcagagttacctcaacagaactgaccatctgacactgactccagaggtttcccctctctaacaaagtcacttctctgaccagggagtgttcataattgtatagttgcatagacattccctgtctccctaatcctataacgtgtagagcattgtgagagtgggcatctcactactgggctgctggccacggggtgtgcagagtacgtatgtctgccctaaatatgggataataagaatttggagaattgtattggaaatttccctccaataacctttagtttgtatctacaccacgtggtgcccataatgtctatgaccccttttcataacacaataatgaattcataaactatcctttgtcagatcattattcaaattttgggttacagaaagtatggtttctttcatttttttttcattaaaaaaaaattaatagctaatttgtgccaggacattaccatctagcctagaagagacacattatgtaagtaattacaatagagtatttggaaccttccaaaagagccagtgctgggtgctgtagaaattatgggaccagcttggctaatttaggggtcagagtatgtattcctgagatagacataagtcaacacgactgatgaaaaggagataactaaacatttatggggagtagtgtaggttcagaatatagcatccaaagagaatagcacatgccaaggatcaaaggggagagaaatgaaatgggaagaaatgaaagttcagagtggttgactggagttttgagtggaaagagatatattaatagttggagggtaaggcatgagttagactggatagaacttaacaatcacattaaggacagtgaacattaccctaagggcaataggaggccatggacaagatttaagcatggaaataaactaattagattttaatgtagaaaagaagagggtgaaccaatagaccttgtcaatatgctaatagagttcagttagtcacggatgactaaggtttttgcttggcacctgggtagattaagttcctcatttcaagttaaactacaacaggctcccaagggcctgtgaaaccctacataatctgattcttgtttactttttcacttcctaccaccttctttcttcatcatcaccaacaacactggtctttcctctctgcctcaggttctttgcacttttgagtccctctgcctggaccatccaatccaaagtgactcccaccccaacctgcaagtcactattgtaatcctatccattattttctttcatcctgtcatcagtacttgaaattatcttgtttatgtgctttctagtttatattctttccttcccccagccaggatgtaacctccatgagctttcccctttgttttttgcttactttcttactttctctctttaaaaaaaaaatctgtcttcagctttcagaatgggtatatacagttagtgctcactgcatatttgttggaataaatgtctgaatggtacttagaagactaggtttttggtaaagaaggtgaagttaatttcaggcatattgagactgtagtgtcaatgggagacttgcaaacaaagacgcccagtgtgcagctggctatgtgtttcttgaagacaaacctgagttgaagacgtagagttgggagccatcagtataaaggtggtaattgaagttgtgagagtgattgacaaagctcagaagtgtgagttgaataatctgactagtttacaatgaaccaaggaggcccatagagaatacacataacatggtgagagggcattgactaataagtagaatgggggagaaagcagcttgtctctccttcctgcccaggaaggtcacttacttttcttagaatggaatcatttctgttaagtgtcttaaaaggacaccagccctgtgattttggacactgggatcatactaatgataaactaagtcagggaagaggagctttaagccactggcttaggctgccatctattgctctgtttccttttacagctagagttgtctacatatgttatcacctcccattcattatccttcccacacaactggctcctgcctccatcaccaaaatttttcttaaattttccagtgattctttgtgaccaaactcaaggccctcttctctgaatttatcttagtctctcagtatagtcaaccattccctcttggcttgctaacatgttctttcttggtgctcctctgtcttcactggtctcgttccctcagtctgtcttgctagattcctcttccactgggattacttagagcagggctaggtctgtggttctcttttcttctcccatagatcagaatacctttattttattgataactcatatatatacatatatctggtccagatattatatattatctggtccagattttatatatatatatatatatatatatatatatatatatatatatggaccacactttttcagtgagtgccaaattgccatattgtggggaatataacttcctgatttctcagtgttcctgtaaaaagccctagtcccggagacacagaaatgtatgcaatataaatataggaaatacttgctttcacttccccagaaacattttcctcttcccacaccatgagaattagagctatagctatttttctagttaattactctgatctagagggagaatagaacctctcttatctcctgagatggccaaatgggttcacccaggactagcttcctaggttaaatcctaaagtaccaggaaaactggagtggtctttccctaggtatttatatatcacaaggggtaaagcccagaacttggagacatctttaggttgtaaaagccagcaacacctagagtttctctggcctttggaaagatgcatttaaattccaaaggttaggatggagagctttggaacgaggatcttttccattttatctcaaagcagcaaagttttttcttttcctttcaggaggaaaggatgatggctatccctctcatgtatctaaacagaaaaatccatcattctacatcccttatacatgagttgtagtctattttgaatagaaagattccattagctctcttagcattgcctttgggtttgtgtatgggagacagacgctgcaatattgctctggctgataagctggttgtgaatatcagtaaagaattattttccctgaccagataccttgtgttcctgcagcactcatatatataaggagataccaatgcaagtggagtaacatcttagaccctttacagttcttgacaaaacacacatctatacacagctgcatagatggctagcagaaacctctaaaggaacaggtcaataattgaactctaagagttatcccccaatatatttgcatcttccctcagcaatgggcattaccacttacttgttcaagccagaaattgaagagtgggccttgatttttctctttctcatctgtagctaataatatgtcaaatcctgtcaacaatacctgcaaaactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcctgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagtttggttgtgaaatgaaggagagagatatggaagtagttgaagtgagatgagaatcaagaaaaagcattttttaatgagctgtgatacatgtaatgcagattcttgtgtgagacatactgctttaatgaatacttgagagagaagggatcatggatactataagatgaggcagaaggattgtcttagaagagaaggagggaactcggagaggagggagacagatgtagttagggtttgtaggactagcagcacaaataaggggattctcatctgatatctccttatggtgcaggagggaaagtcactgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttctaggaaaaggcagagaggaaaggcaggtttaagataatggcaatagattactgaaatgatgaatcttggactgtgagttagtgtcaatgttaaaaagctgggaagcaaagaaaagcagatgatggcttggaaggaggaaaggccagtggactggtgatccaaatgaggttgaaggacaacttcagaggaaacaacaaataaataagcacagaaaaatatatttttgattctttttcttttgttaggattgggctgggaaagagtgatcagaggttgaatgatagctataaaaggagaaaagctcaaggacaggtatcaaaaaaggaattctgaaattaactgttgggaaatcgagccaggtttgaatgacgatagggtctatagcttgcctttgggtatgggaggccaagaattggtggaggaaaaagtcatggaaaatgagaagatgaaggatttgaggggccagagtattggataacagagttgtctgttatccgtgtgtaccctgaaggcatctaggatgatgctgggacttgaaatgacagaaaagcagcttttgaaaggattattggggaaattattggatgatattgatgatgagtgagtgaacattttaattgaatggttaagactcaaaggagaggatcagggaggaaggggctggatggggccagtaggcagcaaaggacagacatctaacctgtctctcaccatgaggtgtgagtgatggatggcagagaatgcctagccatgtcttaagaggaagtgggttcctctctggggaaccaactttcagttaaagagggaagtgcaattaacactctaagaagttgtgaatataggagattgattttttcagaacaggcaattccaatggcatatttcaatacccccaaatgccttctggtttcctgataattttcataaaggcctttttggaagatgcagcaaatggaaactgcagaaacgaactgtgtgtggcatcaggactgtggtcacatagtggtgctcttgacaagatacagtcagaaaaacagaaagcaactctgaattcacccttctgacctctacagaagaaaggcttttcttacctttcttgtctgaaggtgtgctggacacctcctggggctcttctgggtcatttggttctggagaattatctcttatctctgacaaaagaaatataagtcatttcagagctcagatccagtgaagagaaagtgctgagggaagtcaatgcaagaactagaaaagtagaaagtacatgcagcccagggccgggaatctgcttgccctaagaattccctggctctgtcttgatttttgccaacttgtggttattgttacctgtgcgaccatcacagggaactagggcacaactgccccacagcagaggctcagtctgatccttttagagagattatcttatggatggaagagaagtgagtgaagaaggtgcaatgaatggaaattgcaggaataaactgtgctgggtatcatgactatagtcacatggtttctgctcccagcagcccctgctcaaggaatgaagctgagagcggaaagtggtgatattgaaatctgatgtccatgatgaaggggaatgtctttgctgtatgaaaaatacatcttattgctttgacgtctatgtgtggatattctttaactgctctatctgtggttattttacttggagaaatagtggagaaggctaaatgccttatatatttctgtatataaggattgtttgaagaaagcaggagctagcctgtgcttgctagcacctgttaacagcaaagacatataaagctctgctagtttttgctgcacaaagaaagacagagaacttgaagccataacaaataaaggctcatctcacatgaagctgtcacctttttctttacacactgcattgagattggtctcaaatgctggcctgcttaggaataggtgactgaggcaggtggcaagcagtcattagatctttggaataatttattacctttcaagttatattcataatatcaactcttaaactccaagtgatatagaaatgaccagggttgaaagtgaaaattccccacagtcaggtgggggcttggaaggaggaccatccatgtctgctgcagcaattcactattagggccacacagtgtttttgttcatttgctttgcattttgacagagccgttttgagcactactttattgaagtggcctcagaagagtggctctgtcaaacagtccagcctgactcagttcccttgctttcccctggggttcctgccacaaccctttgtggcaggtgaatgtttccctttcaggcgctttgtggcatttggagtccaaacctacaggcactggtggggctctgtccatcatcatccgtggccctatccaagtctaccttttccagacttgcctcctttgccctcccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagttttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattggccccttctgtttcttttcctttgtattgctcagttctttttcccagggttcccaccatagcctcttggttggcagacgcatgttctcccttcacagtcaccttgagctaagcggtatcagccccagtcagtgttaccttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagatgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccattcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccaggggtttaacttttctttaatcttggtgtcatataatttagtcaataatgaacatgctatagttttaaaagaggtctctgttttaataaataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttcatgatccattctttctcagaccctctctttctgtggctatgtttgcgattcactccctttctctgtagctaccttttttcccttctctggctttacaatctgccttccagctgtccttgtccggactagtggttaaaatcttgggccctggtattgggagacccaagtaggactcttgctctgcttcttaaccaacaagtaattttgggaagattacctctgggctttaatttctctgtcagtcaaatggggttaaaaatgacttcaaagggttgttttaaagatgatgtgagataatcaaataaagtgtttgcgataaggcaccaaaaaaagatacttattattatccgtccacattcattttttcttcctccctggctctccttgtccttccaccagacctgatctttgtaactttgcatttctgtcaccttatgcattccctatagattttccagtatgccaaattgtatgatttttttccaaattcatagaacacataagaaatgtttatgtcctctagaagttcatcttagagagttgggatcagctttagcaaggggctgctcctgcagctgtaccaatgagagaatatggtccattccaccccagagagaaggcgggggattaacgtgcatattccacagggctagaagtaaacccagacttttaccatagcaactttttaaatgcaaaaagcacttgagaaatctcattaccacgtttgaagcttctgtaaatcgtcaccagattgggatattcacgcaggttaatttgactgaacaatgtcaccagaagagacaggttaaaagtcctctccagttgggtgagaatgttgtgcaccactctggatacagggatcaaatttctacaggcttccagagattcctataaaaatggagtgaaggtttttataaatgactataaaattgaatgggaagttatacatttatggttttctaagttttaagaaagctaccttactcttttaagaagaaattcaacataaaatatatagtcacattctctaaggtagagcggtcacagttttacatgcttatttttgaaactttacacatatttggatgactagcaacaaaaataaataatttagctttcttaaagtaagtctatattctgaatccaactttcaggcacatttgagacgagagaaatttgaaggaaggaaagtggggttaaaggatgctactatgtaattgattctttaaagctgtgggcaggatacttcagcaatggttctagtgatggtcacagaggcaattctgctggttgcttgtgagcctctgctcagtctctctctgtgtctctcaaacttgagataagcctgaatggattccagccacagagaagtcaccctgagaattttccttgcctagaggatggacaaaaggagaaatacggcaagagagaactgattgcaaataattattgaacatctactaggctcggtcagcgagtctttgggtacacagcactgaataagaccaacatggagttgcctatatttgggggtcagggtaggcactgtcaagtggagaagatgagcattaataaacacaaataaatacccatttacaattgagagtagtgttacggagggaaagcatagattgctatggaactgaataactaaggggtcttcatgagatgagttggccaaggagatgtctctgaggagtgctctctgggctgtgatctgaagagggagttggggccaaccagactaagactaagggaagattattggcacttccttgagtctagggctcaattaatgcttttaaaaaccaaaattatataaaaataggtccacttttgtccacatagcatatctcccagtgcctgcctgtctcacatcagaatgcactgtgagcaatattagctgttataaattgggatgatgcctgtagtgagttgaatgttggatggatatatctcagccaagatatatccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgtaatcccggcactttgggaggccgaggtgggtggatcacctgaggtcaagagattgagaccatcctggccaacatggtgaaactctgtctctactaaaaatacaaaaattagctgggtgtggtggcgcacgcctgtagtcccagctacttgggaggctgaggcgggaaaattgcttgaaccggggaggtggaggttgcagtaagccaagattgtgccactgcactccagcctgggtgacagagtgagactccatctcaaaaaaaaaaaaaaaaaaaatagaagcaaaaccttgaggaatgtgggaagcttctctctgcattaaatgggcagatctaaaggtaagcattctggtcccaaaggcatccttagtagcctgcaaagcaatgtctgcctaaaaggctcatgggtataggaaacaaggacaattcccagcaacaatggaggctgagagtgactgaaaatataatgacagaatcccaaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatggccacactgatctgggttaaacaagatgacctgggctacggctgaagccattaactagcaatgctcatgcaacagggaccaccctaaaatgggtagagttcagctggaaacctggtaatatttggaaactttaacgaaccactcccaatcttcaacacaaatgggccaagcataaataaaagcatgagggctgagaaaggcatacttagtaaaagtgacttaactgacttgttcactgcaaccatttcatgtctcagacatgcgccttttcccatgcccatgcagcatgtattaaagattggccatttatggactgtgaggagatatcaataggttataatgggaagaaagtttacaaatgacattcttgacaaattgtcaagaaaaggaaaagcactaacaaaacattcaatcaacttgacagtttttaacaaacagaacaaacatggattccacttttccaacttcattttgtgttgaacagaaaagtaaatcgtaattaacaactgtttacagggatttaatcccagtggcagattaagcaccctagtctctttctcctcattccccaatttttttaacttggcagaaaaaaatactcatgaaaagaataatccgcaatcgcataggaaaacaagaaaagatgccattgagagtctgtggtggtaaagaagtcttggaagatagagaacagataggagagaaatctactatccacaatatgcacaggggaaggagatagtgcaaagatcagtgcaaagtcagagaaaggcagagtaaacatatactaagaagaggaaggggtcttggaggctccttttagaacaattcattatacagcagcgctcagaacaggaagtctagagcttcctcattcttcatctgtcatgagtcccaaagatgaaagggaggcacagagaggtttagtaactcacccaaggtattcagtggcaaagcagagcttgtctgactctaaagccctgtttctttctatgcaagatactacatctcatatatgactgttcagatttttattatgtaaagagattttgcaaacgaataagcaaaagacaaacatccaactagaaaataaaaaagcaaaatacatgaacagagagtgataaaagaataagccaaatgtgcaatgaataatacgataagcatgttaactagctagtagaaagcataaagaaggccaggcatggtggctcatgcctgtaatcccagcactttgggaggttgaggtgggcggatcagctgaggtcaggagttcgagaccagcctggccaacatggtgaaaccctgtctctactaaaaatacaaaaattagctgggcgtggtggtgcacatctgtagtcccagttactcaggaggctgaggcaggagaatcgcttgaacctgggaggtggaggttgcagtgatctgagatggtgccattgcactccagcctgggtgacagagcgagactccgtctcagaaaacaacaacaacaaacaaccaaaaaaagtgtaaatgaagacaatttgataacatatttgtctatcaaattggccaagatagaaaataatagtaataatctcagacactgtgagtgggaaggtcaacaggtccaaatgttctgaaggctgatttagtaatcagtgtcaaatgtcctaaaacatgtgctcctttgaatttccacttctaataatttatttcaaggaaataatcatgtatttagagaaaatatataaaaagttcatgatacactagagacgaaattaaatgtactctcatttttttcttttccaccagcttcccaagtacctctagtcatttacacaatggataacagatgagccgcctattgcgggcactgaaggatcagagcttaggtgagggtagagggcaaatctcggctccattcacaataacaggctggactctggcgaaaaaaagaggtgtcagtgttccctccatgtgcccccttttaacagtctcctaataagtaccacatgtctgagctctgagagagcctcagagtttaaatagttgaactccaccctgcagctgctgccgcgaagttaactctaagagctgcagtcaccaagagcgaagaataaagcagcaaagacagaaactcacctggactttgagtttgtcgttcctgcccctttccaggggctgggacagggatcactcctcaagattgggagagttacagggagatgctagcaggcaaaacaggaagtctgtgctttgacaaacgcagtaaggggccgggcttccgagaaaagaaaagtgaaagttttcggagtttgccaagccggaagctgaaggcaggtcggtgcctgcagcctctctccacctcctcatgggcactt

SEQ ID NO: 2033 - DNA, 51182 bp, Homo sapiens; identical to SEQ ID NO: 2032

SEQ ID NO: 2034 - DNA, 49256 bp, Homo sapiens
tgagctttttcatttaatttttattttagagtcatttgcttccccatcccaaattaactatgcaaattaattgttttgaagatgccatgcccaaatgtggaggtgactcagagcttggaaactcagaagctctaaggtgagcctccagacagggaaagtctgcaacatggtgactgagagggtagtagaaattcacttgctatttaactctctcttgagatttattcttggaggacagagcaaaagtccactctgaaagacagaaggagtcaatgaatgaggttattctggaggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagaggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcattccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacacgggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgacttaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggtgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggagtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccaggaacccggtgggggatgcttggggctctctaacggcagctggcttgtttgaaaggtgagctgcagcagcggtgagtttaggtccccattaggaagcatgagcaaacaatgaggagcctgctgtgaaaagcaagcaattagagaacagagagctcagggaaaggaaaagcaaggtggagaaaactaagaagaaaagcctaatcgagatgaggaatagcggcatggtaaaaaacgaattcataatccagaagaccaactccaggaattcctacagaacatgaggaaggagcacaaggtggaaattatgcatggaaagaccacaggcctggggagtgatttgggagctctatgatgtatacatgaggggtctggggaggggatgattgggggtggagatggggcggtgggaggaaaagtgatagtcaaggaaacagtaagagcagcagatgcactgtgtcatctatccgcataacaatgtgtaagaaagagaaggcaatgactgtcctcattttatagatgagggacttggggtcagatgtggagagagaattgccggtggtcaccatattacatgaggtggagctggcactggaatttacacatgccagacccagtatctagcgctctttccacatcatcagaaatgccacgagactgcacatcatacaagcaacaacagcacagatactctgcatttaatgagaagttacagacagtgcagaagggagaagaaactgatgctgagggacaactgtcaacgtttgccggggctcctgcctccaccagtgtttgagagtaggtgctttctaggttcatttacatttttagtgtaaaggaaaaagggcttgaaattggaacacataggttgattttagctcattcaagtcttttgccctttaattgaatctgtaaaatgggctgataacactcacttattatggtaattaaatggcaaaatgtagatcaaagtgctttgccaactgtgaagtaatgtacacatttatatggttatcaggaccactgcatgaagttgtatgggttgtgccctgagcaaggactccacctttaaggggtgctctaattcatattagaaacagaatcagtttacctgcttagtacaacaatcttccagcagaaggcagaaaagggtttggtttcaagaattggctctgacagatgaggtagtgaattgaggaaggggcacctttttctaactcacacacatgcatcagataggcccagatactggtattcatacttgaagaagtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaagcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagcactattcacaatagcaaagacatgggctcaacctaaatatccatgaattatagactggataaagaatatgtggtacatatacaccacggaatactatgcagccataaaaaggaacaaggtcatgtcctttgcaggggcatgattacagctggaagccattatcctcagcaaactaatgcaggaacggaaaactaaacaccacatgggttctcacttataagtgggagttaaacaatgagaacacatggacacagggaggagaacagcacacattggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacgaggtgggagcattcggtatctggtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggtttacaagctccttattcttgtagacctgccaagcagcatgcttgtagatggcaccagtctggggaccccaccttgggtagcacctattatactttgataatgaataaaaagggccagtgtggctggcgcctaaaaaaggaagagagggtgacaagaaatgatgctgaagaagcaaggtataaaagcagaagaaaaataaatgcaagaagaggagtgggagggagaggacagagatgcaaagagggccgagggtgcagagaggctgaagcaagcccagggtcccaaccaacacaggaaaaggaacgagaacactgtcaggctgtgcttgaataagggtttcctttaattcctagaatggaagacatagaagttcattttagaatttgacttaaaggtttagtgatcatccttaatcatttttgggtctttgtatagctctgtgttaaagaatccttccaagtatggaaatggccaccatgcacaagggggtgggttaggctggcagcactcctgatgcacccaattcagctggtacccatgacggtggagaacaactttggaggagaagggagagagaagaaggagagggcgggtggagcttccagcagaggccagggctctggggagcccagtggggaggcgctgtggcttgcttgcttacctcttcggtgaatatttttctgaaatctcctttttgagcttgaacagatatctttctcctttttcttttctaaacacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatgtatttcaagccctccagtggatgcctgaaaccatgggtagtgcccacccctgcagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatcacataggaagggctttttaaggaggaagtaatgggcataaagcagtggttaacactgggtgattttgctctcaggggatatctggcaatgtttggaaatctatttgtttgtcaggacggggaagcagctgctactggcatctaatgggtagaggccagagatgtcgctaaacatcccatgacacacacgacagcctccgaagcaaagaattattcagtccaaaatgtcaataatgccaagattgagaaactctggcataaaccatactgctaaaggtaaactgatttgtctatctaactaagcaaatggctccacaaccaaaagcttcttaagttcaaagacagaaaccaaatcagaaaaactaataattataacaaagggttaatttccctaacggatttaacaaaaaaaaatggccagtcttatagaaaaatgggcaaattcaaacagatgaccctcaaaagaaaaaattccaatgtcaaatttatttaaaaaacaggtaaattggtaacgataggctaggtaatgctgtggtaattcacgatcctcccaaatctcagtggtttattacaggtgtcagcaaactatggtctaagggccaaattggcctactgcctgtttatgtaaataaagttttattggaatacagccacgcccatttgtttacgtatttgcctctggctgctgtcacgctacaaaggcagagtcgagtagttgcatcttctggtcctttttggaaaaaatttgccaagctctggtttacaatggcaaaggtttacttctctctcatgctgtttgttcatcataaattagatgaggctcagccctacatcactgacactcatggcttctgcagacagagcagcctctgtctagaacatccctggtcttgggcagagagaaagaagacaaaggggctcttaaagccttggcctgaaagtggctctctaacttgggtccacatttctttcgctaagttatcacatgggcattcctgagtccacaggcagggctgtagacttctgaggaggtggggcactggaacactggagaaccgtaatacaagctaccacagcatgtttgatcacctgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcaatctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttctctttttcaagtcctcattttgtttagtaattacaggtgtatcaattagaatgcaagctccactagtgtagggatttgtgtctgtcttgctcactgctgagttcccaggacctaggacagatacctggcccacaccttacactccactgctgaatgaatgtttaataggcactaaagttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatgttaacatctatttttttttgacttcttaataatggccattcttgcaggagtaaggtggtatctcattgtggttttaatcttcatttccctgatgattagtgatgttgagcattttttcagatgtttcttggccatttgaatatcttcttttgaaatatgtctattaatgtcatttgcccactttttgtgggatttttttctataatgtttgagtttcttgtagacgctggatattaattcttcattggatgcataatttgcaaatattttctcccattctgtgggttgtctgtttactctgatgtttatttcctttgctacgaagaagcgtttcagtttaattaagtcccatttatttatttttgtttttgttgcatttgcttttggggtctcagtcatgaattctttgcctaggccaatgtccagaagagtttttcctaggttttcttatagaatttttctggtttcaggtcttaggtttaaatttttgatccatcttgagttaatttttgtataaggtgggaaatagggatccagttttattcttttacatgtggctaaccagttttcccagcaccatttattaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgatatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttagtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcatggtttctatttattcccaatttaatctaggaggggtgtatgtctccaggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctagttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagttttgatttgcaattctctgatgatcagtgatgttgagcgtttttccatatgtttgttggctacgtaaatttttttttttttgagaagtgtctgttcatatcctttgcccattttttgatggagttgtttgtttttttcttgtaaatatgtttaagttccttgtaaattctggatattaaacctttgtcagatgggtggattgcaaaatttttctcccattctgtaggttgcctgttcactctatttctagtttcttttgctgtgctgtagctgtttagtttaattaattcccatttgtcaatcttggcttttgttgtaatagcttttggcttttttatcatgaagactttgcccatgcctatgtcttgaatgatattgcttcagttttcttctagggtttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccaggaagaagttgaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagagacacaacaaaaaaaaagaaaatttcaggccaatatccctgatgaacatcaatacgaaaatcctcaataaaataatggcaagccaaatccagcagcacatcaaaaaacttattcaccatgatcaagtcggtttcatctctgagatgcaaggttggttcaacatacacaaatcaataagcataatccatcacataaacagaaccaagacaaaaaccacatgattatcttgatagatgcagaaaaggcctttgataaaattctacatcccttcatgttaaaaactctcaataaactaggtattgatggaacatatctcaaaataataagagctatttatgacaaacccacagccaatatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagtatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgttttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttatagaccttgtgagttttatgctttcaagagtttgtattctggtgcatatcaatctttcgtttcaagagttagaactccttttggcatttcttataaagctggtctggtagtgacaaattccctcagcatttgtttgtctaaaaatgactttatttctccttcattcataaaacttagctttgccagatacaaaattcttggctgagagttattctgtttaaggagactaaagataagactccaatcccttccagcttgtaaggtttctgctgaggaatcatgtatttttcatccttgcaaatagtaaagatttccctgactattacatcaataggtttcagggggagggcagatgcttgctagaattgagaagccactgctcagttggggccattttggcaagcttagacaaaatcttgaagcacagtatttgttgggagcaaagaggaatttataaattccaaaaattacctgtacctatcaaaagaaaactttggaggtctgaatgtcaagttttcctataagtcattggtagtgaacactcagcaaatgacagagagtatgtttcctccagcctagggaggcagtggggtggggaactaggaagaagaggccagggaggggaagtgcaagcaggcagatatgactttccttctaggccaaaccccaagattgaggcatgctgggaacaagcagaaaaattagagggctttccaaagcagtgagcctcatgtcctaattcatgtttgggagctgggacaagatctcttcccaggctggctcccataaaggtacagaatccaagagaatccccactgaccggcatatcttaggccctttgtgaataattttgagtaaaagaataaagaaaaaggggccaggtgcaggggctcacacctgtatccgagaactttgggaggctagggcaagaggatcacttgaggccaggatttcaagaccagcctggacaacatagcaagacctggtctatacaaaaaatttacaaaataaattaaaaaaagaaaaagggaaaaagaaaggaacagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcttggggatttaggtttcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctgtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattaggggattgaataaagatggatcaggaatatactagaggactaacatttaatatatgtcatttaaaaagttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgcatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatccatgtccctacaaaggacatgaactcatcattttttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttgggtatatacccggtaatgggatggctgggtcaaatggtatttctagtcccagatccctgaggaatcaccacaccgatttccacaatggttgaactagtgtacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccatgttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctccctcttccacacacttccacaggcgggaaaagaatgtggagagctgcaatgggctcttacatgctgtgacccagaagtgacacccatctctctggcttatttgccagagctagtatagcagagctgcctcctgcaagggggatgataatggagctttccaagtgtctgggaaggggagaagaattggaactagaggagggcagtcataatgcccaccataaacatgggcagggtgagcactgctagttgttcctctttctctggtctccctttttctttagtaataaagcccctgattctgagccccttattcttatagattaaagattacatttcccagcctcctttgaagtcaggtgtggccgtgcaaccagtcctggcaataaaatgatagaatttttttttcttttttgagatggagtcttgctctgttgcccaggctggagtgcagtggcatgatcttggctcactgcaacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatggtgacagcacactgcttttagaaaagtccaggaacttttctatgttgaaaaaaagtgaaatcatgattttaaaaagcataacgctttttctggcttggatgtcttttatggcctagaatggcataataacagtaaggtaacatcaatccacaccacagagaccaaatagtttcttcttcacacttatgctctgccctgggagattttcccagagagagtttatttccattatccataggatcttggaagtaatgagaaagtaatttttgaataagcagttttctattttgggcaatagtgaattgacaaaggtttgacagtattctttctgccccttcctttctatggagaacgatggctcctgaaaagagttcctggggaccaggttgttaacccggtggcagccagcccttacccaggggatcctgaaaaaaatccattaatcctttccatatcttaatttcctcatctgctaaattggaataggtcattcaatcttctccaagggtggttgtgaaaataaaataaaattatccatgagaaaagttgaaatactactagataagccagtgcaatataggagaaactgttaaaatgataatttagattttaaggtggtaaaatttaatccatttttcctgacaataattagatatttgttgtttgaaaatcacatttgtcatgtgagagttctgtgatttttgtgacaatgaccatatcaccagcaaacagacgaatatctagctgttttttcccctctaaggatagtgttatcaacttactccagaaatgtgaataatggtagcgatagtgaggggtgaattaacatgcacaattttaccagcacatgcccacaactccaccagttgtacatgctcagtcatagtgtcacatgtgtgttttaatgagtttttcgcttctcaattttctcagaaaggccacatgagaaatatggagattggaattctaggaaaaagcttgatccatgggttggatcaagctgcactttcgacaagctgtactttcagtatagtaccatgaatatacttaggacactcattctcagtaatggtgatattgctgccagtagtggaaaaactcattcttgagtgctgagaaaaatcttatatagtgcagatatacatacatacatatggacacattacataaaatggacatatatttgtagtagtaaatatcatgggaagggtcttgattaagaaaaaaaaatccagaagggctctctagcacagtaataatgaaaaaaaaaagttaagaaatattgcctcagtgtaagacagctctgaatttagattcctggtgactgtactctgagaccagcaatctccaagttttaccttgtgtgacccttcgtggtgtactaggcgtcttctgggacctctttccttcattcatttctgaagtgccatcaatgatctctggaaaatgaaagatcttagtaaatgccccttgggaaacaccatggagaatctcccagagacccaggaaggcccttgcacactctgaagttgagtcttggaggctccaggtcttaccctcctaacaatgcatctaccaagagatttggtgctgctcatgacactgtgcctgtctgccactcaggggaggagcagaccgcagttggttagcagtggttactctaccaatggagacatccacagtggggtgcagccatctgaaccccttggccagagtctctcaaagtaaggtctgtgagcccctagggggtctgtcaaaccgtttcagaaaatttgcaaggtcaaattgttttcataatatgatgttatttgcctttttcactatttcaacctttgtacagattgagcaagagcaatggcagataaaactgctggtgccttaagacacatcaaagcagtgtccccaaatctcagcaggaatcactgcatcctttattgccacctactcactgtaccaaaaaaaataaaaataaaagcaagattcacttgagaatgtttttggtgagccagtaaaaattattaattttattaaatttctacccttgagtacatatctgacatcttaatattctatgtgaaaaactgaagagcacatataaagcacttctattgcatcctgaagtaccacagtggcctcaagaaaacacttgtgtgattgagatacaagctcactgtataattccaaatgtatattttccaaacagctgtactattataaaatcttgcattagtagaaggtccattcaaaatgcaaggtggattaatgtattttattgtaacagagtatgaagttaattgatatggtttcaaattttacattacaactaatatttaagaaactatcacttgttgagtgttggtgtagtattaaaggtgaatatccacagatatctcaaaagactgttaaattacctcacccttttaaactagatatctgtgtaaggccagattttctttctatccttcaatcaaagcaacatatcacaactgaatgcagaaacagttgtaggaatccagctgtctttttataaagctcactcacaatcaaagagatttgcacaaacataaaatgatgtcactcttttcactaattttttttgttttagaaaatatatttacttttcataaaataatgctatttatgttaacaggcaattggtttattattgttacttttacatgaattaatattttaaaattattagttttaatttctaatcaggtacatgtagatagacataaacaacataaacagaagctccttagggtcctcaataatttttgagagcataaaggagtcctgagaccaaaaaatttgagagctgctgccccaggccacagctgtccctgtgaacacgtctgtttcttccacaaaacttttcagatgcaacagatgcttgctctctttgttcctcttgttataccccatcctcattctctgtactttttccttttactattgactttacatatctacttaactctgtacctgcttcaggagagaccctcccacactgagccattcaaatggcagattccatcatcagccttaccctctgatctcgactttcgggcacattcagttctcgccttttgggcccttgtctctaccgtggagttacaagttgagtcatctttcttttgaggaacctgatccacccttttgagcttcttttggattccgtgtctagatgaggctgtccctggaccaaataatgacttgttaatagtttaaattggggtcttcagtgagcctcctacagtcccaatcagtgacttcccttctcatgcccctaactcccactctttcagatctctgtacccctgtacctcacttttctcctcctacttctctataattatatccttcttcttatgtgtacctttctttgcctccccaaattaccatctgctttcactcctggtatgacctgttgcaatcaactagataaagctggggaaatcctagagcttatttcctgattttcgtttgtgtcggcctgcaccacgaggtggccacacagtctcgtctaggtggagaggaggtgtcttataaagcacctctccaggttcccccacggcctgtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagaggtgagtttgcttcattgtggaaaaagaacacaattttcaccggctgttgactttagaagctgatcccacaggatgaccgctgtcctgttgaacaagaacgtttctctgcaggttagaaaggacacagagtgtgcagccatgcttcccgcacgcaagtgcggtgatatccgcaggccacttccggaggaaaaggcatgggtgaacccttaagagggggcggaagcgaaagcccggtgggacccagggctggcgggaagttcaaacacggaagttactgaatatttatccagaagaggtggggcagcctgatagagcctaaaacttgcctttcattgccaagtttagggttttttttctgcataactaaaggagggtttcggagatgagaacacttacagaaaatatgagagtgtggtatgtatattttcagcactactatatatatttttctcttacaattttgaaacatctttttatgtgttttgttttgtaaaaaataaagctgattaattaaatgtaaaataatatgactcttaaaaatatctctgttgggctgcgggcagggaggaatggggagttgtttaatgggtacagggttttagttttacaagataaaagagtcctggagatggatggtggtgatggttgcacaacattgtgaatgtattttaataccattgagctatgcacctaaaaatggttgagatgataaattttatgtcatgtgtattttacccaggtaaaaaattggaaaattggaaaaaagaaaattaaaagcacatcatctgtcacatttaaaataaaacgattcttttaaaaaacctgaaaaatttcatttaaatacaatatgaagaaaggcaaatctggaagggactggagtctactcctttcggtagcttggcagagagatgtcaaaaggtcagagttacctcaacagaactgaccatctgacactgactccagaggtttcccctctctaacaaagtcacttctctgaccagggagtgttcataattgtatagttgcatagacattccctgtctccctaatcctataacgtgtagagcattgtgagagtgggcatctcactactgggctgctggccacggggtgtgcagagtacgtatgtctgccctaaatatgggataataagaatttggagaattgtattggaaatttccctccaataacctttagtttgtatctacaccacgtggtgcccataatgtctatgaccccttttcataacacaataatgaattcataaactatcctttgtcagatcattattcaaattttgggttacagaaagtatggtttctttcatttttttttcattaaaaaaaaattaatagctaatttgtgccaggacattaccatctagcctagaagagacacattatgtaagtaattacaatagagtatttggaaccttccaaaagagccagtgctgggtgctgtagaaattatgggaccagcttggctaatttaggggtcagagtatgtattcctgagatagacataagtcaacacgactgatgaaaaggagataactaaacatttatggggagtagtgtaggttcagaatatagcatccaaagagaatagcacatgccaaggatcaaaggggagagaaatgaaatgggaagaaatgaaagttcagagtggttgactggagttttgagtggaaagagatatattaatagttggagggtaaggcatgagttagactggatagaacttaacaatcacattaaggacagtgaacattaccctaagggcaataggaggccatggacaagatttaagcatggaaataaactaattagattttaatgtagaaaagaagagggtgaaccaatagaccttgtcaatatgctaatagagttcagttagtcacggatgactaaggtttttgcttggcacctgggtagattaagttcctcatttcaagttaaactacaacaggctcccaagggcctgtgaaaccctacataatctgattcttgtttactttttcacttcctaccaccttctttcttcatcatcaccaacaacactggtctttcctctctgcctcaggttctttgcacttttgagtccctctgcctggaccatccaatccaaagtgactcccaccccaacctgcaagtcactattgtaatcctatccattattttctttcatcctgtcatcagtacttgaaattatcttgtttatgtgctttctagtttatattctttccttcccccagccaggatgtaacctccatgagctttcccctttgttttttgcttactttcttactttctctctttaaaaaaaaaatctgtcttcagctttcagaatgggtatatacagttagtgctcactgcatatttgttggaataaatgtctgaatggtacttagaagactaggtttttggtaaagaaggtgaagttaatttcaggcatattgagactgtagtgtcaatgggagacttgcaaacaaagacgcccagtgtgcagctggctatgtgtttcttgaagacaaacctgagttgaagacgtagagttgggagccatcagtataaaggtggtaattgaagttgtgagagtgattgacaaagctcagaagtgtgagttgaataatctgactagtttacaatgaaccaaggaggcccatagagaatacacataacatggtgagagggcattgactaataagtagaatgggggagaaagcagcttgtctctccttcctgcccaggaaggtcacttacttttcttagaatggaatcatttctgttaagtgtcttaaaaggacaccagccctgtgattttggacactgggatcatactaatgataaactaagtcagggaagaggagctttaagccactggcttaggctgccatctattgctctgtttccttttacagctagagttgtctacatatgttatcacctcccattcattatccttcccacacaactggctcctgcctccatcaccaaaatttttcttaaattttccagtgattctttgtgaccaaactcaaggccctcttctctgaatttatcttagtctctcagtatagtcaaccattccctcttggcttgctaacatgttctttcttggtgctcctctgtcttcactggtctcgttccctcagtctgtcttgctagattcctcttccactgggattacttagagcagggctaggtctgtggttctcttttcttctcccatagatcagaatacctttattttattgataactcatatatatacatatatctggtccagatattatatattatctggtccagattttatatatatatatatatatatatatatatatatatatatatatggaccacactttttcagtgagtgccaaattgccatattgtggggaatataacttcctgatttctcagtgttcctgtaaaaagccctagtcccggagacacagaaatgtatgcaatataaatataggaaatacttgctttcacttccccagaaacattttcctcttcccacaccatgagaattagagctatagctatttttctagttaattactctgatctagagggagaatagaacctctcttatctcctgagatggccaaatgggttcacccaggactagcttcctaggttaaatcctaaagtaccaggaaaactggagtggtctttccctaggtatttatatatcacaaggggtaaagcccagaacttggagacatctttaggttgtaaaagccagcaacacctagagtttctctggcctttggaaagatgcatttaaattccaaaggttaggatggagagctttggaacgaggatcttttccattttatctcaaagcagcaaagttttttcttttcctttcaggaggaaaggatgatggctatccctctcatgtatctaaacagaaaaatccatcattctacatcccttatacatgagttgtagtctattttgaatagaaagattccattagctctcttagcattgcctttgggtttgtgtatgggagacagacgctgcaatattgctctggctgataagctggttgtgaatatcagtaaagaattattttccctgaccagataccttgtgttcctgcagcactcatatatataaggagataccaatgcaagtggagtaacatcttagaccctttacagttcttgacaaaacacacatctatacacagctgcatagatggctagcagaaacctctaaaggaacaggtcaataattgaactctaagagttatcccccaatatatttgcatcttccctcagcaatgggcattaccacttacttgttcaagccagaaattgaagagtgggccttgatttttctctttctcatctgtagctaataatatgtcaaatcctgtcaacaatacctgcaaaactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcctgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagtttggttgtgaaatgaaggagagagatatggaagtagttgaagtgagatgagaatcaagaaaaagcattttttaatgagctgtgatacatgtaatgcagattcttgtgtgagacatactgctttaatgaatacttgagagagaagggatcatggatactataagatgaggcagaaggattgtcttagaagagaaggagggaactcggagaggagggagacagatgtagttagggtttgtaggactagcagcacaaataaggggattctcatctgatatctccttatggtgcaggagggaaagtcactgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttctaggaaaaggcagagaggaaaggcaggtttaagataatggcaatagattactgaaatgatgaatcttggactgtgagttagtgtcaatgttaaaaagctgggaagcaaagaaaagcagatgatggcttggaaggaggaaaggccagtggactggtgatccaaatgaggttgaaggacaacttcagaggaaacaacaaataaataagcacagaaaaatatatttttgattctttttcttttgttaggattgggctgggaaagagtgatcagaggttgaatgatagctataaaaggagaaaagctcaaggacaggtatcaaaaaaggaattctgaaattaactgttgggaaatcgagccaggtttgaatgacgatagggtctatagcttgcctttgggtatgggaggccaagaattggtggaggaaaaagtcatggaaaatgagaagatgaaggatttgaggggccagagtattggataacagagttgtctgttatccgtgtgtaccctgaaggcatctaggatgatgctgggacttgaaatgacagaaaagcagcttttgaaaggattattggggaaattattggatgatattgatgatgagtgagtgaacattttaattgaatggttaagactcaaaggagaggatcagggaggaaggggctggatggggccagtaggcagcaaaggacagacatctaacctgtctctcaccatgaggtgtgagtgatggatggcagagaatgcctagccatgtcttaagaggaagtgggttcctctctggggaaccaactttcagttaaagagggaagtgcaattaacactctaagaagttgtgaatataggagattgattttttcagaacaggcaattccaatggcatatttcaatacccccaaatgccttctggtttcctgataattttcataaaggcctttttggaagatgcagcaaatggaaactgcagaaacgaactgtgtgtggcatcaggactgtggtcacatagtggtgctcttgacaagatacagtcagaaaaacagaaagcaactctgaattcacccttctgacctctacagaagaaaggcttttcttacctttcttgtctgaaggtgtgctggacacctcctggggctcttctgggtcatttggttctggagaattatctcttatctctgacaaaagaaatataagtcatttcagagctcagatccagtgaagagaaagtgctgagggaagtcaatgcaagaactagaaaagtagaaagtacatgcagcccagggccgggaatctgcttgccctaagaattccctggctctgtcttgatttttgccaacttgtggttattgttacctgtgcgaccatcacagggaactagggcacaactgccccacagcagaggctcagtctgatccttttagagagattatcttatggatggaagagaagtgagtgaagaaggtgcaatgaatggaaattgcaggaataaactgtgctgggtatcatgactatagtcacatggtttctgctcccagcagcccctgctcaaggaatgaagctgagagcggaaagtggtgatattgaaatctgatgtccatgatgaaggggaatgtctttgctgtatgaaaaatacatcttattgctttgacgtctatgtgtggatattctttaactgctctatctgtggttattttacttggagaaatagtggagaaggctaaatgccttatatatttctgtatataaggattgtttgaagaaagcaggagctagcctgtgcttgctagcacctgttaacagcaaagacatataaagctctgctagtttttgctgcacaaagaaagacagagaacttgaagccataacaaataaaggctcatctcacatgaagctgtcacctttttctttacacactgcattgagattggtctcaaatgctggcctgcttaggaataggtgactgaggcaggtggcaagcagtcattagatctttggaataatttattacctttcaagttatattcataatatcaactcttaaactccaagtgatatagaaatgaccagggttgaaagtgaaaattccccacagtcaggtgggggcttggaaggaggaccatccatgtctgctgcagcaattcactattagggccacacagtgtttttgttcatttgctttgcattttgacagagccgttttgagcactactttattgaagtggcctcagaagagtggctctgtcaaacagtccagcctgactcagttcccttgctttcccctggggttcctgccacaaccctttgtggcaggtgaatgtttccctttcaggcgctttgtggcatttggagtccaaacctacaggcactggtggggctctgtccatcatcatccgtggccctatccaagtctaccttttccagacttgcctcctttgccctcccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagttttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattggccccttctgtttcttttcctttgtattgctcagttctttttcccagggttcccaccatagcctcttggttggcagacgcatgttctcccttcacagtcaccttgagctaagcggtatcagccccagtcagtgttaccttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagatgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccattcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccaggggtttaacttttctttaatcttggtgtcatataatttagtcaataatgaacatgctatagttttaaaagaggtctctgttttaataaataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttcatgatccattctttctcagaccctctctttctgtggctatgtttgcgattcactccctttctctgtagctaccttttttcccttctctggctttacaatctgccttccagctgtccttgtccggactagtggttaaaatcttgggccctggtattgggagacccaagtaggactcttgctctgcttcttaaccaacaagtaattttgggaagattacctctgggctttaatttctctgtcagtcaaatggggttaaaaatgacttcaaagggttgttttaaagatgatgtgagataatcaaataaagtgtttgcgataaggcaccaaaaaaagatacttattattatccgtccacattcattttttcttcctccctggctctccttgtccttccaccagacctgatctttgtaactttgcatttctgtcaccttatgcattccctatagattttccagtatgccaaattgtatgatttttttccaaattcatagaacacataagaaatgtttatgtcctctagaagttcatcttagagagttgggatcagctttagcaaggggctgctcctgcagctgtaccaatgagagaatatggtccattccaccccagagagaaggcgggggattaacgtgcatattccacagggctagaagtaaacccagacttttaccatagcaactttttaaatgcaaaaagcacttgagaaatctcattaccacgtttgaagcttctgtaaatcgtcaccagattgggatattcacgcaggttaatttgactgaacaatgtcaccagaagagacaggttaaaagtcctctccagttgggtgagaatgttgtgcaccactctggatacagggatcaaatttctacaggcttccagagattcctataaaaatggagtgaaggtttttataaatgactataaaattgaatgggaagttatacatttatggttttctaagttttaagaaagctaccttactcttttaagaagaaattcaacataaaatatatagtcacattctctaaggtagagcggtcacagttttacatgcttatttttgaaactttacacatatttggatgactagcaacaaaaataaataatttagctttcttaaagtaagtctatattctgaatccaactttcaggcacatttgagacgagagaaatttgaaggaaggaaagtggggttaaaggatgctactatgtaattgattctttaaagctgtgggcaggatacttcagcaatggttctagtgatggtcacagaggcaattctgctggttgcttgtgagcctctgctcagtctctctctgtgtctctcaaacttgagataagcctgaatggattccagccacagagaagtcaccctgagaattttccttgcctagaggatggacaaaaggagaaatacggcaagagagaactgattgcaaataattattgaacatctactaggctcggtcagcgagtctttgggtacacagcactgaataagaccaacatggagttgcctatatttgggggtcagggtaggcactgtcaagtggagaagatgagcattaataaacacaaataaatacccatttacaattgagagtagtgttacggagggaaagcatagattgctatggaactgaataactaaggggtcttcatgagatgagttggccaaggagatgtctctgaggagtgctctctgggctgtgatctgaagagggagttggggccaaccagactaagactaagggaagattattggcacttccttgagtctagggctcaattaatgcttttaaaaaccaaaattatataaaaataggtccacttttgtccacatagcatatctcccagtgcctgcctgtctcacatcagaatgcactgtgagcaatattagctgttataaattgggatgatgcctgtagtgagttgaatgttggatggatatatctcagccaagatatatccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgtaatcccggcactttgggaggccgaggtgggtggatcacctgaggtcaagagattgagaccatcctggccaacatggtgaaactctgtctctactaaaaatacaaaaattagctgggtgtggtggcgcacgcctgtagtcccagctacttgggaggctgaggcgggaaaattgcttgaaccggggaggtggaggttgcagtaagccaagattgtgccactgcactccagcctgggtgacagagtgagactccatctcaaaaaaaaaaaaaaaaaaaatagaagcaaaaccttgaggaatgtgggaagcttctctctgcattaaatgggcagatctaaaggtaagcattctggtcccaaaggcatccttagtagcctgcaaagcaatgtctgcctaaaaggctcatgggtataggaaacaaggacaattcccagcaacaatggaggctgagagtgactgaaaatataatgacagaatcccaaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatggccacactgatctgggttaaacaagatgacctgggctacggctgaagccattaactagcaatgctcatgcaacagggaccaccctaaaatgggtagagttcagctggaaacctggtaatatttggaaactttaacgaaccactcccaatcttcaacacaaatgggccaagcataaataaaagcatgagggctgagaaaggcatacttagtaaaagtgacttaactgacttgttcactgcaaccatttcatgtctcagacatgcgccttttcccatgcccatgcagcatgtattaaagattggccatttatggactgtgaggagatatcaataggttataatgggaagaaagtttacaaatgacattcttgacaaattgtcaagaaaaggaaaagcactaacaaaacattcaatcaacttgacagtttttaacaaacagaacaaacatggattccacttttccaacttcattttgtgttgaacagaaaagtaaatcgtaattaacaactgtttacagggatttaatcccagtggcagattaagcaccctagtctctttctcctcattccccaatttttttaacttggcagaaaaaaatactcatgaaaagaataatccgcaatcgcataggaaaacaagaaaagatgccattgagagtctgtggtggtaaagaagtcttggaagatagagaacagataggagagaaatctactatccacaatatgcacaggggaaggagatagtgcaaagatcagtgcaaagtcagagaaaggcagagtaaacatatactaagaagaggaaggggtcttggaggctccttttagaacaattcattatacagcagcgctcagaacaggaagtctagagcttcctcattcttcatctgtcatgagtcccaaagatgaaagggaggcacagagaggtttagtaactcacccaaggtattcagtggcaaagcagagcttgtctgactctaaagccctgtttctttctatgcaagatactacatctcatatatgactgttcagatttttattatgtaaagagattttgcaaacgaataagcaaaagacaaacatccaactagaaaataaaaaagcaaaatacatgaacagagagtgataaaagaataagccaaatgtgcaatgaataatacgataagcatgttaactagctagtagaaagcataaagaaggccaggcatggtggctcatgcctgtaatcccagcactttgggaggttgaggtgggcggatcagctgaggtcaggagttcgagaccagcctggccaacatggtgaaaccctgtctctactaaaaatacaaaaattagctgggcgtggtggtgcacatctgtagtcccagttactcaggaggctgaggcaggagaatcgcttgaacctgggaggtggaggttgcagtgatctgagatggtgccattgcactccagcctgggtgacagagcgagactccgtctcagaaaacaacaacaacaaacaaccaaaaaaagtgtaaatgaagacaatttgataacatatttgtctatcaaattggccaagatagaaaataatagtaataatctcagacactgtgagtgggaaggtcaacaggtccaaatgttctgaaggctgatttagtaatcagtgtcaaatgtcctaaaacatgtgctcctttgaatttccacttctaataatttatttcaaggaaataatcatgtatttagagaaaatatataaaaagttcatgatacactagagacgaaattaaatgtactctcatttttttcttttccaccagcttcccaagtacctctagtcatttacacaatggataacagatgagccgcctattgcgggcactgaaggatcagagcttaggtgagggtagagggcaaatctcggctccattcacaataacaggctggactctggcgaaaaaaagaggtgtcagtgttccctccatgtgcccccttttaacagtctcctaataagtaccacatgtctgagctctgagagagcctcagagtttaaatagttgaactccaccctgcagctgctgccgcgaagttaactctaagagctgcagtcaccaagagcgaagaataaagcagcaaagacagaaactcacctggactttgagtttgtcgttcctgcccctttccaggggctgggacagggatcactcctcaagattgggagagttacagggagatgctagcaggcaaaacaggaagtctgtgctttgacaaacgcagtaaggggccgggcttccgagaaaagaaaagtgaaagttttcggagtttgccaagccggaagctgaaggcaggtcggtgcctgcagcctctctccacctcctcatgggcacttgtgaggctcccaggacgtcttggcagttggggtttgggggagggcgtgttgccagttgggatcagcccagagagggaggtatgggaggaggaggcataagggtacagccccagcggcaataggaactgggaactcagcgtccaaatgcttccctaaccacatctattttcccatgacttgtcctcattctgtacattttaggttgatgaaaatgttctcaaactggattgtggtgatgtttacataactgaatgaattcactggaatttatccagtgtgttatcaaactctaacaacacacaaaaaaacaaagagaatgtgccagaaatgcctagaacttgtcaggataagattattacaggaagaaattgaaatgaaagggaacctgcacatgaactggaattgtgcagaggcaggcagacctccaggcagaaaaatggctgagagctgggcaggtagttgggagccaggagtctgaggcagaactgggacctgctgattccagagagcagtaactcaagggctggcagggacaccccttctcatgccccttttaaagatccctaatgtacattgacatgtggggcctatgaaaaatcctaaactattggccaggcacagtggctcatgcctataatcccaggactttaggaggccaagatgggaggattgcttgagcctaggagtttgagaccagtctgggcaacatagtgagaccccatctctacaaaaaataaaaaaataaaaaattaactgagtgtggtggcatgcaccttgtagtcctagttagtgaggaggctgaggctggagacttgcttgagcccaggagttcaaggctgcggtgagctatgattgcaccactgcactatagaaatctgtgtaactttgggccaggctcggtggctcacgcctgtaatcccagcactttgggaggctgagatgggtggatcacaaggtcaggagtttgagaccatcctggccaacatggtgaaaccccatctctactaaaaatacaaaaattagccagatgtggtggcgggaacctgtaatcccagctacttgggaggctgaggcaggagaattgcttgaacccaggaggtggaggttgcagtgagccgagatcgcaccactgcactccagcctgggtgacagagcaagactccatctcgaaaaaaaaaaaaaaaaagaattctatgtaactttgattaaatcaataattctcaaatgtatttgacccacaagttcccctaccaggacatccacaaactcctcagataaaagatgggagacatggatctaaagtttaagaagctttgaaaccaaggctaactgcataagagcaagcccttctatgcaggcacaaacagcatatcccaccctagtatgtacagaatagcagacccggccttgcgggtaatggctgtgggtgaaacagaggcatggaagccacagccaggaaaaattcaatgctaacagctgaggagagggtgcattgatgcctcagcatgcagtaacatacagcgctgtgatgcaggggatggcggtggtaaaggaattaaggttattttatgcaaatgtcacatgtcacttacctgaagcccctccccatcacctggaaagccccttcatgggcatctgaggatcctggcagcaagaacttcttcctttagatctattcagagatacaccaggcaaatgcaaaacaaacaaacaaaagtaaagcaggagtgggaaaataaagtcaatgtcaaatcaggcaaaaattgttacatgaaaaaaagacagctgcgaatgaggatgaaagatgtttattctaagccatatatgcttggctgggcacagtggctcaggcctgtagcttagctagcactttgggaggctgaggcaggcagatcacttgaggccaggaattcaagaccagccttgccaacatggcaaaatcccgtctctactaaaaacacaaaaaaattagctgggcgtggtggcacatgcctgtaatccgagctactcgggaggctgaggcatgagaatcgcttgaactcaggagctggaggttgcagtgagctgagactgcgccacagcagttcagcctgagcaacagagtgagatcccgcctcaaaaaaaaaaaaaaaaaaatgcatgcttgagaacatggtaataatgggaaaacgtcacctgttaattcacatgctagtgattatgtactgagataaattatacataattctttttagctccattttattgaggtataaaatttattcattgtaatgtacattttaccaaatgtagttactacaccagtcaagatgtagaccatttctaggcctggagagtcgcttgtgcctataatcccagcattctgggaggtcaaagcaggaggatcgcttgagcccaggtgtttgagaccagcctggacaacagagcaagacctcgtctctacaaaaatacatttttttaaattaattgggcatgttggcatacacctgtggtccccgctatcagggagacagaagtgggagaattgcttgagcccaggaggtccagtctctggtgagcagtgacagagtgagaccctgtctcaaaaaaaaaaaaaaagatacagaccatttctgttaccctagaaagttccctgtgacctttgcaaacaatcccctccttaaggccagcaccaggcaaccactgatctgctttctatcaccacagattagtttcgtgtgtattaaagttttttttttttttttttttatcaatgaaggcacatggaatgcatttttggtgtatggctttcttttcctcatcatcatgcttttgagattcatctctgttgttgtgggtcagtaatttattcttctttagcaggtatgctagccaccaagatcctgctcatcctgtctgatcagcatgatgtcatcaatcagtctgacttttttttttttttttgagacagagtcacggtctgtctccaggctagagtgctgtggcgcaatcttggctcactgcaacctccgcctcccaggttcaagtgattctctttcctcagcctcctgagtagctgggactacaggcacgcatcaccatacctggctaatttttgtatttttagtagagatggggtttcaccatgttggccaggatggtcttgatctcctgacctcgtgatctgcctgcctcagcctcccgaagtgctggggttataggcatgagccaccatgcccagcccagtctgacattctatgggatgtccaggtgatccagatatctttcaactatattatgacaaagggcaagtgagtcaatataacctgcctggactgcctactttcttaacctagtcctctggctttcccatacattctgtgagctacccaatatagttctaagaaattgactttttgcctgagttagccagagtcagtttggattacttttactcccaaatcctgactgataaaaatgttgggcaccagaggttgaattataggcaagagatattcaaggaaatatgatcaatctgggattggttatctgacataattggacataaaaacagtgaacatccccattagcgttcagagtcaggaattttggagttgtgggcaaataggggtaagttggcaaattaaattacagcactggattgtgatcaagactctatacaattcatttccccaattccaggtgtcagattctagcatgcttagcaaaatgaagagaaatcttccaggtagaatgaaagcattgatttacctttggggattatgacctacttggcctaaatctggatgggggaacagagccaggaggcaggccggagccttctgactccactggtcacgtggcagtaaaggaagacattgggaaccagagatggtctgatggtcctacatatgcctggcccaggaatcccttacccaggagaggttctgtagtgagcatagggaaaaacaagatagtgggaaatagaactgaaatttcaggctatccttacctgggctaatgcatggtgttgcaaagtagggctttctagtagtagcagcagtacccctgaagtaccaatcttaccaccagtcagctgaggaacaccaatggccttgtgcttataagcaaaagaagctggcacattttcaaaaatgtccagttcattggtgtcctgggtctgcctactgcctaagggcagagagaagagagagaggggatgctggagcaggcggtatagtctgtaccaggccttgttggagccccatggagactgggaggagaggacagctgtgtctaacagaagcccagcatacttttccttcttgttttaaagagggagggagagggagggagagagagggagagggagggagagggagggagagagagggagagagagggagacagaggagagagaggacagagagagagagagagaggagagagagagagatactggaaaaggtgtcctcatcagtgttctagagtttgtctcaaccagattggtgtttgttcctttggtagaaagaaagcagaagtgtggaaggggtagaaatttcttgcactctgtattttgcaaacttatgtatgcaaatttccttgcatatgtgtaatgaaccagaaaaagtaggattcaggagcacatgttttggaaaaatactgctttgcctctggcttttcaatcctcactactgttctgtcactggccctggattctacccataccctggctctcatcagccccctgtctttgacccatttttctgcctggatttctagtcctgtggttatattttttatatttgccctttgcttccatttgtttatcactcgactttatgctgatatagtgtgtttttgtaaattgtttcaaatcctttacagaatgagggctgggtataaatgaaaaattgtgtgcaaacataaatgtaatacagctatcctcctgtatcatattgtccttgaaggtctagataatctcagctccaaaccctttccccatccagtgagaaggctgtcactctcctcaagatttcagtgaaatggttgaagctcatttttttcccagtcacccctggctgctgttgtaaagtgcccacatatttgagaaaacttagaattgcacctcatttctctgcccaacctcagcacttgcctttggctggaggagttgagagagttgtcttttacctctgtctgctttcatggagtgctaagagcatctcccccactttctaatgcatgctatttcagttctccctggccccatgtccaaacactgggcctaagccatccagcccaggctcactaaggtgcatggccagccctggagcctgactgaagatttgaaatgtctggtcttcacttgtccttctcagccacctcagcaaggggtggggacaaatacagagtttacttcctcctcatgatgccaccttacctcaaaacaactttgatctgcttgagttgaatgacttttccaccctctttccttggcaggaacaagtgaccctgtcttccgtggcctcgtggggctggctctgctcctcctcccttgactgagagacgtcatggagattgggtggagggaggactgtagagttggtgcacccacgtcagctagttaggcaatttc

SEQ ID NO: 2035 - DNA, 43639 bp, Homo sapiens
tgagctttttcatttaatttttattttagagtcatttgcttccccatcccaaattaactatgcaaattaattgttttgaagatgccatgcccaaatgtggaggtgactcagagcttggaaactcagaagctctaaggtgagcctccagacagggaaagtctgcaacatggtgactgagagggtagtagaaattcacttgctatttaactctctcttgagatttattcttggaggacagagcaaaagtccactctgaaagacagaaggagtcaatgaatgaggttattctggaggtttttcttttgtagatactggccttcccacttcctagtgaatgtctgtacccagacatcacactggatctcaaacccaagaagtcaaaaagaaaaattagctccctcccccagtcagtttttcttctggacctcacttagtgataaaatcactttttcccctgtcactcaaacccacgaccctagttcttctttcttaacctttcccatccattcctttctccttccatttctccctctctagattaaaatctttaggatttcatcctagtgataatttcttgagtgttgctgagagaggccttgtgttgggtcctgtcatcatagacactagttgttctcaggacaggaatagtgtgctgtggacatgcagcggagagacagaccacggactgggcagcctggaaatgctgcaggggggccagatgagctgggccttgagtagatgtcaggtagaggatgcaggggagtggttgcaggcatctgtcttcagctagtttctttttaggttcttacatctctcttcacctcaaagccctttgccggcatttaaagttcctgtactcctttacttgcatttaaagttctccaccatcaggaacaatatgtgctcctaactttgtcacccacagttttttttctatgaacatttaactccttataaatcatgctgttgaatcctaacgggagctcttcacatttctgctcttaaagctccacttctccttcaaggatttaaacctgtcacctatctgtcccgtcattataataccttcagcagctctcctagggtcattccttcacaacgtatattccgtttccagttctttgcgttccttccttttccttcgacttcaaattcatttggtgttaaccaagttccatcctcattccgaatgcacttcactgaggatcctgtaagaaaaagcccattcttggatctacccccatcctctgtgaattcaccctgaacctcttcatcctaattgtggccttctacctttccaggtcaagagagacttcctctgtgaggtggaaggagtagcaggggagtctgcgggcctcttctcttggactgaagccagccctaaagcctgactgagtggtgaggggtgggacagaatgtgcattcgtgtagtgcctacatgcagcaaggacatggctgtcagtacagcagggcccatgggtgacttccaggtgggagtggagggtctgattgccagaaataccatgatgtggaagagtttggaaattccttcctaagaagcgtttcttctgcagtctagctagcagggtccatttcctgatcaattacacacacgggtattttcctcccttctagtgagtccttcatctagggattccaaagagcagaagaccaaggaactcaccgtgtttcattttcttcttatataaaatccctttcgcctcaccacaggtcacggggagcttagaacagtgaaaatccacagtgtcacttttgggttttccttaaagtagaagagaacagttttgtgttattcagtcttcactccatcttccttttgaattctcccctccatgaattccaataatgtacagggtattggggaacgttctctggttagtttgcaggaactctttcatctcgagtgacagataagctatgtgtacacagtggcctgcaacaaaccaccactgccaccaacactatatcaaaaaaaaaaacattttagtggaacatatagggcatcttcagtgaatgtgtcttaatttgcaagtgaattggctgtcactgaatagtcttctattctataagcatcctgctgatctctctgtgctgatggaaatgtttctttgcattcatgttgccagaggaaaaaaaaatcttcatttataatcttatttcctgacttaaatgaagacttgggtgagtgaggtggctggcactgaggggatggtgtcagtcttaattatttgctgtttcttttcattttattgcttccctgcttcttcctcgatgaataaaagaaaaccctggagagctttgaactaatttcccagttgctcatggagcagtctggcaactcagaacccctgggtagaaatccagagtttagattcaggggaagcagttgcaagagggtttaaaataaatctcagcaattcctgctgccttcccctccaacctcactatgggtgaattcattaaagagagacagcaggggctgtttctctggggagaaatgaaggggctgtccatgtcttatgttgagttacagaggatgttacacctaaaatgaatctaggagaacacctggtccaactctctcccttgcctcaaacagttattgaaagagctaaaggaaaacaaatggcaaaacaagagcattgacggaaaggtgaaggaacagtatcagcggcgaagaagccattcatttctctggaaagacacaaggcagatagagtgagactgagagaggagggaccctgagaagtgaggatgtgatccccccgacagaaccctacaggatgcctggcctcacaggagcaggggctggcagcaaggctaggcatgggggtggagggtagtgggggtgtgggaacttacggtgggaaaaactttgtttcaacagccagccctcttgcatggagtggccagctccaccatttgtctctagactcaactcagtaaatatggaacagcagatgagagcgtggccttgggagccagactggggggcagggaggagtgggggtgggaggggcttgtaatcctggctctgcaacttactagaaggattacctaagcgtgcattactgttatcaaatttgagtgggaaatttgctgccgcaggttcctaatgtgagggaaaggcagagctccaggtgactctggaccactattgcaaaccttgagggagattagcacagctctggggaccttcccttctacagttctctgtctccacagaaatgtcttctctaattccctgtggtgaatatagctttagggaacacaaatgtcccaaacacattcacaagcagatgagggagcagggggtggctttgggggccacgggtagcaagctgatgtgcagagttgtgaggacaaacatcagtcccttccttacccagtggaggcaggccatcaagtgaggtggggcctttagacccgaggacttccaaagccaactgtcctatgcctgagggcagcctgttcctaatagtgctaagtctggctcagcctcacctactcatcttaccaaccaggccttgaaggatggaaccctgcagccccaggaacccggtgggggatgcttggggctctctaacggcagctggcttgtttgaaaggtgagctgcagcagcggtgagtttaggtccccattaggaagcatgagcaaacaatgaggagcctgctgtgaaaagcaagcaattagagaacagagagctcagggaaaggaaaagcaaggtggagaaaactaagaagaaaagcctaatcgagatgaggaatagcggcatggtaaaaaacgaattcataatccagaagaccaactccaggaattcctacagaacatgaggaaggagcacaaggtggaaattatgcatggaaagaccacaggcctggggagtgatttgggagctctatgatgtatacatgaggggtctggggaggggatgattgggggtggagatggggcggtgggaggaaaagtgatagtcaaggaaacagtaagagcagcagatgcactgtgtcatctatccgcataacaatgtgtaagaaagagaaggcaatgactgtcctcattttatagatgagggacttggggtcagatgtggagagagaattgccggtggtcaccatattacatgaggtggagctggcactggaatttacacatgccagacccagtatctagcgctctttccacatcatcagaaatgccacgagactgcacatcatacaagcaacaacagcacagatactctgcatttaatgagaagttacagacagtgcagaagggagaagaaactgatgctgagggacaactgtcaacgtttgccggggctcctgcctccaccagtgtttgagagtaggtgctttctaggttcatttacatttttagtgtaaaggaaaaagggcttgaaattggaacacataggttgattttagctcattcaagtcttttgccctttaattgaatctgtaaaatgggctgataacactcacttattatggtaattaaatggcaaaatgtagatcaaagtgctttgccaactgtgaagtaatgtacacatttatatggttatcaggaccactgcatgaagttgtatgggttgtgccctgagcaaggactccacctttaaggggtgctctaattcatattagaaacagaatcagtttacctgcttagtacaacaatcttccagcagaaggcagaaaagggtttggtttcaagaattggctctgacagatgaggtagtgaattgaggaaggggcacctttttctaactcacacacatgcatcagataggcccagatactggtattcatacttgaagaagtaccagctgtgtgaggcatggggagctggacatacagcaacacacaagacccatccacttactgacctcacgtgactttcacgcagtgaacaggctgtgcacagatcattcatcacagttaagataagtgccatgaagacaaaatgcaggtctccacaagggcatgtcagggagacccacccctacctgctgggagagagaatgcttccctgtggaagtgacatttaaggtgaggtctgagggcaaaggtctaatatccagaatttacaaggaacttaaacaaatttacaagaaaaaagcaaacaacacctttaaaaagtgggcaaaggacatgaacagacacttctcaaaagaagacatttatgcggccaataaagatatgaaaaaaagctccacatcactgagcattagagagctgcaaatcaaaaccacaatgagataccatctcatgccagtcagaatggcgattattaaaaagttaagaaacaacagatgctggcaaggctgtggagaaataggaacacttttatactattggtgggaatgtaaattagtttaaccattgtgaaagacctcgaagcaattcctcaaagacctagaaccagaaataccatttgactcagcaagcaatcccattactgggtatacacccaaaggaatataaatcattctattataaatatacctgcatgtgtatgttcaccgcagcactattcacaatagcaaagacatgggctcaacctaaatatccatgaattatagactggataaagaatatgtggtacatatacaccacggaatactatgcagccataaaaaggaacaaggtcatgtcctttgcaggggcatgattacagctggaagccattatcctcagcaaactaatgcaggaacggaaaactaaacaccacatgggttctcacttataagtgggagttaaacaatgagaacacatggacacagggaggagaacagcacacattggggcctatcaggggagcaggagggagagcaccaggataaatagctaatgcatgttgggcttaatacctaggggatgggttgataggtgcagcaaaccaccatggcacacatttacctatgtaacaagcctgcacatcctgcacatgtatcctggaacttaaaataaatatttttaaaaaaggtgaggtctgagggtgtatagcaaagaaagggaggaagatagggggattcactttggggttgggtgggtgagctgggaggcccatgtgaggaggccctgagcaggaacgaggtgggagcattcggtatctggtgacctatgctgtgaggaatcaggctggtgtgaccctagagacacgggtaggggtggtttatgggtgttggtgacatcctgtgtcttgagctgcgtgctgggtgtgcgggtgcattttctgtgtgtgtgaatccatcaagctgtactcttaggatacatgccattttctgcaagcacatacaccagtgctactcagtgctccagcctacgatgcgacaggggcttgatcagaatcaatgcactgctgtctccactgaggaatcttgctatgaaaacagtgtgcttagcgtcacagttggtttacaagctccttattcttgtagacctgccaagcagcatgcttgtagatggcaccagtctggggaccccaccttgggtagcacctattatactttgataatgaataaaaagggccagtgtggctggcgcctaaaaaaggaagagagggtgacaagaaatgatgctgaagaagcaaggtataaaagcagaagaaaaataaatgcaagaagaggagtgggagggagaggacagagatgcaaagagggccgagggtgcagagaggctgaagcaagcccagggtcccaaccaacacaggaaaaggaacgagaacactgtcaggctgtgcttgaataagggtttcctttaattcctagaatggaagacatagaagttcattttagaatttgacttaaaggtttagtgatcatccttaatcatttttgggtctttgtatagctctgtgttaaagaatccttccaagtatggaaatggccaccatgcacaagggggtgggttaggctggcagcactcctgatgcacccaattcagctggtacccatgacggtggagaacaactttggaggagaagggagagagaagaaggagagggcgggtggagcttccagcagaggccagggctctggggagcccagtggggaggcgctgtggcttgcttgcttacctcttcggtgaatatttttctgaaatctcctttttgagcttgaacagatatctttctcctttttcttttctaaacacagaattaataatcacttatagctacaaacatagatttataagcctcataggttaacaatcttcaagcattttttcctgtttttctaccagtttggagagacaagttacatatgagtccttatgaaaggacttccttgtagcattgactaaggaaatacagcaagctcatgttaataggcagaaaagctaaaaatactacagaagccaaatttccactaattaatatatgtcaatacatttactacaaatactagaataaagggatgtacaggagtccccccttatccacacggcatgtatttcaagccctccagtggatgcctgaaaccatgggtagtgcccacccctgcagatactatgtttcttcaatctgataaccaagacagctactaagtgactgatgggtgggctgcgtatacagcaggacacactggaccaagggatgattcgcatccccgagtgggatacagcaggatggtgcaagactttgtcacgctactcagaacagcgcatcatttttaacttataaattgtttatttctggaactttccatttaatattttcaaactgcagttgacttcaggtaactgaaatcatggatcaaaaaactgcttataaaggggggctactgtatggccttataaatatcacataggaagggctttttaaggaggaagtaatgggcataaagcagtggttaacactgggtgattttgctctcaggggatatctggcaatgtttggaaatctatttgtttgtcaggacggggaagcagctgctactggcatctaatgggtagaggccagagatgtcgctaaacatcccatgacacacacgacagcctccgaagcaaagaattattcagtccaaaatgtcaataatgccaagattgagaaactctggcataaaccatactgctaaaggtaaactgatttgtctatctaactaagcaaatggctccacaaccaaaagcttcttaagttcaaagacagaaaccaaatcagaaaaactaataattataacaaagggttaatttccctaacggatttaacaaaaaaaaatggccagtcttatagaaaaatgggcaaattcaaacagatgaccctcaaaagaaaaaattccaatgtcaaatttatttaaaaaacaggtaaattggtaacgataggctaggtaatgctgtggtaattcacgatcctcccaaatctcagtggtttattacaggtgtcagcaaactatggtctaagggccaaattggcctactgcctgtttatgtaaataaagttttattggaatacagccacgcccatttgtttacgtatttgcctctggctgctgtcacgctacaaaggcagagtcgagtagttgcatcttctggtcctttttggaaaaaatttgccaagctctggtttacaatggcaaaggtttacttctctctcatgctgtttgttcatcataaattagatgaggctcagccctacatcactgacactcatggcttctgcagacagagcagcctctgtctagaacatccctggtcttgggcagagagaaagaagacaaaggggctcttaaagccttggcctgaaagtggctctctaacttgggtccacatttctttcgctaagttatcacatgggcattcctgagtccacaggcagggctgtagacttctgaggaggtggggcactggaacactggagaaccgtaatacaagctaccacagcatgtttgatcacctgccaagtgaaaagaaattcaaagggaaacaccggtggaatatcacccttcacctttggccgtcatcatagacacatcttgttatttctagtgttggtgaaagtggagggaaagggtgtctgtatgatgtaatgggagtataaacagacaatttaggcaatttgacaacaaatatgtcctaacttaaaaatgcagacttgaccaagcaacttcacttctagaaatgaaacattaaaaaacaatcctgcaaatgtgtccactttgaggattggtgccacttccaagactgggttggccagaaccagaaaggagtctcccaaactcaagagagtagtggtgactctaataacagaaatgaaaacagcagacactggggagtagtcatgtaaatccacatggcaaagccaaggtgaactgcaccctgagaacacttcttccaacaaccactgtcacatcaacagatccgtgctctgtcttcatgtccctcttttctgtacgtctccctccttctactattgactttacatatctatctgaccctgtactgctccaagaggccctcctacattgagctattcaaatagcagattccatcattagccttacctttcaatctggactttcgggcacatttagttcttgccttttggaccctcatcatgacctctgagttccaggttgagtcgtctttcctttgagtcaccttatccaccacttggagcttctcttggatgccatgcccaggtgaggctgcccctggaccaaatagacttgtgaatagtttagtgagctcccttctcatgttcccagcccctaccctttcaggagttatcttgccatttctctataattctctcttttcttgtgtgtatctttcttccccccagactcataatacttccttctatttctctttttcaagtcctcattttgtttagtaattacaggtgtatcaattagaatgcaagctccactagtgtagggatttgtgtctgtcttgctcactgctgagttcccaggacctaggacagatacctggcccacaccttacactccactgctgaatgaatgtttaataggcactaaagttttgaaaatattaaatgtatttttctttttaatttgtttttatttcaatagcttttggggtacaagtggtttttggttacatggatgaattatataatggcaaaatctgagactttagtgcactcttcgtctgagtagtgtacattgtacccaatacataggtttttactccccctcctccgtccctctcctttctgagtctccataatccgttatatcactctgtatgcctttgagtactaatatcttagctcccacctataagtgagaacatacagtatttggttttccattccatcacctcacttagaataatggcctccagctccatttaagttgctgcaaaagacattatttcattctttttttatggctgagtaatacaccatggtgtatatatactacattttctttacacattcattggtcaatgggcactgaggttggttccctatctttacaattgtgaattatgcagcaataaacatgtgtgtaggtgtcttcttgatataatgacttattttcctttgggttgatacctagtagtggggttgctggatggaatggtagatctacttttagttatttaagaaatctccatactgttttccatagaggttgtactaatttgcactcccaccagcagtgtataaacattcccttttcaccacgtccatgttaacatctatttttttttgacttcttaataatggccattcttgcaggagtaaggtggtatctcattgtggttttaatcttcatttccctgatgattagtgatgttgagcattttttcagatgtttcttggccatttgaatatcttcttttgaaatatgtctattaatgtcatttgcccactttttgtgggatttttttctataatgtttgagtttcttgtagacgctggatattaattcttcattggatgcataatttgcaaatattttctcccattctgtgggttgtctgtttactctgatgtttatttcctttgctacgaagaagcgtttcagtttaattaagtcccatttatttatttttgtttttgttgcatttgcttttggggtctcagtcatgaattctttgcctaggccaatgtccagaagagtttttcctaggttttcttatagaatttttctggtttcaggtcttaggtttaaatttttgatccatcttgagttaatttttgtataaggtgggaaatagggatccagttttattcttttacatgtggctaaccagttttcccagcaccatttattaaatatggtgtcatttccccaatttatgtttttgtatgctttgtcaaagatcagttggttttaagtatttggctttatttctgagttctctattctgttccattggtcgatgtatctacttttataacagtatcatgctgttttggtaactatagccttgtagtataattttaagtctggtaatgtgatgcctccagatttgttctttttgcttaggattgctttggctttgcaggctcttttttggttccatatgaattttaagattttttttccagttctgtgaaaaatgatgttgatatttgataagaattgcattcaatctgtagattgccttgggcagtgtgatcattttcatattgattcttccaatccatgaacatgggatgtgtttctatatgtttgtgtcatctatgatttctttcagcagtgttttgtagttctccctgtagaaatctttcatctccttggataagtatattcctaggtattttattttattttgttgaagttgttttaaaagggattgagttcttgctttgattctcagcttggtcactgtaggtgtatagcagtgctaatttgtgtacatttgattttgtaacctgagactttactggattcatttatcaaatctaggagtcttctgaaggagtctttagggttttctaggtatatgatcatataatcagggaacagtgatactttgatttcttttccaatttggatgtcatttatttctttctcttttctgattgttctggctaggacttctagtactatgttgaatagaagtggtgaaagtgggcatccttgtcttattccagttctccaggggaatgcattagattttttcccatttagtatcacattggctgtgggtttgtcatatatgacttttataactttgaggtaagccccttctatgcctagtttgttgaggatctttatctaaagggatgctggattttatcaaatgttttttctgcatctattgaaatgatctatggtttttaattctgtttttgtgatgtaccacattattgacttgcatgtgttaaaccatccctaaatccctgggattaaatccacttgatcatggtgtattatatttttgatgggctgctggattcaatctcactgtttgttattggtctgttcatggtttctatttattcccaatttaatctaggaggggtgtatgtctccaggaatttatttatttcctctagatttttctagtttttgtgcatagaggtgttcatagtagtcctgaatgatcttttgtatttctgtggtgtcagttgtaatgtctccagtttcatttctagttgagtttatttgaaacttctctctttttttttggttactctggctaatgttctatcaattttgtttatcttttcaaagaaccagctttttgtttaattgatcttttttattttttgtttcaattttatttcattcttctctcatctttctttttttctgctagctttgggtttctctagttccttgaggcatgacattaggttgtcaatttgtgatctttcagactttttgatgtaggcatttagcgctatgaactttcctcttaaaagcactgcttttgctgtatcctagaagttttgataatttatgtcactgttaccattcatttcaaataattttctaatttccgtcttaatttcagtgttaacccataaatcattcaggagcagattatttaatttccatttatttgttatggttttgaaagttccttttggagttgatttctagttttattccactgtgatctgaggagatacttaatataatttcaatttttttcttctaaaaaaccccccaaaatgggacacacgtgcagaacatgcaggtttcttacataggtatgcatgtgccatggtggcttgctgcacctattgacccatcctctaagttccctcccctcaccacccacaccccaacaggccctggtgtgtgttgttcccctctctgtgtccatgtgttctcaatgatcaactcccacttatgagtgagaacatgcggtgtttggttttctgttcctgtgttactttgctgaggatgatgggttccagcttcatccatgtacctgcaaaggacatgatcttattactttttatggctgcatagtgttccatgatgtatatgtaccacatattctttatccagtctaaatgctggattctttatccagcatttgggttggttccacgtctttgctatggtaaatactgctgcgataaacatacatgtgcatgtgtctttacagtagaatgatttatattcctttggatatatacccagtaatgggattgctgtgtcaaatggtatttctggttctacatccttgaggaatcaccacactgtcttccacaatggttgaactaatttacactcccaccaacagtgtaaaagtattcctatttctccacagcctcaccagcatctattgttttctgacttcttaataattgtcattctgactggcatgagatggtctctcattgcagttttgatttgcaattctctgatgatcagtgatgttgagcgtttttccatatgtttgttggctacgtaaatttttttttttttgagaagtgtctgttcatatcctttgcccattttttgatggagttgtttgtttttttcttgtaaatatgtttaagttccttgtaaattctggatattaaacctttgtcagatgggtggattgcaaaatttttctcccattctgtaggttgcctgttcactctatttctagtttcttttgctgtgctgtagctgtttagtttaattaattcccatttgtcaatcttggcttttgttgtaatagcttttggcttttttatcatgaagactttgcccatgcctatgtcttgaatgatattgcttcagttttcttctagggtttttatggttttgggttttacatttaagtctttaatccatcttcagttattttttgtataagatgtgaggaaggggtccagtttcagttttctgcatatggatagccagttttcctggcaccatttattaaatggggaatccttttgccattgcttgtttttgtcaggtttgttgaagaacagatggttgtagatgtgtcgtgttatttctgaggtctctgttctgctccatggtctatatgtctgttttggtaccagtaccgtgctgttttggttactgtagccttgtcgtattgttcaaagtcaggtagtgggatgcatcccgttttatcctttttgcttaggattgtcctagctatatgggatcttcttcgattccatatgaaatttaaaatagtttttttttctaattctgtgaagaatgtagagacaatataccagaatctctgggacacagctaaagcagtgttaagaggaaaacttgtagcactaaatgcccacatcaggaagctagaaagatctcaaatggacaccctaacatcacaattaaaagagctagagaggcaagagcaagctaatccaaaagctagcagaagacaagaaataagtaagatcagagaaaaattgaaggagatagagacacaaaaaaccctcaaaaaatcaatgaatccaggagctggttttttgaaaaaattaacaaaatagatcactagccatattaataaagaagagagagaagaatcaaatagacagaataaaaatgataagggggaatatcatcactgatcccacagaaatacaaactaccatcagagaatactataaacacctctacacaaatgaactagaaaatctagaagaaatggataaattcctggacacatacaccctatcaagactaaaccaggaagaagttgaatccctgaatagaccaataacaagctctgaaattgaggcagtaattaatagcctaccaacaacacaaaacccaggaccagatggattcacagctgattctaccagaaatacaaagaggagctggtaccattacttctgaaactattccaaacaattgaaaaggagggaactcctccttaactcattttatgaagccagcatcatcctgataccaaaactgggaagagacacaacaaaaaaaaagaaaatttcaggccaatatccctgatgaacatcaatacgaaaatcctcaataaaataatggcaagccaaatccagcagcacatcaaaaaacttattcaccatgatcaagtcggtttcatctctgagatgcaaggttggttcaacatacacaaatcaataagcataatccatcacataaacagaaccaagacaaaaaccacatgattatcttgatagatgcagaaaaggcctttgataaaattctacatcccttcatgttaaaaactctcaataaactaggtattgatggaacatatctcaaaataataagagctatttatgacaaacccacagccaatatcatataaaatgggcaaaagctggaagcattccctttgaaaaccagtacaagacaaggatgccctctctcaccattcctattcaacatagtattagaagttctggccagcacaatcaggcaagagaaagaaataaagcgtattcaaataggaagagaggaagtcaagttgtttctgtttgcagatgacatgattatatacttagaaaaccccatcatctcagcccaaaaacttctcgaactgataagcaacttcaacaaagtctcaggatacaaaatcaatgtgcaaaaatcacaagtatgcctttacaccaacaataggcaagcagagagccaaatcatgatgaactaccattcacaatcactacaaagagaataaaatacctaggaatacagctaacagaggatgggaaggacctcttcaaggagaactacaaaccactcctcaaggaaataagagaggacacaaatggaaaaacattccatcttcatggataagaagaatcaatatcttggaaatggccatactgcccaaagtaatttatagattcaatgttattcccatcaaactataatttcaatttataaaaatttattgagacttgttttgtggctatcatatggtctatcttggagaatgttccatgtgctgatgagaagaatgtaatcttctgtaaatatctattaggtccatttgttctagagtgtagtttacatctattgtttcttttttgactttctgtctcaatgatctctctggtgctgacagtggaatactgaagttccccactattattgtgttgttgtcttatctcttttcttaggtctagtagtaaatgtcttatgaatctgggagctccagtgttagctacatctaaatttaggactgtaatatcttcctgttagattgatccttttatcattatataatgaccttctttgcctttttttactgttgttgctttaaagtctgttttatctgatatgagaaaagctactcctgtttacttttggtttccatttgcatggaatatcttttttcacccttataccttgaatttatatgggtccttgtgtgttaagtgagtctcttgaagatagcagatatttggtttgtgattttgtatccattctgccaatctgtatcttttaagtggagcatttaggcccatttatgttgaacattaatatcaagatgtgaggtactgtttcagtcatcatgttaattgttacctacatacgttgttttcttcattgtgttattgttttatagaccttgtgagttttatgctttcaagagtttgtattctggtgcatatcaatctttcgtttcaagagttagaactccttttggcatttcttataaagctggtctggtagtgacaaattccctcagcatttgtttgtctaaaaatgactttatttctccttcattcataaaacttagctttgccagatacaaaattcttggctgagagttattctgtttaaggagactaaagataagactccaatcccttccagcttgtaaggtttctgctgaggaatcatgtatttttcatccttgcaaatagtaaagatttccctgactattacatcaataggtttcagggggagggcagatgcttgctagaattgagaagccactgctcagttggggccattttggcaagcttagacaaaatcttgaagcacagtatttgttgggagcaaagaggaatttataaattccaaaaattacctgtacctatcaaaagaaaactttggaggtctgaatgtcaagttttcctataagtcattggtagtgaacactcagcaaatgacagagagtatgtttcctccagcctagggaggcagtggggtggggaactaggaagaagaggccagggaggggaagtgcaagcaggcagatatgactttccttctaggccaaaccccaagattgaggcatgctgggaacaagcagaaaaattagagggctttccaaagcagtgagcctcatgtcctaattcatgtttgggagctgggacaagatctcttcccaggctggctcccataaaggtacagaatccaagagaatccccactgaccggcatatcttaggccctttgtgaataattttgagtaaaagaataaagaaaaaggggccaggtgcaggggctcacacctgtatccgagaactttgggaggctagggcaagaggatcacttgaggccaggatttcaagaccagcctggacaacatagcaagacctggtctatacaaaaaatttacaaaataaattaaaaaaagaaaaagggaaaaagaaaggaacagaaagggaagagggagagaatacagaggagaaaaagaaaagtgggatgaagcagaggaaccagaaaaatgcagcttttttgtttcttattctgcaagtaacacagtttgtgcactggagtagacacatgcatgcaggcatgcaagcaagcatgggttgactgaggtagttctgaacactctatgactccaaatctaatccagtttggaactgaaagtctgaatcctgcttggggatttaggtttcttgtgtctattcttctgggctctgaccctagacaggaaacaattctaatctcaaaattgtctgatgcctcatgtccacctcaaccccattccctccctatgataagagaaaagaagactaggtataaaccaagttggtgttaggtttgctcttcctttgttggggagtctactgatggggtggcctaggggacaaggttggggctggctgtgctccaggcacatgtggctggagaggaggtcatgccagctggtcaggtgaggggcctgataaacaccaagagagtaacaatttcacttttcttccttatgtcttgggcattttttttttctgttttctttttgaacttggccatattcttttctccttttttctaaaaaagaaaaaacccacatcttttatggctacaaatattgatctacaaacctgcaatgtcattacttttttaagtaatttttttcctgttttccctgactttgagaaggcaagaaaaccatgtgacctatgtgaaaaaagtactccattttagctggaaattgaattaggggattgaataaagatggatcaggaatatactagaggactaacatttaatatatgtcatttaaaaagttttttggggacagagtcttgttctgttatgcaggctggagtgcagtggcataatctcagctcactgcaatctccacatcctgggtccaagtgattatcgcacctcagcctcctgagtagctggcataacaggtatgcacccccaggctaacttttgcatttttagtagagacggggtttcaccatgttggccaggctggtcttgaactcctggactcaagtgaacctcctgcctcagcctcccaaggtgctgggattacaggcatgagccggcatgccttattaattttaaaattaataagcagtttttcaagactagacaaagattgttataaaccatggatattaaaaggtttcctagccaaaattcagggccagaaattacacagttatgagataaacagatttgaatgtttaaaaaattaaaaatatacagaaggagcaggactgaaaaaaactgttcacagttcaaaaaacaccccgacactattaaagcaaaaacaaaatttaaatatacatagcatatagaaggttaatatccttattagataaagcaaaagatgaatggtaatctaggaaaataagcaaaaaatataagttaaaaatgctcaaggaggaaatgaagatgacaaatttatttagaaatcatctctatattactactaatcaaagaaactcattgtttggatgttaaggatacctaaacatttaaaaagttttattacatccagcattgaggatgtaggaaatgaatactcatatattgttaaagggaatataaatcattatgttttctggacagcaaattggtaacatgtataattaagatatagattttaaccaagtaagcttgtgtttaagaatcaattctaaggaaattattggacaagtgtgcaaagatacaaatacacacaaacctgatttctattttcatataaaaataagaaataaactgtccactagtaggtgattatttaaacaaattgcggtgaatcatacgtaacgtgccatgcagttaaaaaaatagataacattgatacagagatgatacacaatgaaaaaagtgatttatagaatagactatatagtatgagcttatatataaaaagaaaaatgtatgcatacttatacaaaaataaagtgggggaagcagattaaatagatgtttaactttatgatttataattttcttttttttaaaattttattattatattttaagttttagggtacatgtgcacaatgtgcaggtttgttacatatgtatacatgtgccatgttggtatgctgcacccattaactcgtcatttagcattaggtatatctcctaatgctatccctccctcctccccgcaccccacaacagtccccagagtgtgatgttccccttcctgtgtccatgtgctctcattgttcaattcccacctatgagtgagaacatgcagtgtttggttttttgtccttgcaatagtttgcagagaatgatggtttccagtttcatccatgtccctacaaaggacatgaactcatcattttttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttgggtatatacccggtaatgggatggctgggtcaaatggtatttctagtcccagatccctgaggaatcaccacaccgatttccacaatggttgaactagtgtacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatatcctgaatggtattgcttaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatataattttctttttctttgttttgagacagggtcttactacattgtcaagctggtttcaaactcctgggctcaagcaattctcccatgttggcctcccaaagtgctgggattacaggtgtgagctaccatgcctagcctgatttacaattttctacactgaagattttattaggaatattgtatcacacaagacagggtaggctgtgctgcagtaacaaatgaaaccaaattttggtggtttaacattgaaaagtgtatttctctatcacatgaagttctctgtaggacaataggaccctctgtaggactggaagtcctctgtagggccctccagggctgctgtcctctatgtggtaggtcatgctgctttggccttctggcgcctccctcttccacacacttccacaggcgggaaaagaatgtggagagctgcaatgggctcttacatgctgtgacccagaagtgacacccatctctctggcttatttgccagagctagtatagcagagctgcctcctgcaagggggatgataatggagctttccaagtgtctgggaaggggagaagaattggaactagaggagggcagtcataatgcccaccataaacatgggcagggtgagcactgctagttgttcctctttctctggtctccctttttctttagtaataaagcccctgattctgagccccttattcttatagattaaagattacatttcccagcctcctttgaagtcaggtgtggccgtgcaaccagtcctggcaataaaatgatagaatttttttttcttttttgagatggagtcttgctctgttgcccaggctggagtgcagtggcatgatcttggctcactgcaacctctgcctcctgggttcaagcaattctcctgtctcagcctcctgagtagctgggattacaggtgcacaccaccaggctcagctaattttttttgtatttttagcagagatggggtttcaccatgttggccagactggtcttgaacttccaacctgaagtgatccacccacctcggcctcccaatagcaaattattaatgatagcaaattactatctgtgaccggaagcatttagagtccttcagtggaggaggtgtgcccttctttgactttgccattttctctttagctggaacatagacatgctggctggacctcaataaaggggatgccacatgctgaggatgatggagccacatgctgaggatgatggagcaacaagcaagaataagcccaggaccctacagtgtatgacaccagctcttgaccacctacctctcttgctttagctactattattattattattattatttttttttttttttagtggggtgaggtttgctgtcacacacagcaacataatcctctttttttttttttttttttttgagacagagtctcactctgtcacctaggctagagtgtagtggtgtgatcttggctcgctgcaacctctgcctcctgggttcaagcgattctccttcctcagcctcccatgtagctgggattacaggcgcccaccaccacgcctggctagtttttgtatttttagtagagacagggtttcatcatgctggccaggctggtctcgaactcctggcctcaagtgattcacctacctcagcttcccaaagtgctgggattataggcatgagccactgtgctgggccagcaacataatcctaatggtgacagcacactgcttttagaaaagtccaggaacttttctatgttgaaaaaaagtgaaatcatgattttaaaaagcataacgctttttctggcttggatgtcttttatggcctagaatggcataataacagtaaggtaacatcaatccacaccacagagaccaaatagtttcttcttcacacttatgctctgccctgggagattttcccagagagagtttatttccattatccataggatcttggaagtaatgagaaagtaatttttgaataagcagttttctattttgggcaatagtgaattgacaaaggtttgacagtattctttctgccccttcctttctatggagaacgatggctcctgaaaagagttcctggggaccaggttgttaacccggtggcagccagcccttacccaggggatcctgaaaaaaatccattaatcctttccatatcttaatttcctcatctgctaaattggaataggtcattcaatcttctccaagggtggttgtgaaaataaaataaaattatccatgagaaaagttgaaatactactagataagccagtgcaatataggagaaactgttaaaatgataatttagattttaaggtggtaaaatttaatccatttttcctgacaataattagatatttgttgtttgaaaatcacatttgtcatgtgagagttctgtgatttttgtgacaatgaccatatcaccagcaaacagacgaatatctagctgttttttcccctctaaggatagtgttatcaacttactccagaaatgtgaataatggtagcgatagtgaggggtgaattaacatgcacaattttaccagcacatgcccacaactccaccagttgtacatgctcagtcatagtgtcacatgtgtgttttaatgagtttttcgcttctcaattttctcagaaaggccacatgagaaatatggagattggaattctaggaaaaagcttgatccatgggttggatcaagctgcactttcgacaagctgtactttcagtatagtaccatgaatatacttaggacactcattctcagtaatggtgatattgctgccagtagtggaaaaactcattcttgagtgctgagaaaaatcttatatagtgcagatatacatacatacatatggacacattacataaaatggacatatatttgtagtagtaaatatcatgggaagggtcttgattaagaaaaaaaaatccagaagggctctctagcacagtaataatgaaaaaaaaaagttaagaaatattgcctcagtgtaagacagctctgaatttagattcctggtgactgtactctgagaccagcaatctccaagttttaccttgtgtgacccttcgtggtgtactaggcgtcttctgggacctctttccttcattcatttctgaagtgccatcaatgatctctggaaaatgaaagatcttagtaaatgccccttgggaaacaccatggagaatctcccagagacccaggaaggcccttgcacactctgaagttgagtcttggaggctccaggtcttaccctcctaacaatgcatctaccaagagatttggtgctgctcatgacactgtgcctgtctgccactcaggggaggagcagaccgcagttggttagcagtggttactctaccaatggagacatccacagtggggtgcagccatctgaaccccttggccagagtctctcaaagtaaggtctgtgagcccctagggggtctgtcaaaccgtttcagaaaatttgcaaggtcaaattgttttcataatatgatgttatttgcctttttcactatttcaacctttgtacagattgagcaagagcaatggcagataaaactgctggtgccttaagacacatcaaagcagtgtccccaaatctcagcaggaatcactgcatcctttattgccacctactcactgtaccaaaaaaaataaaaataaaagcaagattcacttgagaatgtttttggtgagccagtaaaaattattaattttattaaatttctacccttgagtacatatctgacatcttaatattctatgtgaaaaactgaagagcacatataaagcacttctattgcatcctgaagtaccacagtggcctcaagaaaacacttgtgtgattgagatacaagctcactgtataattccaaatgtatattttccaaacagctgtactattataaaatcttgcattagtagaaggtccattcaaaatgcaaggtggattaatgtattttattgtaacagagtatgaagttaattgatatggtttcaaattttacattacaactaatatttaagaaactatcacttgttgagtgttggtgtagtattaaaggtgaatatccacagatatctcaaaagactgttaaattacctcacccttttaaactagatatctgtgtaaggccagattttctttctatccttcaatcaaagcaacatatcacaactgaatgcagaaacagttgtaggaatccagctgtctttttataaagctcactcacaatcaaagagatttgcacaaacataaaatgatgtcactcttttcactaattttttttgttttagaaaatatatttacttttcataaaataatgctatttatgttaacaggcaattggtttattattgttacttttacatgaattaatattttaaaattattagttttaatttctaatcaggtacatgtagatagacataaacaacataaacagaagctccttagggtcctcaataatttttgagagcataaaggagtcctgagaccaaaaaatttgagagctgctgccccaggccacagctgtccctgtgaacacgtctgtttcttccacaaaacttttcagatgcaacagatgcttgctctctttgttcctcttgttataccccatcctcattctctgtactttttccttttactattgactttacatatctacttaactctgtacctgcttcaggagagaccctcccacactgagccattcaaatggcagattccatcatcagccttaccctctgatctcgactttcgggcacattcagttctcgccttttgggcccttgtctctaccgtggagttacaagttgagtcatctttcttttgaggaacctgatccacccttttgagcttcttttggattccgtgtctagatgaggctgtccctggaccaaataatgacttgttaatagtttaaattggggtcttcagtgagcctcctacagtcccaatcagtgacttcccttctcatgcccctaactcccactctttcagatctctgtacccctgtacctcacttttctcctcctacttctctataattatatccttcttcttatgtgtacctttctttgcctccccaaattaccatctgctttcactcctggtatgacctgttgcaatcaactagataaagctggggaaatcctagagcttatttcctgattttcgtttgtgtcggcctgcaccacgaggtggccacacagtctcgtctaggtggagaggaggtgtcttataaagcacctctccaggttcccccacggcctgtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagaggtgagtttgcttcattgtggaaaaagaacacaattttcaccggctgttgactttagaagctgatcccacaggatgaccgctgtcctgttgaacaagaacgtttctctgcaggttagaaaggacacagagtgtgcagccatgcttcccgcacgcaagtgcggtgatatccgcaggccacttccggaggaaaaggcatgggtgaacccttaagagggggcggaagcgaaagcccggtgggacccagggctggcgggaagttcaaacacggaagttactgaatatttatccagaagaggtggggcagcctgatagagcctaaaacttgcctttcattgccaagtttagggttttttttctgcataactaaaggagggtttcggagatgagaacacttacagaaaatatgagagtgtggtatgtatattttcagcactactatatatatttttctcttacaattttgaaacatctttttatgtgttttgttttgtaaaaaataaagctgattaattaaatgtaaaataatatgactcttaaaaatatctctgttgggctgcgggcagggaggaatggggagttgtttaatgggtacagggttttagttttacaagataaaagagtcctggagatggatggtggtgatggttgcacaacattgtgaatgtattttaataccattgagctatgcacctaaaaatggttgagatgataaattttatgtcatgtgtattttacccaggtaaaaaattggaaaattggaaaaaagaaaattaaaagcacatcatctgtcacatttaaaataaaacgattcttttaaaaaacctgaaaaatttcatttaaatacaatatgaagaaaggcaaatctggaagggactggagtctactcctttcggtagcttggcagagagatgtcaaaaggtcagagttacctcaacagaactgaccatctgacactgactccagaggtttcccctctctaacaaagtcacttctctgaccagggagtgttcataattgtatagttgcatagacattccctgtctccctaatcctataacgtgtagagcattgtgagagtgggcatctcactactgggctgctggccacggggtgtgcagagtacgtatgtctgccctaaatatgggataataagaatttggagaattgtattggaaatttccctccaataacctttagtttgtatctacaccacgtggtgcccataatgtctatgaccccttttcataacacaataatgaattcataaactatcctttgtcagatcattattcaaattttgggttacagaaagtatggtttctttcatttttttttcattaaaaaaaaattaatagctaatttgtgccaggacattaccatctagcctagaagagacacattatgtaagtaattacaatagagtatttggaaccttccaaaagagccagtgctgggtgctgtagaaattatgggaccagcttggctaatttaggggtcagagtatgtattcctgagatagacataagtcaacacgactgatgaaaaggagataactaaacatttatggggagtagtgtaggttcagaatatagcatccaaagagaatagcacatgccaaggatcaaaggggagagaaatgaaatgggaagaaatgaaagttcagagtggttgactggagttttgagtggaaagagatatattaatagttggagggtaaggcatgagttagactggatagaacttaacaatcacattaaggacagtgaacattaccctaagggcaataggaggccatggacaagatttaagcatggaaataaactaattagattttaatgtagaaaagaagagggtgaaccaatagaccttgtcaatatgctaatagagttcagttagtcacggatgactaaggtttttgcttggcacctgggtagattaagttcctcatttcaagttaaactacaacaggctcccaagggcctgtgaaaccctacataatctgattcttgtttactttttcacttcctaccaccttctttcttcatcatcaccaacaacactggtctttcctctctgcctcaggttctttgcacttttgagtccctctgcctggaccatccaatccaaagtgactcccaccccaacctgcaagtcactattgtaatcctatccattattttctttcatcctgtcatcagtacttgaaattatcttgtttatgtgctttctagtttatattctttccttcccccagccaggatgtaacctccatgagctttcccctttgttttttgcttactttcttactttctctctttaaaaaaaaaatctgtcttcagctttcagaatgggtatatacagttagtgctcactgcatatttgttggaataaatgtctgaatggtacttagaagactaggtttttggtaaagaaggtgaagttaatttcaggcatattgagactgtagtgtcaatgggagacttgcaaacaaagacgcccagtgtgcagctggctatgtgtttcttgaagacaaacctgagttgaagacgtagagttgggagccatcagtataaaggtggtaattgaagttgtgagagtgattgacaaagctcagaagtgtgagttgaataatctgactagtttacaatgaaccaaggaggcccatagagaatacacataacatggtgagagggcattgactaataagtagaatgggggagaaagcagcttgtctctccttcctgcccaggaaggtcacttacttttcttagaatggaatcatttctgttaagtgtcttaaaaggacaccagccctgtgattttggacactgggatcatactaatgataaactaagtcagggaagaggagctttaagccactggcttaggctgccatctattgctctgtttccttttacagctagagttgtctacatatgttatcacctcccattcattatccttcccacacaactggctcctgcctccatcaccaaaatttttcttaaattttccagtgattctttgtgaccaaactcaaggccctcttctctgaatttatcttagtctctcagtatagtcaaccattccctcttggcttgctaacatgttctttcttggtgctcctctgtcttcactggtctcgttccctcagtctgtcttgctagattcctcttccactgggattacttagagcagggctaggtctgtggttctcttttcttctcccatagatcagaatacctttattttattgataactcatatatatacatatatctggtccagatattatatattatctggtccagattttatatatatatatatatatatatatatatatatatatatatatggaccacactttttcagtgagtgccaaattgccatattgtggggaatataacttcctgatttctcagtgttcctgtaaaaagccctagtcccggagacacagaaatgtatgcaatataaatataggaaatacttgctttcacttccccagaaacattttcctcttcccacaccatgagaattagagctatagctatttttctagttaattactctgatctagagggagaatagaacctctcttatctcctgagatggccaaatgggttcacccaggactagcttcctaggttaaatcctaaagtaccaggaaaactggagtggtctttccctaggtatttatatatcacaaggggtaaagcccagaacttggagacatctttaggttgtaaaagccagcaacacctagagtttctctggcctttggaaagatgcatttaaattccaaaggttaggatggagagctttggaacgaggatcttttccattttatctcaaagcagcaaagttttttcttttcctttcaggaggaaaggatgatggctatccctctcatgtatctaaacagaaaaatccatcattctacatcccttatacatgagttgtagtctattttgaatagaaagattccattagctctcttagcattgcctttgggtttgtgtatgggagacagacgctgcaatattgctctggctgataagctggttgtgaatatcagtaaagaattattttccctgaccagataccttgtgttcctgcagcactcatatatataaggagataccaatgcaagtggagtaacatcttagaccctttacagttcttgacaaaacacacatctatacacagctgcatagatggctagcagaaacctctaaaggaacaggtcaataattgaactctaagagttatcccccaatatatttgcatcttccctcagcaatgggcattaccacttacttgttcaagccagaaattgaagagtgggccttgatttttctctttctcatctgtagctaataatatgtcaaatcctgtcaacaatacctgcaaaactgatcttgaattggcactcttctctgcatctccactgtcagatctgaatccaagccaccaagaactctcatggcatctgccccaaaatggctgccctgcctccattctttcccagctccaactcattctttacaccgtagcaaaattgagcttacattgtgtcacttcactgactaaatctcttcaatggcttcccattgcatttagaataaaattcaaccctccacagcttgacctacaagccctgcatgagctgtttccagcctccagcttcctcttgtactctcatcttacctcctgggaggctttttttcttatgtctcctttttggagttgaccagatacatctttttcttttctttcctaaaaagaaaggataatgttttatagttacaaacattgatctcccaatcttgtatgtcaatgatattcagcttttacttttggtcttcaaaccacattgctagaagttcattggtgaccttaggtgatggtacttcagggagtaataggggaagaaggactctaaaatgacagaggaaaaggagaaacgaagaaatagagacagggagtttaggtagctcatttctagaagtttggttgtgaaatgaaggagagagatatggaagtagttgaagtgagatgagaatcaagaaaaagcattttttaatgagctgtgatacatgtaatgcagattcttgtgtgagacatactgctttaatgaatacttgagagagaagggatcatggatactataagatgaggcagaaggattgtcttagaagagaaggagggaactcggagaggagggagacagatgtagttagggtttgtaggactagcagcacaaataaggggattctcatctgatatctccttatggtgcaggagggaaagtcactgattgagcaaaaagcaggaggtgagggggtcagaggtttgaaaaatagggcttgaggtttgaaaggattattgcaggaagtagcattgtcacacagtaaggagagatgatttgtgctggaaccatgaagaccagtgagtgcactctgccctgctgtggaactctctccagcactgctggctttcagatgcagtgtacaggaagtaggtaagtagggtcttccaagacttgccagagagttctaggaaaaggcagagaggaaaggcaggtttaagataatggcaatagattactgaaatgatgaatcttggactgtgagttagtgtcaatgttaaaaagctgggaagcaaagaaaagcagatgatggcttggaaggaggaaaggccagtggactggtgatccaaatgaggttgaaggacaacttcagaggaaacaacaaataaataagcacagaaaaatatatttttgattctttttcttttgttaggattgggctgggaaagagtgatcagaggttgaatgatagctataaaaggagaaaagctcaaggacaggtatcaaaaaaggaattctgaaattaactgttgggaaatcgagccaggtttgaatgacgatagggtctatagcttgcctttgggtatgggaggccaagaattggtggaggaaaaagtcatggaaaatgagaagatgaaggatttgaggggccagagtattggataacagagttgtctgttatccgtgtgtaccctgaaggcatctaggatgatgctgggacttgaaatgacagaaaagcagcttttgaaaggattattggggaaattattggatgatattgatgatgagtgagtgaacattttaattgaatggttaagactcaaaggagaggatcagggaggaaggggctggatggggccagtaggcagcaaaggacagacatctaacctgtctctcaccatgaggtgtgagtgatggatggcagagaatgcctagccatgtcttaagaggaagtgggttcctctctggggaaccaactttcagttaaagagggaagtgcaattaacactctaagaagttgtgaatataggagattgattttttcagaacaggcaattccaatggcatatttcaatacccccaaatgccttctggtttcctgataattttcataaaggcctttttggaagatgcagcaaatggaaactgcagaaacgaactgtgtgtggcatcaggactgtggtcacatagtggtgctcttgacaagatacagtcagaaaaacagaaagcaactctgaattcacccttctgacctctacagaagaaaggcttttcttacctttcttgtctgaaggtgtgctggacacctcctggggctcttctgggtcatttggttctggagaattatctcttatctctgacaaaagaaatataagtcatttcagagctcagatccagtgaagagaaagtgctgagggaagtcaatgcaagaactagaaaagtagaaagtacatgcagcccagggccgggaatctgcttgccctaagaattccctggctctgtcttgatttttgccaacttgtggttattgttacctgtgcgaccatcacagggaactagggcacaactgccccacagcagaggctcagtctgatccttttagagagattatcttatggatggaagagaagtgagtgaagaaggtgcaatgaatggaaattgcaggaataaactgtgctgggtatcatgactatagtcacatggtttctgctcccagcagcccctgctcaaggaatgaagctgagagcggaaagtggtgatattgaaatctgatgtccatgatgaaggggaatgtctttgctgtatgaaaaatacatcttattgctttgacgtctatgtgtggatattctttaactgctctatctgtggttattttacttggagaaatagtggagaaggctaaatgccttatatatttctgtatataaggattgtttgaagaaagcaggagctagcctgtgcttgctagcacctgttaacagcaaagacatataaagctctgctagtttttgctgcacaaagaaagacagagaacttgaagccataacaaataaaggctcatctcacatgaagctgtcacctttttctttacacactgcattgagattggtctcaaatgctggcctgcttaggaataggtgactgaggcaggtggcaagcagtcattagatctttggaataatttattacctttcaagttatattcataatatcaactcttaaactccaagtgatatagaaatgaccagggttgaaagtgaaaattccccacagtcaggtgggggcttggaaggaggaccatccatgtctgctgcagcaattcactattagggccacacagtgtttttgttcatttgctttgcattttgacagagccgttttgagcactactttattgaagtggcctcagaagagtggctctgtcaaacagtccagcctgactcagttcccttgctttcccctggggttcctgccacaaccctttgtggcaggtgaatgtttccctttcaggcgctttgtggcatttggagtccaaacctacaggcactggtggggctctgtccatcatcatccgtggccctatccaagtctaccttttccagacttgcctcctttgccctcccccagggactctgtatccattcagaggtcgggtctcctgcctgttcaagctcccaagtgctgggtgaactggaagctgggccaagattgctgagaggcaggaggagagccccctctctagaagatccgaatggcttttcctcttagtaaacacagaaacaaaggcaagcttttaggttgaccaaaccaagattacctggcatagagcccaagggagagtggggcatctcttgagggtcttctttatctcttatttgggggatcaggttgtcactggccactgaatggaggaagaaaaagttttagatctcaggaacagcaagcagggaccagaatgaggagaaaagagaatgctctattccaacaagtaaaaatgacggggtaacagcaaccaaggcctgggaaaggatggcatagagtgggaaagtaagcaaccattcactctcaattagccacttgttcttccattgctgttagcttcctgattatgttaacctttttggatggtaggtattagaggagtggatgcaatattatttggatcgaagaggacccctcttctcagtactggagagctcagaatccatggtatcatttttgacaatgcccaatatcataccattcttacgtttaatgtaatcaaactccattatgatgatggtttggggaggacaagtgatacaatttgagaagctaaatattaggtctagcagacctttaaacattttatcatcttttctagtaattttgataacattgttcttagaatccaaaccatataaaaatgaagaatgttgaaactctaaggcccccataatcaggtgggggtgaggaatcagctaagggtcactagtgtgagtgttacgcaggttacttgtcaattcagaatggtgttttggttgttggtttgttttgcattgctgcgttggtgaattggccccttctgtttcttttcctttgtattgctcagttctttttcccagggttcccaccatagcctcttggttggcagacgcatgttctcccttcacagtcaccttgagctaagcggtatcagccccagtcagtgttaccttgcacagtgctagtgaggaggctgggcatctcttctgagtcttcttccgcattcattttggatgttaacttgtcattggtcactgaaggaggaaaggaaattattacagattgcagggactggatgtcagggagaagagtgaatgttaaaagtgcctggggcagatagagcatcaaggcacaagggcagagggttggaatgtcccgggagtgggaagcaggtgttctggactctaggtcttacccaccccccggcagtgctcataatccctcttgaaaagggttgtgtttgggtagatgggtgcaagagaagaactaggacaataaaagtcaagatgctgggattggcggcaacatggcacaggcaccttaggctgaggatatacaggtgttggatgggatctgtttctcacctgaagtgcttcttccttcctggatgagtgcagggagaggcaggacagggtcagatgggctgggcgactcactcaggatctcatcgctttgctgggaggatgttccaggctcactgactcttggcgcacagggtgaacagcttggttgagggggttgtggtgggggcagcgccagtggggtatggagggagcttccttctgctaggccagttggggcttcaagtaggattggtgtgtctctgctctgccattcataggaagcaccaactgggattggtgaagggacacacatcagtaccctggagactcagaattacttggggaaggggatttcttaatacatgccttccaataggatgggggcatggagctattcattgtcccccaggtgcagagaactgattcattgtcatcattatccatttgtggccccttaatattttatttatctggtttgggcattgagtgctacaataagtgcatctaagccctgatctaataccaaaatggtttcacacataaaagttgagtttgggtttgtacccaggggtttaacttttctttaatcttggtgtcatataatttagtcaataatgaacatgctatagttttaaaagaggtctctgttttaataaataaacagatcatacttccccgaagcaaataagagaaaataaaaattccttagcagggtgtattaggacatttatattctggtttctgctcatttctgcagagtcagcttctgtgccttctattgtaccctgtgatctggtcacacccagctttctctcccatccacaataccccagacccttggctttctgcatgctattcccttgcatggctagtgctgggtttctcttaagattcttctccatcatttatttcagaagtaaatggtctcaaccagtgaatggaaaaaggaaagtaacttcaaattttggaaagggattcagaacaaaatcatcaggttgaagatcccggaagatgactgaagctcagccaggtcaggggcacatcagtgtgtgggtccccatggttctcagatgttcttaccatagcctttaaggccatgcctctcctagtattgcccagatgctgccaggacagtgggccctctgtagctgcccctacctggaggtggacttgcccctttcactgtccatgtagctcaagaaatcatctctcccttcagggggaagccttttgatggtgaagtgtcagagagcaaaggaggaactgtcaacaatggtgattccactaatgaaaatatccaatgtgagctggtggtcctttgcttgttgttctgaggtaagtgaacatgtgatttggccacagtgttttacttccaacctaaaatgactttactgcctctctctttccctggctgatttcttcccaactctgccactgttctttttcctactcctttatttatccagtctcttttctttctctacgtacttcatgatccattctttctcagaccctctctttctgtggctatgtttgcgattcactccctttctctgtagctaccttttttcccttctctggctttacaatctgccttccagctgtccttgtccggactagtggttaaaatcttgggccctggtattgggagacccaagtaggactcttgctctgcttcttaaccaacaagtaattttgggaagattacctctgggctttaatttctctgtcagtcaaatggggttaaaaatgacttcaaagggttgttttaaagatgatgtgagataatcaaataaagtgtttgcgataaggcaccaaaaaaagatacttattattatccgtccacattcattttttcttcctccctggctctccttgtccttccaccagacctgatctttgtaactttgcatttctgtcaccttatgcattccctatagattttccagtatgccaaattgtatgatttttttccaaattcatagaacacataagaaatgtttatgtcctctagaagttcatcttagagagttgggatcagctttagcaaggggctgctcctgcagctgtaccaatgagagaatatggtccattccaccccagagagaaggcgggggattaacgtgcatattccacagggctagaagtaaacccagacttttaccatagcaactttttaaatgcaaaaagcacttgagaaatctcattaccacgtttgaagcttctgtaaatcgtcaccagattgggatattcacgcaggttaatttgactgaacaatgtcaccagaagagacaggttaaaagtcctctccagttgggtgagaatgttgtgcaccactctggatacagggatcaaatttctacaggcttccagagattcctataaaaatggagtgaaggtttttataaatgactataaaattgaatgggaagttatacatttatggttttctaagttttaagaaagctaccttactcttttaagaagaaattcaacataaaatatatagtcacattctctaaggtagagcggtcacagttttacatgcttatttttgaaactttacacatatttggatgactagcaacaaaaataaataatttagctttcttaaagtaagtctatattctgaatccaactttcaggcacatttgagacgagagaaatttgaaggaaggaaagtggggttaaaggatgctactatgtaattgattctttaaagctgtgggcaggatacttcagcaatggttctagtgatggtcacagaggcaattctgctggttgcttgtgagcctctgctcagtctctctctgtgtctctcaaacttgagataagcctgaatggattccagccacagagaagtcaccctgagaattttccttgcctagaggatggacaaaaggagaaatacggcaagagagaactgattgcaaataattattgaacatctactaggctcggtcagcgagtctttgggtacacagcactgaataagaccaacatggagttgcctatatttgggggtcagggtaggcactgtcaagtggagaagatgagcattaataaacacaaataaatacccatttacaattgagagtagtgttacggagggaaagcatagattgctatggaactgaataactaaggggtcttcatgagatgagttggccaaggagatgtctctgaggagtgctctctgggctgtgatctgaagagggagttggggccaaccagactaagactaagggaagattattggcacttccttgagtctagggctcaattaatgcttttaaaaaccaaaattatataaaaataggtccacttttgtccacatagcatatctcccagtgcctgcctgtctcacatcagaatgcactgtgagcaatattagctgttataaattgggatgatgcctgtagtgagttgaatgttggatggatatatctcagccaagatatatccatctagaatctgtgaatgtgaacttatttggaaaaagtgtctttgcagttgtaattaagttaaggatcttgagataaaatcatctttgattagggtgaccctaaatccaagtgtcctcagaagattaggtagaagactcaaaagagaggtgatgtagagatgaaaacatatcagagtgatgcatctacaaggcaaggaacactaaggatttccaacagctaccagaagctaggagataggcagctatcggattctcctcagggcctctagaaggaaccaaccctgtcaacaccttgattttggacttctggcctccacacctgagagaatatatttctgttgttttaagctacctggtttgtagtcattgttacagcagtccttatgacaccctagaaaccaacatagcccctatgacaccctctctcctaactacccccaccttctgtgataatgaacatgcctgggctgggccttccaaactctggaagccctggtggtttgtggtttgagactttaataatcaggcatattggtgggggctgggctgccatggaagggttcaacatgactcaccatgtacattctcttagtgatgatggagttgtctaggaggccttcaaagaagggaaatggcttgtgtatggcataggcgatccccagcttctggtgcatgaagtgctgaaaaagagcctcttccatggctcttgtcatggtgaacatcctatggaaagaggcatgataaaaaatagaagcaaaggctgggcgcggtggctcatgcctgtaatcccggcactttgggaggccgaggtgggtggatcacctgaggtcaagagattgagaccatcctggccaacatggtgaaactctgtctctactaaaaatacaaaaattagctgggtgtggtggcgcacgcctgtagtcccagctacttgggaggctgaggcgggaaaattgcttgaaccggggaggtggaggttgcagtaagccaagattgtgccactgcactccagcctgggtgacagagtgagactccatctcaaaaaaaaaaaaaaaaaaaatagaagcaaaaccttgaggaatgtgggaagcttctctctgcattaaatgggcagatctaaaggtaagcattctggtcccaaaggcatccttagtagcctgcaaagcaatgtctgcctaaaaggctcatgggtataggaaacaaggacaattcccagcaacaatggaggctgagagtgactgaaaatataatgacagaatcccaaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatggccacactgatctgggttaaacaagatgacctgggctacggctgaagccattaactagcaatgctcatgcaacagggaccaccctaaaatgggtagagttcagctggaaacctggtaatatttggaaactttaacgaaccactcccaatcttcaacacaaatgggccaagcataaataaaagcatgagggctgagaaaggcatacttagtaaaagtgacttaactgacttgttcactgcaaccatttcatgtctcagacatgcgccttttcccatgcccatgcagcatgtattaaagattggccatttatggactgtgaggagatatcaataggttataatgggaagaaagtttacaaatgacattcttgacaaattgtcaagaaaaggaaaagcactaacaaaacattcaatcaacttgacagtttttaacaaacagaacaaacatggattccacttttccaacttcattttgtgttgaacagaaaagtaaatcgtaattaacaactgtttacagggatttaatcccagtggcagattaagcaccctagtctctttctcctcattccccaatttttttaacttggcagaaaaaaatactcatgaaaagaataatccgcaatcgcataggaaaacaagaaaagatgccattgagagtctgtggtggtaaagaagtcttggaagatagagaacagataggagagaaatctactatccacaatatgcacaggggaaggagatagtgcaaagatcagtgcaaagtcagagaaaggcagagtaaacatatactaagaagaggaaggggtcttggaggctccttttagaacaattcattatacagcagcgctcagaacaggaagtctagagcttcctcattcttcatctgtcatgagtcccaaagatgaaagggaggcacagagaggtttagtaactcacccaaggtattcagtggcaaagcagagcttgtctgactctaaagccctgtttctttctatgcaagatactacatctcatatatgactgttcagatttttattatgtaaagagattttgcaaacgaataagcaaaagacaaacatccaactagaaaataaaaaagcaaaatacatgaacagagagtgataaaagaataagccaaatgtgcaatgaataatacgataagcatgttaactagctagtagaaagcataaagaaggccaggcatggtggctcatgcctgtaatcccagcactttgggaggttgaggtgggcggatcagctgaggtcaggagttcgagaccagcctggccaacatggtgaaaccctgtctctactaaaaatacaaaaattagctgggcgtggtggtgcacatctgtagtcccagttactcaggaggctgaggcaggagaatcgcttgaacctgggaggtggaggttgcagtgatctgagatggtgccattgcactccagcctgggtgacagagcgagactccgtctcagaaaacaacaacaacaaacaaccaaaaaaagtgtaaatgaagacaatttgataacatatttgtctatcaaattggccaagatagaaaataatagtaataatctcagacactgtgagtgggaaggtcaacaggtccaaatgttctgaaggctgatttagtaatcagtgtcaaatgtcctaaaacatgtgctcctttgaatttccacttctaataatttatttcaaggaaataatcatgtatttagagaaaatatataaaaagttcatgatacactagagacgaaattaaatgtactctcatttttttcttttccaccagcttcccaagtacctctagtcatttacacaatggataacagatgagccgcctattgcgggcactgaaggatcagagcttaggtgagggtagagggcaaatctcggctccattcacaataacaggctggactctggcgaaaaaaagaggtgtcagtgttccctccatgtgcccccttttaacagtctcctaataagtaccacatgtctgagctctgagagagcctcagagtttaaatagttgaactccaccctgcagctgctgccgcgaagttaactctaagagctgcagtcaccaagagcgaagaataaagcagcaaagacagaaactcacctggactttgagtttgtcgttcctgcccctttccaggggctgggacagggatcactcctcaagattgggagagttacagggagatgctagcaggcaaaacaggaagtctgtgctttgacaaacgcagtaaggggccgggcttccgagaaaagaaaagtgaaagttttcggagtttgccaagccggaagctgaaggcaggtcggtgcctgcagcctctctccacctcctcatgggcactt

SEQ ID NO: 2036 - DNA, 13347 bp, Homo sapiens
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtgggtcatcgtctcctttcccgtctgtccttcatctctggtagggttccctttcatacttgttatttaatgtctacccagcttcactctacaggtatacaatagaattcagttacaaataaataacgaggcaatcagattttttaaattgcagggattggctgttggagaaactcaaggatgccgtgactcacatcatcttcctattctcttacatctgcaaatggctggactggagctgtttgaacatcatgcctgttctgaggctttgtgtaggattggatgattccccgtgacctctgaaccctctcttctcccccaggcctcctttatccccactccaaaagacaactctgtctaaaaaggatctttttagaagaattaaaatccaaacgcctgtctgttgtcacactttccaggctgtgtagttggggaccggttctgctctgagcccatctatgtggctcttagccctagaatcacttcaggatctctgaatacttggtaggaggaagtgaaagcagatgagacccaacaaaaaaggcaagcaggtagagagtgagtgctgcttctgctttttttattcttctgttctggtattttttacatatctggtcagagaagcctggaaatcatctttaaaaaatgtaagacaatgagaccagtctgaccaacgtggagaaaccctgtctttactaaaaatacaaaattagctgggtgtcatggtgtatgcctgtaattccagctactcaggaggctgaggcaggataatcgcttgaaccagggaggcagaggttttggcgagccaagatcacaccattacactttagcctgggcaacaagagtgaaattccatctcaaaaaaaaaaaaaaaaaaagacaagtacatcaatacggtcatttcttcttatctgtggattctgtatccatggatctaaccaaccatgaatgcaaaatattttctaaaaattaaaaacataaataacaacaataaaaagtaatataaaaatttaaaatacagtataactatttgtatagcatttacattgtattaggtattataagtctagagatgatttaaaatatacaggaggatgtgcataggttatatgtaaatactacaccttttatatcagggacttgagcatccatggattttggtatccatggagggtcctggaaccaattccccctggataccaagggatgactgtacattcttgataaaaatgaaaatgtgtggaatgtaaaaatgtatggaaacttgtctaattgggactctgtgctaaggctacttctggcgctggtacagccccaagaaagcaaaagctattgctattatcagcagtagtggtggcaccagactggttttcagtgcccagtgccaccactcccagacaggcatccctgtcatctctctttcacttgctctctagtgaagggaagatgagccagcggagctcaaagtccagccagcccatggtcaccaagcaggaagaagacggcactgagaggtgacaatgggctaatgctaacctcaaagaatgagttaggaagtgttgcctctgctcttatttttggaggaaattggggaggatgatgtcatttcttccttaaatatctggtaggattagctagtgataccatctgggcctagtactttcctttctggagggctattaattatcgattcaaatttctttaatagatgtaggcctattcagacaacctatctcttgtgcaagttttggttagtttgcctcttaaagaatttgttcatttcatctgtgaccaaatttgtaggtgtagagtccatagttttcctttattacctttccattgtccatggaattcgtagtgatgacccttctttcattctgatgatttccgtcttctctatttttttctttgttaggctggctagaggtttattaattaactctttgaaaagaaaatcagcttttggtttcattaagtttctcgaatgttttcctgtttcaatttttttaacttccactttaattttaattttttttcctgcttgcatcaggcttaaattgctccttttttctctagtttcctcagatgaaagcttagattattgacttagatctttcttcttttctattgtatgcatttaatactatacatttccttctaagtgctgcttttgttgcatcccattcattttaataagttgttttccttttcatttacttcaaaatatttttaaaattcttttaggacttcttatttgaccctagaactcttttggttaatctggaaatattttggaattttccagctatttttctgttactgatttctagtttatggtctgagaacaaacttttaggatttctattcttttaaatttgttaaggtatgttttatggcccaaaatgaagtacatcttggcaaatattctatgtgagcttaaaaagtacatgcattctgctattgttaaatggagtaccgtataagtgtcagttagaccaagctgattgctattgctcatcaggtcaactacacccttactgatttttctgcctgtgtgatatgtcaattaataaaaaagaagtgttgaagccttcaataatagtagtgaatttgtctatttctctttatagttctatcagtttttgcctcatacattttgccattagtttgttagttgcatacacattaaggattgtgtaccttcttggagaattgacccttttatcataatgtaatgtccctctttaatccctgacaattttccttgttctgaagcttctttgtctgaaattgatatagctactataccttttctttgattagtgttggcatggtatatcttgctccatccctttatgtttaacctatctgtatttttatatttacaatgactttcttatagacaacatatagtcgggtgttttgtgttttttatgtactctgttgatctcttgtcttttaattggtgttttagaccattggcattaaagtgattattaatatagttagattaatatctaccacatttgtaaatgtttcattgtacctatcgtttttatcttttcttccttttttcctgccttttctggtttaattgagcattttatgcttctattttctctcccttcttagcatatcaattatacttcctttaaaacatttttagtggttccctgaagtttgtaatatatatttacagcgaatcatgcccattttaaattacactatatcacttcatgagtagagaatacaccatgcaactgaatgtcccaaattctgccctcctgttctttttaacattgtgaaatgactgacaatgttaaaaagaacaggagggcttccagtcattccatttatttatgtcccataaccactcaatatgttgttgattctattaatttgaataaatggcttcattttaggttaacttggagtaggaaaaatgaaaacattttattatatctgcatttatttcttctctggtgctctttctttctctatgtaaatctgagtttctggcccacatcatttttccctttgcatgaagaaattctttttttttttttttttttttttttttttgagatggagtctcactctgttgcccaggctggagtacagtggtgcaatctcggctctctgcacactccgcctcctgggttcacgccattctcctgcctcagcctcctgagtagctgggactacaggcgcccaccaccacgcctggctaattttttgtatttttagtagagacgggatttcaccatgttagccaggatggtcaagaaattcttttaacattttcacatggagtaggctttctggcaaagaatttcctcagtttttgtttgtttgagaaaatctttatttctactttacttggaaggttaatttcacaggatatggaagcctacataggctttttttttctttcatcactttaaatatttctttccactttctttgcttgcatggtttttaatgagaaatctgatgtaattttatccttgttctttcacaggtaggggttttttgttttttttccctaccccctggcttttttcaatattttctctgtctttcgtattctgcagtttgaatataaaattgtaattgccaaactagactcttcttgtccattgcccagaaaagccacacattgagaatagtaggagttgcaggagagagagaatttaataatcgcagggccagccaagcgggagatgtttctgaaatccatctccccaagaattcagagactaggctttttaaaggatagttaggcagacagggggctggggaacagggaagtgctgattgcttaggttgggaatgaaatcacagggggttgaagctgtgttcttgtgctgagtcatttcctgggtaggggtcacaggacctggttaccaatcctgtggtattagctgttccattagaatgcaaggtctgaaaaatacctcaaaccccagtcttaggttttacaatactgaagttatctataggagcaattgcggtggttatggatcatgtgacctccagctacatgactcctgaaccataattctaatcttgtatccaatttgttagttttacaaaagtggttttggtcccagagcaaggagggggtaagttttgggaagggattgttataatctttgttttaaagttaaactataaactaaattcttctcattgttagcttggcatacacccaggaatgagcaaggacagcttgtgaggttagaagcaagatggagtcagttaatttagattcctctcactgtcatgatttttgcaaaggtggtttcaatatgtctaagtctagatcatttgatatttatgcagcttggtgtttgatgagtttcctgaatctgtggtttgttgtctgtcattacttttggaaaattcttggctatcactacttgaatatttcttctgctctattttctctttcttctccttctcgtattccaattacatatttgtcacactttctgaaattattccagcattcttggatattgtgttctgttttgttttttcctttttttttcctctttgcatttctatttgagaagtttcttttgacatatcttcaattcactgattctttccttggccatgtccaggctactgatgaactcatcaaaggtattcttcatttctgttacattgtttttcatttctagcatttcatttttcattatgtctttgagttgtcatctttctgctcacttaaccatctgttcatgcgtattgtgtgcttttttctttagagcccttaacatattaactaaccatagttattttaaatttctgtctaaaaacttgaaaatccatcatatctgagtctggttttgatgattactttgtctcttcacactgtgttacttcttgccttttggcatgtcttataattttttttttaagtcagacatgataagtcaggtaataggaactgaggcaaataagccttcaatgtgaggttttatattaatctgggtaggaaatgggccatatctaatgtttgttctagctgtaggtggcagaggtgtcaaattcctctagcgttcttgtttttctttcccctgctttctctgggtttctctgagaactcctttttaaatagtctgtttcttgtagttcttccagctgtaatctgctcttattatacaggaaccctgttgatggaatggtaacgtgtcagagggggaagtggtctataatcttatgattacatctcgatcttttaatggaactgcaccttgggctattacttttaaaagaatttctccctccacccttttttttcaatttttttgagatggagtcttgctttgttgcccaggctatagtgcagtggcgtggtctcggctcactgcaacttctgcctcctaggttcaagtgattctcctgcctctgcctcctgagtagcagagattacaggtgcctgccaccatgcccagctaattttcttttgtgtttttagtagagacggggtttcaccatgttggccaggctggtctcaaactcctggctttgtgatccacccgtctcagtctcccaaaatgctgggattacaggtgtgagccaccgtgcccagcctcacctccaccctttttagaagtgacaagatggccagaaggggctagattttggtagtcacccttcccctagaatggttaaagcattttccctggagagcaggcccttgtcatggagaatgctttggctttttaaaaacttttcttttccctcttcttgccagaaggataaagagatttttcttggggtttgtggaggtaaaatccataaaaggttgggggcctgccctgagatgatgacccccaggagtttctcatgctcatgctcctccacactcagcctccagcaattcatcaaacataccaggctatgacttcagtgcctgctgcctcagatagttgatctcggctaattctctggatttgcctgtatctccagattttggggcagtttgccttgtgactttggttatttgagagatagaagaaaagttgttaattcatagtttgttcagcagggttgttgttgttgttgtgaggatgggagcgatgacttccaatgtctttgcgtgttgaagctgaaaccagaggtctagtgaacttttacatttttgaagtttagacttttttcttaagacaaactttctttttgttttaaattttggttttattatagtattatcttatagccagagcatgtaacctgttcaatttctcttcattattatttattgaaattacttcagggccaaatacctggtatgatcttgtgtgtttaacacagtgttattaaaaatcaattttgccagtttttaaaacttacattttgtgtatctttgttcttttatttttatctacttgagaagctaaggactggaagtaagatgttttttaacagccttgaaagatttccccattagtaatctttaatcttactttttaaatgtgagtattgagaattttaccttctttctcatttgtatttgcttaatgaaacttatccatcttttgactgttaacatttttaatgttattttatctctgttatgtctcttgtagttagattctattttgaccatttataatttaagatggtagcttaatctgttttaaatatcttgttgcttatggattttttatttttatattttatgcctctttattttctataagaaaaagagcatgtttttctttctcattattttgtaaagtttgtagcctcattttgactctatttgttacacttgggtttctaattaattctttaatgtatatttctctaactgagaccatcaaatttataactatatcatttgaatttgtatttgaaataagttacttaactcaattttttacttgtcctcactcaatttaaaaaactttaccaagatatcgcaccactgcactccagcctgggtgacagagcgagattccgtctcaaaacaaaacaaaaaaaacattaaaatagaatctaaagtttaagattgaaattactataattttattatatgcagtatatatcctctctttttagaacagtgcttctcaagtatttgggttcaggatatttttatatttttaaaaattatcgagaaccccaaagaactggcttttgtttattgggttatatctgttgctatttacgatattagaaattaaaactttgaacacttaaaatatgtatttattcatttagaaataatagtagtgaatttattacccgtgaatatgtgatgtgtttttatgaaaaataataaaacttttcaaaatagaaataaattagccagaggattagcattgctttacatttttatacgtcttttaaatataagtagaaggcagctagaccctcctatctgcttctgcattcaatccgttgtgacatcacaggccatttagcctctgaaaaatttcattgtatattcatgagagaatgagaaagataaagggaaaataatatgttattatgtgaagagttttacttggtgacacctgaaagggtcttgcacaatcctagggggtccctaaccccactttgagaattactgttctaagataatttatacatttgagacatcagtattgtaactggttttaatgatgcttccagttcctctacaataaggctttactgatactgatttcttgattctgttaatgtagtacatcatcaaataattcgtcctacacagtgtcagtaaaaatggagtagggtgatctataggaacaaacaattcccaaatctcaacgggtcaccagccctctgcacagaggaccctcatcctggactctgtctctggctgaggagcagccaccccatctgaaatgacagtcactgtggtagaggaacagagagcatgcctaaccaggtgctgcctctgagctcttctgccagagtgatacccattgctccaagggaggtacaatcttaccttggcccagaagaaaagaacattgaaaaatgtgtgaccaacacagaaggtgcatgagcaaaatattctttgagtccttgtctatctaagtattgattctgccctcatacgtgaatcattgaataaggtatacatttttccattttaatttttttggacccattctcaagaactgaatgggtatacactttttttagtagtttcctcttacctctaggtttataggtttgcatcattgctttagacatttagggtttcaaattcacttatttttccctttagggcttttccccatatgttctgggaaattctccctcctttatcttataaaaattttcattcactttttaaaaatttcacaatcattttgaatttccaaggtcgttttattttctggttgtttcttttctgcatggaatttttggtacaatatattctctttctgtgtgataatatttgttgtttagaaattcttttttgttccctgaaacatctgtatttccgctagggtaattttttgccttttgcttatcttggttttactccttaatgttgtaggtttccacaaatgctgtggtctgttgtagtctgttcatgcttaccagcaagatgctgaaaagtaaacttgaaactccatttaatgagatgggcttgcaaacttgtgggcttcactgagcaaataccaaatccctgaaggtaaaggccttttctctgagtcatttatatttttcttaagaggaaacctccagtcttctgcctgattgtgggtgttctgtgtcgtagagcaaactgtttttaattttgcctttggaacaatctctcgattttcatctctgcatctccttctcaaccaccactgcatctctgggaggctgcaggacacgctggatccttttctgacctcaggaagcatcctccaccttcaatagcaatgagtacccctcagaccactttttctctttcatacttaggttaaaatttctcatctaattcctttctcttcatcattgtaactttaattcctttactgtcattttaggagatattctagtgaaagaggagaaaaacagttgtcattaatcaacgattttaaaccagaaggctttttcttttttaaaagaattcaatggataaatggtgcatgtctggagaatgggaaattttagtgatcctctattctatcctgatgcatgtttaaggaatggaaagtcccaatgaccatttcctggtgggataaaaaaaatcctggaagtcttcataccgtttagaaatacagataaatttgttaaggcctattagcaaggggaacaatttagcaagtaggaatcagaactacaaacttttgtgattaaaaattagtttcccaggcacagccttaatgtctgaaatccagaggtctccaagtttagacagattaatgtgtcctagttttgcatatccacacaaatctccatgttggaccagagaaagagtgattttcttgtgactgtttttttttttttttttttttttttgagatggagtcttgcctctgtcactcaggctggagtgcagtggcacgatctcagctcactgcaagctccgcctcctgggttcacgccattctcctgtctcagcctctcgagtagctgggactacaggcacctgccaccatgcccggctaattttttgtatttttagtagagacaggtttcaccatgttagccaggatggtctcgatctcctgaccttgtgatccgcctgtctcggcctcccaaagtgctgggattacaggcgtgagccaccgcgcccggccttcttgtgtattcttaatcaaaccttaccagatgagagtctttgaaccaattttatgatgcagaatgccaccctccttttgcagttacagatggaggagatacatctcctttacatctcctgagatttcctctctttgttgttaactaagaagacttgcagttcagtgttaggttctgtaatatctcagccagatttttatttctttctctgtaagttaaagttctccagagaaacagaaccaataggatgtgtatatacagagaaagagatttgttataaggaattggctcttgcaattatgaaggctggcaagtccaaaatctgtagtgtgggcctgctgtttggagacccaggagagctgatggtgcagctccagtctgaatgcagtctactagaggattctttctttcttggggacactagtcttttggttctattcaggctttcaattggttgggcaagccccacccacattatggaaggcaatctgccctactccaaattcaccaatgtaaatgttaatcttatccaaaaacaccctcaaagttggcatataaaattaattaccacagtatcatgtcaattcctataaagattttgacatcttttaattgcatattttccctagagagttcaggtgaaggtctctttataatagtttgattggaacagggtgagcctttttacttctatgtacaggtctttcttaagttcactgttttcatcttttccaccttgatttttcccaaaataaataaattccattcattctggtctccctacaagaatgcttattttatacatgttggctctccattggccatccttcatgtctaaaatcttctaaccaccacaaacctcttggaaactcagtgtctacttccacgttgtatctttgtttcttaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaagtaagtaagaatttccaaatgatgataaaccaggtccatactcaattatgccaaacttcaagatgcaatgagcaggctaaagggcctcctgtgagtggggaccttcaccattctgtaggttaggaggtgacaggagaagcaggcatcacagaaaacctcccttcttctgtagtaaatgttgggggagggccacagtgagggaggtggggcaggagagagaatgggaatgctgtatgggtgcagatcatcctaggtacttgtaaacaatctactaatggtagccataattaaaataaataagtgacctaggcagcattttattccaaagcctacttatttgaaacacttgaaactgagatttttttgaaactcacagtgaagttgtgtcattttaggttacatttggaagtggatgcttgctactgtctctccaaatcattgtttgatctttggacatttctagagccctagaatgcaagttaatgttagcagtggatgcccttagggatactgaggacaaggcttcttcttgtctttgtgaattttctgtgccctttggccaggagtcatagtgggggctggttgattggtttcctggagctcgtcaggccaggccaatcctagtagtggttattgtccatgcaacagaacagccttgttaaggccactcctgaaataacctggccaggctctaaagccatacacaacattcaactttgaacccacacttattatttaaaattactctctccccttaagtgtacaacaatgtcagagagtcaggttcaaaaaattagagtgtatttttatggtggaggacatttaagaagtcatccaaatatacgcaaaattctaacatttcacaagagaacagatgttctatctacaacctaaaagtcttttgtaacccataaatctctagctacataattctccatttaatatttttaagcattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatggtaactatagctctcaacagctttgggggattcaagcccatttcattcattgattcattcattcactcttcattcatatttgacaaatatttgactgagtgactattacatgccaagcccagggggaatataatgatgaaaaaacacacatgtcccatgtccttatggagtttacatacagtgggagtgacagacgttaaccaagtaatcctgcaaatggttgctcagccaggacttgattttgatgctgtaaaacatagggttgaagtctctatttttttgaaggaatacatgagtgatgtcttttcatgggaaaggaggaagccttctctgatatttgcagatatgttcaaagataaaacaattttctttgtattagaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaa

SEQ ID NO: 2037 - DNA, 87486 bp, Homo sapiens
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtgggtcatcgtctcctttcccgtctgtccttcatctctggtagggttccctttcatacttgttatttaatgtctacccagcttcactctacaggtatacaatagaattcagttacaaataaataacgaggcaatcagattttttaaattgcagggattggctgttggagaaactcaaggatgccgtgactcacatcatcttcctattctcttacatctgcaaatggctggactggagctgtttgaacatcatgcctgttctgaggctttgtgtaggattggatgattccccgtgacctctgaaccctctcttctcccccaggcctcctttatccccactccaaaagacaactctgtctaaaaaggatctttttagaagaattaaaatccaaacgcctgtctgttgtcacactttccaggctgtgtagttggggaccggttctgctctgagcccatctatgtggctcttagccctagaatcacttcaggatctctgaatacttggtaggaggaagtgaaagcagatgagacccaacaaaaaaggcaagcaggtagagagtgagtgctgcttctgctttttttattcttctgttctggtattttttacatatctggtcagagaagcctggaaatcatctttaaaaaatgtaagacaatgagaccagtctgaccaacgtggagaaaccctgtctttactaaaaatacaaaattagctgggtgtcatggtgtatgcctgtaattccagctactcaggaggctgaggcaggataatcgcttgaaccagggaggcagaggttttggcgagccaagatcacaccattacactttagcctgggcaacaagagtgaaattccatctcaaaaaaaaaaaaaaaaaaagacaagtacatcaatacggtcatttcttcttatctgtggattctgtatccatggatctaaccaaccatgaatgcaaaatattttctaaaaattaaaaacataaataacaacaataaaaagtaatataaaaatttaaaatacagtataactatttgtatagcatttacattgtattaggtattataagtctagagatgatttaaaatatacaggaggatgtgcataggttatatgtaaatactacaccttttatatcagggacttgagcatccatggattttggtatccatggagggtcctggaaccaattccccctggataccaagggatgactgtacattcttgataaaaatgaaaatgtgtggaatgtaaaaatgtatggaaacttgtctaattgggactctgtgctaaggctacttctggcgctggtacagccccaagaaagcaaaagctattgctattatcagcagtagtggtggcaccagactggttttcagtgcccagtgccaccactcccagacaggcatccctgtcatctctctttcacttgctctctagtgaagggaagatgagccagcggagctcaaagtccagccagcccatggtcaccaagcaggaagaagacggcactgagaggtgacaatgggctaatgctaacctcaaagaatgagttaggaagtgttgcctctgctcttatttttggaggaaattggggaggatgatgtcatttcttccttaaatatctggtaggattagctagtgataccatctgggcctagtactttcctttctggagggctattaattatcgattcaaatttctttaatagatgtaggcctattcagacaacctatctcttgtgcaagttttggttagtttgcctcttaaagaatttgttcatttcatctgtgaccaaatttgtaggtgtagagtccatagttttcctttattacctttccattgtccatggaattcgtagtgatgacccttctttcattctgatgatttccgtcttctctatttttttctttgttaggctggctagaggtttattaattaactctttgaaaagaaaatcagcttttggtttcattaagtttctcgaatgttttcctgtttcaatttttttaacttccactttaattttaattttttttcctgcttgcatcaggcttaaattgctccttttttctctagtttcctcagatgaaagcttagattattgacttagatctttcttcttttctattgtatgcatttaatactatacatttccttctaagtgctgcttttgttgcatcccattcattttaataagttgttttccttttcatttacttcaaaatatttttaaaattcttttaggacttcttatttgaccctagaactcttttggttaatctggaaatattttggaattttccagctatttttctgttactgatttctagtttatggtctgagaacaaacttttaggatttctattcttttaaatttgttaaggtatgttttatggcccaaaatgaagtacatcttggcaaatattctatgtgagcttaaaaagtacatgcattctgctattgttaaatggagtaccgtataagtgtcagttagaccaagctgattgctattgctcatcaggtcaactacacccttactgatttttctgcctgtgtgatatgtcaattaataaaaaagaagtgttgaagccttcaataatagtagtgaatttgtctatttctctttatagttctatcagtttttgcctcatacattttgccattagtttgttagttgcatacacattaaggattgtgtaccttcttggagaattgacccttttatcataatgtaatgtccctctttaatccctgacaattttccttgttctgaagcttctttgtctgaaattgatatagctactataccttttctttgattagtgttggcatggtatatcttgctccatccctttatgtttaacctatctgtatttttatatttacaatgactttcttatagacaacatatagtcgggtgttttgtgttttttatgtactctgttgatctcttgtcttttaattggtgttttagaccattggcattaaagtgattattaatatagttagattaatatctaccacatttgtaaatgtttcattgtacctatcgtttttatcttttcttccttttttcctgccttttctggtttaattgagcattttatgcttctattttctctcccttcttagcatatcaattatacttcctttaaaacatttttagtggttccctgaagtttgtaatatatatttacagcgaatcatgcccattttaaattacactatatcacttcatgagtagagaatacaccatgcaactgaatgtcccaaattctgccctcctgttctttttaacattgtgaaatgactgacaatgttaaaaagaacaggagggcttccagtcattccatttatttatgtcccataaccactcaatatgttgttgattctattaatttgaataaatggcttcattttaggttaacttggagtaggaaaaatgaaaacattttattatatctgcatttatttcttctctggtgctctttctttctctatgtaaatctgagtttctggcccacatcatttttccctttgcatgaagaaattctttttttttttttttttttttttttttttgagatggagtctcactctgttgcccaggctggagtacagtggtgcaatctcggctctctgcacactccgcctcctgggttcacgccattctcctgcctcagcctcctgagtagctgggactacaggcgcccaccaccacgcctggctaattttttgtatttttagtagagacgggatttcaccatgttagccaggatggtcaagaaattcttttaacattttcacatggagtaggctttctggcaaagaatttcctcagtttttgtttgtttgagaaaatctttatttctactttacttggaaggttaatttcacaggatatggaagcctacataggctttttttttctttcatcactttaaatatttctttccactttctttgcttgcatggtttttaatgagaaatctgatgtaattttatccttgttctttcacaggtaggggttttttgttttttttccctaccccctggcttttttcaatattttctctgtctttcgtattctgcagtttgaatataaaattgtaattgccaaactagactcttcttgtccattgcccagaaaagccacacattgagaatagtaggagttgcaggagagagagaatttaataatcgcagggccagccaagcgggagatgtttctgaaatccatctccccaagaattcagagactaggctttttaaaggatagttaggcagacagggggctggggaacagggaagtgctgattgcttaggttgggaatgaaatcacagggggttgaagctgtgttcttgtgctgagtcatttcctgggtaggggtcacaggacctggttaccaatcctgtggtattagctgttccattagaatgcaaggtctgaaaaatacctcaaaccccagtcttaggttttacaatactgaagttatctataggagcaattgcggtggttatggatcatgtgacctccagctacatgactcctgaaccataattctaatcttgtatccaatttgttagttttacaaaagtggttttggtcccagagcaaggagggggtaagttttgggaagggattgttataatctttgttttaaagttaaactataaactaaattcttctcattgttagcttggcatacacccaggaatgagcaaggacagcttgtgaggttagaagcaagatggagtcagttaatttagattcctctcactgtcatgatttttgcaaaggtggtttcaatatgtctaagtctagatcatttgatatttatgcagcttggtgtttgatgagtttcctgaatctgtggtttgttgtctgtcattacttttggaaaattcttggctatcactacttgaatatttcttctgctctattttctctttcttctccttctcgtattccaattacatatttgtcacactttctgaaattattccagcattcttggatattgtgttctgttttgttttttcctttttttttcctctttgcatttctatttgagaagtttcttttgacatatcttcaattcactgattctttccttggccatgtccaggctactgatgaactcatcaaaggtattcttcatttctgttacattgtttttcatttctagcatttcatttttcattatgtctttgagttgtcatctttctgctcacttaaccatctgttcatgcgtattgtgtgcttttttctttagagcccttaacatattaactaaccatagttattttaaatttctgtctaaaaacttgaaaatccatcatatctgagtctggttttgatgattactttgtctcttcacactgtgttacttcttgccttttggcatgtcttataattttttttttaagtcagacatgataagtcaggtaataggaactgaggcaaataagccttcaatgtgaggttttatattaatctgggtaggaaatgggccatatctaatgtttgttctagctgtaggtggcagaggtgtcaaattcctctagcgttcttgtttttctttcccctgctttctctgggtttctctgagaactcctttttaaatagtctgtttcttgtagttcttccagctgtaatctgctcttattatacaggaaccctgttgatggaatggtaacgtgtcagagggggaagtggtctataatcttatgattacatctcgatcttttaatggaactgcaccttgggctattacttttaaaagaatttctccctccacccttttttttcaatttttttgagatggagtcttgctttgttgcccaggctatagtgcagtggcgtggtctcggctcactgcaacttctgcctcctaggttcaagtgattctcctgcctctgcctcctgagtagcagagattacaggtgcctgccaccatgcccagctaattttcttttgtgtttttagtagagacggggtttcaccatgttggccaggctggtctcaaactcctggctttgtgatccacccgtctcagtctcccaaaatgctgggattacaggtgtgagccaccgtgcccagcctcacctccaccctttttagaagtgacaagatggccagaaggggctagattttggtagtcacccttcccctagaatggttaaagcattttccctggagagcaggcccttgtcatggagaatgctttggctttttaaaaacttttcttttccctcttcttgccagaaggataaagagatttttcttggggtttgtggaggtaaaatccataaaaggttgggggcctgccctgagatgatgacccccaggagtttctcatgctcatgctcctccacactcagcctccagcaattcatcaaacataccaggctatgacttcagtgcctgctgcctcagatagttgatctcggctaattctctggatttgcctgtatctccagattttggggcagtttgccttgtgactttggttatttgagagatagaagaaaagttgttaattcatagtttgttcagcagggttgttgttgttgttgtgaggatgggagcgatgacttccaatgtctttgcgtgttgaagctgaaaccagaggtctagtgaacttttacatttttgaagtttagacttttttcttaagacaaactttctttttgttttaaattttggttttattatagtattatcttatagccagagcatgtaacctgttcaatttctcttcattattatttattgaaattacttcagggccaaatacctggtatgatcttgtgtgtttaacacagtgttattaaaaatcaattttgccagtttttaaaacttacattttgtgtatctttgttcttttatttttatctacttgagaagctaaggactggaagtaagatgttttttaacagccttgaaagatttccccattagtaatctttaatcttactttttaaatgtgagtattgagaattttaccttctttctcatttgtatttgcttaatgaaacttatccatcttttgactgttaacatttttaatgttattttatctctgttatgtctcttgtagttagattctattttgaccatttataatttaagatggtagcttaatctgttttaaatatcttgttgcttatggattttttatttttatattttatgcctctttattttctataagaaaaagagcatgtttttctttctcattattttgtaaagtttgtagcctcattttgactctatttgttacacttgggtttctaattaattctttaatgtatatttctctaactgagaccatcaaatttataactatatcatttgaatttgtatttgaaataagttacttaactcaattttttacttgtcctcactcaatttaaaaaactttaccaagatatcgcaccactgcactccagcctgggtgacagagcgagattccgtctcaaaacaaaacaaaaaaaacattaaaatagaatctaaagtttaagattgaaattactataattttattatatgcagtatatatcctctctttttagaacagtgcttctcaagtatttgggttcaggatatttttatatttttaaaaattatcgagaaccccaaagaactggcttttgtttattgggttatatctgttgctatttacgatattagaaattaaaactttgaacacttaaaatatgtatttattcatttagaaataatagtagtgaatttattacccgtgaatatgtgatgtgtttttatgaaaaataataaaacttttcaaaatagaaataaattagccagaggattagcattgctttacatttttatacgtcttttaaatataagtagaaggcagctagaccctcctatctgcttctgcattcaatccgttgtgacatcacaggccatttagcctctgaaaaatttcattgtatattcatgagagaatgagaaagataaagggaaaataatatgttattatgtgaagagttttacttggtgacacctgaaagggtcttgcacaatcctagggggtccctaaccccactttgagaattactgttctaagataatttatacatttgagacatcagtattgtaactggttttaatgatgcttccagttcctctacaataaggctttactgatactgatttcttgattctgttaatgtagtacatcatcaaataattcgtcctacacagtgtcagtaaaaatggagtagggtgatctataggaacaaacaattcccaaatctcaacgggtcaccagccctctgcacagaggaccctcatcctggactctgtctctggctgaggagcagccaccccatctgaaatgacagtcactgtggtagaggaacagagagcatgcctaaccaggtgctgcctctgagctcttctgccagagtgatacccattgctccaagggaggtacaatcttaccttggcccagaagaaaagaacattgaaaaatgtgtgaccaacacagaaggtgcatgagcaaaatattctttgagtccttgtctatctaagtattgattctgccctcatacgtgaatcattgaataaggtatacatttttccattttaatttttttggacccattctcaagaactgaatgggtatacactttttttagtagtttcctcttacctctaggtttataggtttgcatcattgctttagacatttagggtttcaaattcacttatttttccctttagggcttttccccatatgttctgggaaattctccctcctttatcttataaaaattttcattcactttttaaaaatttcacaatcattttgaatttccaaggtcgttttattttctggttgtttcttttctgcatggaatttttggtacaatatattctctttctgtgtgataatatttgttgtttagaaattcttttttgttccctgaaacatctgtatttccgctagggtaattttttgccttttgcttatcttggttttactccttaatgttgtaggtttccacaaatgctgtggtctgttgtagtctgttcatgcttaccagcaagatgctgaaaagtaaacttgaaactccatttaatgagatgggcttgcaaacttgtgggcttcactgagcaaataccaaatccctgaaggtaaaggccttttctctgagtcatttatatttttcttaagaggaaacctccagtcttctgcctgattgtgggtgttctgtgtcgtagagcaaactgtttttaattttgcctttggaacaatctctcgattttcatctctgcatctccttctcaaccaccactgcatctctgggaggctgcaggacacgctggatccttttctgacctcaggaagcatcctccaccttcaatagcaatgagtacccctcagaccactttttctctttcatacttaggttaaaatttctcatctaattcctttctcttcatcattgtaactttaattcctttactgtcattttaggagatattctagtgaaagaggagaaaaacagttgtcattaatcaacgattttaaaccagaaggctttttcttttttaaaagaattcaatggataaatggtgcatgtctggagaatgggaaattttagtgatcctctattctatcctgatgcatgtttaaggaatggaaagtcccaatgaccatttcctggtgggataaaaaaaatcctggaagtcttcataccgtttagaaatacagataaatttgttaaggcctattagcaaggggaacaatttagcaagtaggaatcagaactacaaacttttgtgattaaaaattagtttcccaggcacagccttaatgtctgaaatccagaggtctccaagtttagacagattaatgtgtcctagttttgcatatccacacaaatctccatgttggaccagagaaagagtgattttcttgtgactgtttttttttttttttttttttttttgagatggagtcttgcctctgtcactcaggctggagtgcagtggcacgatctcagctcactgcaagctccgcctcctgggttcacgccattctcctgtctcagcctctcgagtagctgggactacaggcacctgccaccatgcccggctaattttttgtatttttagtagagacaggtttcaccatgttagccaggatggtctcgatctcctgaccttgtgatccgcctgtctcggcctcccaaagtgctgggattacaggcgtgagccaccgcgcccggccttcttgtgtattcttaatcaaaccttaccagatgagagtctttgaaccaattttatgatgcagaatgccaccctccttttgcagttacagatggaggagatacatctcctttacatctcctgagatttcctctctttgttgttaactaagaagacttgcagttcagtgttaggttctgtaatatctcagccagatttttatttctttctctgtaagttaaagttctccagagaaacagaaccaataggatgtgtatatacagagaaagagatttgttataaggaattggctcttgcaattatgaaggctggcaagtccaaaatctgtagtgtgggcctgctgtttggagacccaggagagctgatggtgcagctccagtctgaatgcagtctactagaggattctttctttcttggggacactagtcttttggttctattcaggctttcaattggttgggcaagccccacccacattatggaaggcaatctgccctactccaaattcaccaatgtaaatgttaatcttatccaaaaacaccctcaaagttggcatataaaattaattaccacagtatcatgtcaattcctataaagattttgacatcttttaattgcatattttccctagagagttcaggtgaaggtctctttataatagtttgattggaacagggtgagcctttttacttctatgtacaggtctttcttaagttcactgttttcatcttttccaccttgatttttcccaaaataaataaattccattcattctggtctccctacaagaatgcttattttatacatgttggctctccattggccatccttcatgtctaaaatcttctaaccaccacaaacctcttggaaactcagtgtctacttccacgttgtatctttgtttcttaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaagtaagtaagaatttccaaatgatgataaaccaggtccatactcaattatgccaaacttcaagatgcaatgagcaggctaaagggcctcctgtgagtggggaccttcaccattctgtaggttaggaggtgacaggagaagcaggcatcacagaaaacctcccttcttctgtagtaaatgttgggggagggccacagtgagggaggtggggcaggagagagaatgggaatgctgtatgggtgcagatcatcctaggtacttgtaaacaatctactaatggtagccataattaaaataaataagtgacctaggcagcattttattccaaagcctacttatttgaaacacttgaaactgagatttttttgaaactcacagtgaagttgtgtcattttaggttacatttggaagtggatgcttgctactgtctctccaaatcattgtttgatctttggacatttctagagccctagaatgcaagttaatgttagcagtggatgcccttagggatactgaggacaaggcttcttcttgtctttgtgaattttctgtgccctttggccaggagtcatagtgggggctggttgattggtttcctggagctcgtcaggccaggccaatcctagtagtggttattgtccatgcaacagaacagccttgttaaggccactcctgaaataacctggccaggctctaaagccatacacaacattcaactttgaacccacacttattatttaaaattactctctccccttaagtgtacaacaatgtcagagagtcaggttcaaaaaattagagtgtatttttatggtggaggacatttaagaagtcatccaaatatacgcaaaattctaacatttcacaagagaacagatgttctatctacaacctaaaagtcttttgtaacccataaatctctagctacataattctccatttaatatttttaagcattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatggtaactatagctctcaacagctttgggggattcaagcccatttcattcattgattcattcattcactcttcattcatatttgacaaatatttgactgagtgactattacatgccaagcccagggggaatataatgatgaaaaaacacacatgtcccatgtccttatggagtttacatacagtgggagtgacagacgttaaccaagtaatcctgcaaatggttgctcagccaggacttgattttgatgctgtaaaacatagggttgaagtctctatttttttgaaggaatacatgagtgatgtcttttcatgggaaaggaggaagccttctctgatatttgcagatatgttcaaagataaaacaattttctttgtattagaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaaaagtaaaagaagtcagtatgaagaatgggatgtgttgatttgtgaatactataccttgattcaaaaaagaggtatcttgttttcatattatgatacatccaagtcagagaaaggtctagaggaagtcaaatactgtgcatgcctcctttggtatccatgagggattggtttcaggaatacccaccactctcagtcctgaatgcttaagtcccttatataaaatggcgtagtatttgtgtataacctatgcacattgcaccagtatactttaaatcatctctagattacaatacctaatacaatgtaaatgctatgtaaatagttgttaaattgtatttttcatttgattatttttaatttttgtattgttattttatttatttatttattgagatggagttcactctgtcacccaggctggagtgcagtggtgtgatcttggctactgcaacctccacctcctgggttcaagtgattttcctgcctcagcctcctgagtatctgggattacagtcacccaccaccacacccggttaattcttttgtatttttagtagagacagggtttcgccatgttggcaaggctggtcttgaacccccgacctcaggtgatctgcctgccttggcttccccaaatgctgggattacagacatgagccaccatgcctggcctgttattatctttaacttttgtcccacgtttttaatctgagggtgggtgaatccacagatcccaagccaactgtacctaggcacaaattttgagtcaatatttgtattttaaccagggtgttccaggctgtggcaatgaagggaatgatgttacttctactgcccacatctcaggggctctgattctgtctgtggactgtggggatcctcctggccccagcatccacatctcatatgttagtatctggcacttcctgtgtttgggtgacaggtacctgaggctcacgactgcccactgcctcagactatgagtagaaatgtgagaaatgggcagaagtagaatgaattgtaaaaagattgaaaaaagaaaaaataaacctctacttatactacacaacatccacaaaaaaataattcaagttggatcacaaatctagaagttaagactacaagtataaagctgctaaaagagaaaacataagacagtgtgtttgcaaactgagagtaggcagtaatttgctatacaggacacaaaaaaacatggatcataaaagaaaaacttggtaagttagatgtcaacaaattaaaaactatgcatccaaagtcaccattaagaaaaggaaaaaacaagccatagactgggagacaatattttgcaatacacatatctaacaaaggattgtactcacaaaatatgaagaactcctataaatgaataataaaaggacacatcaccaattcaaaaaatggacaaacgatttgaacagacatttcaagacaggagatataaaatgtccagcaagaatataaagtgtatgacattattaatcatgagggaaatgcaaattaaagttatagtgagatatcattcactcactagaattgctaaaattaaaaagactgacaataccaagtgctgatgagaatatggaacaattggacctcccatcccttgctggtaggaatgtaaaatgataacgaccactttgggaaagtgcctggcaatttcctataaagttaaatctaacctatgatcttggcagtttcactcctaggtatttacatgagagaaatgaaaatatgttcatgcaaagatttgtttaagaatgtttatggcagccttattcataataactaaaatctggaaccaacccaaatgctcatcaacggagggtagataaactatgactaatttatagagtataatactattcagcaataaaaagaatgaactgttatcacatagagcaacatggataaatctcaaaaacattatgttgagcaaaataagcaagttgtaagagtacatactgcatgatcctatttatataagtacaagtacagacaatacagacaagtacagtgccagaaaggaaggcgccattgctggtgataggaaccagaacagtggtgtcttaagcacaaagcaattttctgggatggtggaaatgttctgaatcttgactgggatgttggtttcacaatgatttacacttaagatatgtgcctctcaatgaaaaaaaggggaacaaggctctgttggacctcgggggtgggagatcctggggcttggacatcaagttcatcttgagcacactgaggtctctcctctggtcactgtctgagtttggtaattttcacattgttttcctcagtatgctatgaacactcacctctccaaatgaataatgtaaacgatttagaagatagacccagattactaccatatggtaaacaaggtaactatcatttagctgatcaatgcccttattaaagttttgcttccttgccttcatggaggcaaatcttgtatttcctctcctgtcttagccctctgttatctcccagtcctcctcccctcacacagccatgtacctgcccttatctgccaacagatgtgagagaaccaatgaaaaaggagatctgatctcttgaatagatggagtctccattggtggagaatataagaagagaaaatgggaaaggtagacagagaataatacaggacaaattacatgaatggattccatcttctaaaggaacataaaagtcctaccctccgaggttgagataaggggattatttttaattaatttcatagaactattaagagaaactcagaaataacctaagccatatcagattcaggtgagagatattccttacggagatgaccagttaggggtctctagtactgtggtcacagtccaagaggggagtttggatatggagagagaggggagcctgaaagatagaattgcgcagggagacaaaactgaaatagtgttggcagatagaagatcaaagtgaaatgggagaaacagaaatggaaagagaggaagtataagacacagcagagaaaaggtaaaccgaaacatctgccaaggatcagaggtaaaaatggagagagaagtatatggaaaaggaaagatgagaggaaaataaataccaagaaatggggaaagtagagaggtacagaggcaactatgtagataaagagttaagaaaaaaagggtgtaaaacacttgagagtgaaaagtggataaaagggagagagaaacagactgggacagtgtaggtttgaggtaagagcactggatatccataactttacaagggtttattccattaaccgtaagttttcagaatgaactgttcccacatcaaagtggcacttgcatgatactcagatttcaatagatctctcccagaatagtccaatgattcccaagcacaaatctccactctaaattatctttagagtacatttattcatggacctgaggacctttactcaagggtcagatagacatctacacttgatttttttcaagaaccttaaacttggtactttgagaactgaaagccacatcttcattgctcaagttagatcgaactcctctgcagcactctttctctcagagacggatcactattatcccatggtttttcaagttggaaacctagtcaagtcatcatggatgactcctcccttgccctcaaatacatgccagttatgcagccaatgtaatcatttcatcttcaggttgcccctggcctgtccatctttgcatccccaagaccaggtctctggtccagatctccatcaccctcatgattctcagggcaacatcctttgctcatctcctccctctaatcttgcttccatcaaatgtgttatttgcacttcaactagatgggatattttaaagtgcacatcagattgtatcattttcctacttacctccttaatacactaaggattaaataaatgggtttttaagtagcatccaaaggcatccacaatgagccacctgcttacttctccagcttaatccctgcctcctgaaatattacttcaaggtggaataaaatttcccccaataatttcaattgttaaatctctctttcaaactgagcctttccctatgttttctctatgctgccttatttagaattgttttcctgtcccactatcctccatttacccttctccaatccagctaaatcctacttagaatatatgatcaaagggaggtctttctttagagaaagctagaaaggcacaattgggagaccaaggatgggagagaaagagcagtatcagagaaagcaagagaaaaaatttgcaggagcagagaagagagaaatgcatctaggaaagagaggctccaagaaacatccgcagaaaaaaacagaggcagagattgaggaaatgtacagaaacaggtggaaagacatgagtgagaaaatgggaaagagaacaaggtataaggaaaggaagactcccccacagtggatgaattattctcagcctctggtgaaggttactgaaggactgaatcctcaggtcaggttgtttggggagaggggaccttccagattatcaggttttcttagttttctcattatttgttttcttgttttgatggctttttgaccataaatcaagacatctaagggatttcattcctttcggcagagaacagcaatgcctgtcatgaaatggatgatatagcagtgcctcaggaagccttgagctcctcgccaaggtgtgagccaggtaaggaaggagtgacttgctctccctgacctgcagggtgtcaggaggtggaattcagagctggtgtttcctaatgcattttactctgagtacatgccacaggcaaaagatccattttgtccttggatcctataattctgctaaattttcctaagtgtatgttatagtagaaatatgctagagaaggatgatgtctttcatgtctactaataataaaaacttgattatacctacccaccacttactttctctagagaataaaaacgattattgtttgttactattattattttgtcccttactatagaaagccttcaaaagaaacatgttccatcagaccaactactcgaaaaactaaatgataatttttgccaaatattttccattgtgttactatcttatctagttattgttcaaagaattttggcaaacaagatgtcattttatctccacagcttatgaattttgatggataaacttttgcttatttgtattttatagctaaataaagtagaagtagaagcatagcaatgtgtaaggtcttttaccaggtcaaattagtcaagcaagaacatgacccacatccctgctgactcactgcggtgatggttgtgtgaatttggcagagatcagggtagccagggtcatggattggagttcacacaggagacccaaggaggcctgcaggttcttaggggagtgggccagggcctggtgcaaggagactcttattcagcaaaagcatttccatggccagagcagggaaaagcagagagaaacggtaagattggaatctgccatgtgggatgcaagaaatccagaagaagagaaccagaaagaaaaatggagacacaagtaggaaaatgtgatggagggcattgaagagcaacagaaaagaaaaagagagggaatcccagggagtcaaggagatggacggtgcttcatggcgtagaagcaagagtgtgtggtaaccaaaaagtgagaaggagaaaggaggtagcagagagatgatcagaaggaaaacaggcagagcaaggctgtggcggggctcaggcgaggtccttggagcaatagtgtttttttgcaaggagaagctcacttgagtgctgaacaccaggattcagcaggagcatcctgaggtctgtgctctcatcactgtgccttgtttatttccaggtttctcttcagagtcttgtgagcagttagctctcccaaaggctggtggaggagatgctgaagatgcacccagcctactaccaggtgggggaggtaattatgatttaaatgaccaattatctcattaaattagttggcctatctctatgcaaccaacacttccttctctctccaccaccaaccctgtaacacacttttgttcagcctgtggttgttttccccaggtgtgtgggaggcaagaggtaaaggacggctaagtcctttagtggaggggctcctgggcagagagcttaagggtacagagtaataaaaattactctgattggaggcaccaaatggtgttgcctaagtgggcccaattttatctacatgaatattgaatctaaatcctaccaggatggggtttgagaaaagagagagaattttaaacttacttgccagggattatttaggaataatgaaatactgtatatagaagagacaaagtggaagtgacaaagttagaagaatgaatagggatataacggggcaaagaggtaacaaacatcacgaaggaagaaagagacagaaatgcaaagaaatggtagaagtcagggagaggaagtcaagtcaaagagatcctggagttggtttatggtgcagatgcagcaatgtgtaaagacagggttagagggagaaaaaagaaggagagagagggagagaggggaaaggggcctgacaaggtgctagaagaagtagagccacttttgtttggtgcaaagatacctttattcccagggagcagttctacacccgaatattagagctcagcatggatccaggtaggtgtccaggtcactgccaattgtctgtcatgttcctctttcactctgcagtgtcctgtaaacttgctatacaaatagatgaaggagaatcagaagaaatgcccaagttactgccttatgatacagaaggtaattaggatttaaattaaagctttatttttctgtcaacatacaaaaacacctactctttcatctcccttcccattcccccatctattcatgtattcatccatatatccatccatccatccattcatccatccatccatatatccatccatccatctgtatattcatctgtccatccatccatccagccatccatcaatccatgcatccctccccacatacagacagagacagtctatgtccagcttcttcctgctttccttaagaggcacaagtagcaaaagaaggatgagctcagactggttggggctttcctgcatataggacatagggaaagagagagagaaagaaaaatatagtttgaatcgttaaataaagagagatctgagtgattgccagttttacctcaatagttgtgggatccaaatattaccacgttgggtaacatttgggtaatattaccacattgggtaacatttgggtaatattaccacattgggttataaggaaggggagataattttcaacttattttctcgaggttatgccaacagcatggatataatgagtatattgcaatatagaaaactcagtgaaagactgttgaaatgaacttcacaaagggaagggtccctgcccctttgttaatggcaaaagatgaggcctttgatactatggcagaaaaataagacagaatatacagaaagactgaagtttaaatttttagatttaaattttggattgaaaaattaggaacagaaagctaattagagagaacagatagaggcatggaaatgagcaccatggaagaaaggagataagcttgattattaaatatggcacaggaattaaaaggtggagaaaatactgtgagaggaacagagagaagaaaaatgctcgaagacagagacagtggaggagaggcacaaaagttgtacacagagaaaaagagaaaggagaataagtgaagttagcagagagtgaaaactgcttgcaagagatggggaacaatatgggacattgtagggatggagggaagattcactagacagaaataacttctggcccaagaatgagacatgttagcagcgagttttcacattatggtgtccccagcctatcaaaatggcacctgtaatgtcctcagaggcagtcgacctccccctgaggctttcatgtctctcccatctataacttaatgatttcaaaacacatatgtccagatttatcttctaagttcattcatctgagtacctgaatacgttcatgaagatatctgaaagacctctccatttggatgtttttcaggaacctcaatacaagacacctccaagagtacataccatctttcctgacacagatctgactcctctcccagtgttccctatctcaggatgaaacactattactccattcttgaagcagaaacctaggagccactcatgactcaccccacctccctcaacttaaacaccccatcaaccatccagtagacttttagtgagttctacatatctcacctgtccatttccttccaccccaacacaaaaactctggtaagatctctctcttggactggagcaacagcctctagactcacatctttcctctgatcttgtacctctcacatccattctttccaactcaaacaactctttcaaaaattgaagttggcttatcttacatttctactttaaatcaataactacttggggtcataaggattaaatctattttttcccccagggctccagcttcatgtctgcctctcctgcaattacttcaaggtttatatacaaattttctagtcattgtcattttctgatgactctttctcatctgagctttcctaaaggcttagccctgtgcttgaaaaagtcaccttgtttcactacaatctccatcatgctcactaatctagtgaaattatatggaaattacatacactctcagagatgccttttttgatccctagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaaggtaggaacagaagaagcagagacatgtgtcaagggtgaaaatgagagtgccaacatggggtgggagaccaggtgggcaaggtttctgacagtctctatcagattactggattgcacaagagcttcttttaccctcacaaaatctttaacatcgatatgcaaacagctgtatgtctatcttacagactgagaaataaagcacagaaatgcaagcaggatattatcacaaaggcaaagtagaaaaggaagagtgggcaccagtgtcctggatgtgtcactgggtgatggttgtgcaaggccagctgggggttcagggccaggtcacagggtcagaatagaaagaagtccaaggagttctgcaggttcccggaggagtggaccagggatcaatgtaaggctttaaggaaaaaaaatgctaatgggagggaagggaaatcatggaaacacagcatggaaatagagcctgccctttggaataggagagggatctagaataagagctaaagaaataatagaaaagggatatggtatcactgaaaaagaaaaaagacatagaaacaggagacaagagaagccagttggagagaagatcagacaatccaagcgctgctcagctaggagggaattatgtggaggcagaacggtgaggaggacactgagaattacagagaaggagaaagaggagctgcaacaaggtggagaaaaggcggaacaagacaggggtggctctcagcatttgcccatcttggatggcatgaacacactgaggcctgtgtccaagtcaccctctgtggtctgtcaatttcttgtttatctgcagagacctttgatctaaaaactccccaagtcactaatgaaggagaaccagagaaggggctctgtctactaccaggtgaaggagaaggtaattatgatttaagtttttaaatatttgagtacatctttgttttctagttggcatggaaaaaaagtttccctttctcccatcctacccttcccttcttcacattcgcatacatacagatggaattatgtcaattttctgttgtgcctttttgaaaactgtgagagagacaaaggatcaaggtgagctgagcccctgagtggggaccatatttctgcatggggaatgtagggagaacgaatataccagaggtaggctggggcgccagagaagtgcgtgggtgatgttattaaacacacattaaacctaaataacagcagattatggcaactgacgcaggggagaatgttttcagcctacttccagaaggatctggagcacagacatgttttgtgaaagaccgaaggcttgcaactgaggaaagtcatgcaggagacccttgggatggtgctgacaagggaaggacctgtggtgctatagcccctgcgtgaacagaagatcttttccaacctggaagaagataactttgagaatgaggaaaatatataaaataagggacattttaccagcatctaggagcataagataaaacccaaagaaacagaaaaggagaaagtagaagacacatagaaaggtgataacctcaaggagaaaagttagagaaaattgtacaaatggtagcaaatacaataacaacagcaatatgggaaggaagcacagaagaaattatgcagagaaagaaacagatcaaaataattaaagaacccatgaagagtgaaaactgttgtccaaggaaaggggcaggtcgagggcctatggagctgaagtcagtcactagatagaagcagctcccagcaaagggcacctctatcaatagtgagttttccaatccaggcccccctaggtagacagtggcacagaagcatactcagagagtaagagtactctttccccagtctcatctgctcaggtagtggaatgattctcatgtacatgtctgcgatgcagacctgctttccaagctcttccatccatgtgcctgaagatatttatcccaggaccctgccccttgcaatgtctttcaggaactacacacatccaaaagggaaaccaacacctcctccgaacctagaaactcccctttctccagggtttactctgtcagtaaagggatgaatatcctgtttgctcttctactcatcagactctttttctctgctttagcacaattgttctctgctttagcacaattggcaattgcaagatgtcaatcagatcattttcttttccccttagacgcggtgatctttgctgcacaggattagatgaattatccttcctgtggatttctgtggcttccacccttcatgggtccccagcccatatcatctgtcccatctctactaatggcatcaattgtttcaggagctgcaatgatctgatctttcttttatatgtgggcccttgagccacatttcccctgtactctgtattgttgccttggcccactcttctcctgatccctttccttatctggttcatttccaccatcccaaggatgcctttcctgatgcccagtatgagaaagggggtgacaaggaaataaatgagatggggaaagccaataaaaagcagagtcaggggtgcaagagaaaaaggcaggagcagagaatggagcagaaacacatggaaacaaagagaagcacctggagccactggcagcaggaaagcagggcaaaggcagaagaaatgtgcctaggaaagggggagggggagaaggagagagaattaggagtccaggcagcaagtgagctgatggatggttctcagccttggtgacagcaactggagtgcatccacttacaggccaggtgaacccacctacagaacccacctacaggccaggagggcctgggtgatggacagccccacctaggagatacttcagcttcccacgtcttcactaagttttctcttcataatttcttgagggatttcttttctttctgcagagggcagtgatgactgttcagaaatgtgtgatggagaagagccccaggaagcctctagctccctagcaagatgtgggtcaggtaaagaaggggaggatttctggccctgggctgcagagtgtcaggaggttgaatttggagcttgtgtttcctgattgtctttcctccaagtatacttcacagtgaaagaatgcaattaaatctgagatttttcacattttctatacatggatatttgagaaatgcagggaggaatcttgatatagaagtctgtgtttaacggaatgggttttattgtttgaacatatgtgtttagataatcacgtggtagttggattatgtcaaggcaaggcaatgtgttctccccttcatattctcatgcctattaatactgaagcattaaaatattttactgaataagatctcctgataccctcacaaaaccttaagatggggccagacaaactgggtaatcctattttacagatgaagaaataaaggtcagaatatgctaggaggaaaaaatgctctttgcctttatttttcttcactatcaatagtattacttgaatttaaaattctattctcactcactttttctatgggaatgaaaaagcttatcatccctctgctggtagatactttttatcattttattacaaacttgacaaagccttcaaagaaatggtatcctaccctctaattgacagaattcagatgatctctttatgagactaaatgctatttttgaccaatactcttcattatgttattggatcatgcagtatgtttttagaggactctgataagtgttacatttttaccctcagaaacctcaagatttaggcagggaaagtgctgttattgttgttttgaggagccagaaacacagacgtacatgtgacaccggtgtttgttaagacccaagaaggagggaaatgcggagaccagtgtcctggatgactccttacaggctttcagttctgtgaggcgggcatgggttagggtggggtcccatagactgagtccaatgtggatgcccaaagggtttttaggaatctgagagactctacctgggtttaatggaaagagacttttattaacaagtaaagcaagcttaaggagaggagtggaaaaattattgagagttagaaagtatgtaaatataatccatgatacgagataggagatatccagaaaaatagagccaggaaagatacacagagatagaatgtgcatagcagatgtagcatatcactgaaggagaaagagacagatattcagggagagatgtttggaagagaaagtccacagagccaaagagaaggacagttgccttcatagagtagcattctatgaaggtgtatgaagatataagtgtataccttcatgtgccttaataggcatagagtggggcaaggacataaagcacaggaccagggatgcaagagggaaatgagggaggcaggagcagtcccagaaaaagaaaccaagacaaggagaagtaccaagagagtccagcggcaagagacagaggtagaaacagaagaagcagagacatgtgtcaagcatgaaaatgagagtgccaacatggggtgggagaccaggtgggcaaggtttctgacagtctctatcagattactgggttgcacaagagctccttttaccctcacaaactcttaaacatctgtatgcaaacagctaaacgtctattttagactgagaaataaagcacagaaatgcaagcaggatattatcgcaaaggcaaagtagaaaaggaagagtgggcaccagtgtcctggatgtgtcactgggtgatggttgtgcaaggccagctgggggttcagggccgggtcacagggtcagaatagaaagaagcccaaggagttctgcaggttccctgaggagtgaaccagggatcaatgtaaggctttaaggaaaagaaaaatgctaccgggagggaagggagatcgtggaaacacagcatggaaatagagcctgctctatgggataggatggatctagaataagagctaaagaaataatagaaaagagatacaatatcactaaaaaagaaaaaagacatagaaacaggaggcaggagaggccagttggagagaagatcagacaatccaagcgctgctcagctaggagggaactatgtggaggcagaacggtgaggaggacactgagaattagagagaaggagaaagaggagatgtaacaagatggagaaaaggcggaacaagacaggggtggctcttagcattttcccatcttggatggcgtgaatgcactgaggtctgtgtccaagtcaccctctgtggtctgtcagtttcttgtttatctgcagagacctttgatctaaagactccccaagtcactaatgaaggagaaccagagaaggagctcagtctactaccaggtgaaggagaaggtaattatgatgtacatttttaggtatttgagtacatctttgttttccagttggcatgggaaaaaagcttccctttctcccatcctacccttctcttcttcacattcgcatacatacagatggaattatgtcaattttctgttgggctttttttgtaaattgtgagagacaaaggatcaagctaaggtgagcccctgagtggagaccatatccctgcatggagcatgtagggagatacaatatgccagaggtaggctgggggcaccagagaagaagttcctgggtgatgttattaaaaacacatgaaaccgaaatatcagcaggttatggtaattgaggcagggagattgttttcagcctactttcagaagtatcaggaacacagacgtaagttttgtgaatgattgaatgcttgcaattgagaaaagtcatgtggaagacccttgggatggagctgacaagcaaagcgtatgcagttttacagcccctgcgtaaacggaagaacttttccaacctgggagaagagaactttgagagtgaggaaaatatataaaatcgtggacattttacaggcatctaagaggttaaggtaaaacccaaagaaacagagacagaaaaggagaaagtgaaagacaaagtagaaagaggataatctcgataagaaataagaggcagagagaaaagttaagagaaaattatacaaatggaggcaaatacaaatgacaacaatgttggaaggaagcacagattaaactatgcagagaaagagatcaaaataattaaagtacccatgaagagtgcaaactatgtcggaggaaaggagcgggttgagggcctgtagagctgaagtcagagttactagacagcagcaacatccagcaaacggcacctctatcaatagtgagttttctgattaaggtccttctaggtagagagtgacacagaagcatactcagagggtaagaattctttctctccccgcagcctcatctgctcaggtagtggaatcattgtcaagcatttaatatctgtctgttaggcaggcctcccttccaagctcttccatctgtgtgcctgaagacttttatcttgggaccttctttattgcaatgtctttcaggaactgaacacctcacagtggaaaccagcacctcccctgaacttagaaactcctctttctccagggtttgctgtctcagtaaagggatgaatgtcctgtttgctcttctactcatcagactcattttttctgctttagcacaattgttatttgcaagatatcaatcagatcatcttcctttccccttagatgtggtgatctttgttgcacaggattagaagagttatccttcctgtggatttctgtggcttccacccttcatggggccccagcccatatcatctgtctcatctctactaatggcatcaatcatttcaggagctgcaatgatctgatctttcttttatatgtgggcccttgagccacacttcccctgtactatgtgttgttgccttggcccactctgctcctgatccccttccttatctggttcatttccactatcccaggaatgcctttcctgatacccagtatgaaaaagggggtgacaaggaaataaacaagatggggaaagctagtaaagagcagagtcaggggtgcaagagaaaaggatagaaacagagaaggggggcagaaacgcatggaaacaaagagaagcacctggagccactggcagcaggaaagcagggcagaggcctgagtctaatgtggaaagggggagggggagaaggagagagaattaggagtccaggcagcaagtgagctgatggatggttctcagccttggtggcagcaactggagtgtgtccacctacaggccaggtgaacccacagggcagaccaggaggacctgggtgggggacagccctacctgagagatacttcagctttccacatcttcactaagttttctcttcatgattttttgttggttgtatactgagacctctgagggatttccttcctttctgcagagggcagtgatgactgttcggaaatgtgtgatggagaagagcgccaggaagcctctagctccctagcaagacgtgggtcaggtaaggacggggggggggatttctggccctgggctgcagagtgtcaggaggttgaatttggagctcgtgtttcctgattgactttcctctgcatatacctcacagtgaaaggatctaattaatcctgagatttttcacattttctgtacatgaatcttttgtgaaatgcagggaggaatctttatacagaagtccatgtttaacagaatgggatttattgtttgaacatatgtgttcaggcagtctagtggtagtcaaaatatgccaaggcaaggcaatgtgttccctcctttatattctcatgcctttcaatactacagtattaaaatattttaccaaataagatctctcgataccctcacaaaaccttaagatgggggcaggcaaactgagtaatcctattttataggtgaagaaataaaggtcagaaatacggtaggaagaagcaatgctcttttgcctttattttttctagctatcaatactattatttgaatttatataaaatttctattctcaggaacaattttacactgttggtgggactgtaaactagttcaaccattgtggaagtcagtgtggtgattcctcagggatctagaactagaaataccatttgactcagccatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagtccatgtcctttgtagggacatggatgaagctggaaaccatcattctcagcaaactatcacaaggacaaaaaaccaaacactgcatgttctcactcataggtgggaattgaacaatgagaacacttggacacaagaagggggatatcacacaccagggcctattgtggggtgggggaggggggagggatagcattaggagatatacctaacgtaaatgatgagttaatgggtgcagcacaccaacacagcacatgtatacatatgtaacaaacctgcacgttgtgcacatgtaccctaaaacttaaagtataataaaaaaaatttctattctcactccctctatggaaataaaaaagggtatcattcctctgctggtagatacttttttatgattttttcacaaacttgacaaagccttcagtgtaatggtattctaccatctaattggcagaacttagatcaactatttgtgagactaaatggtatttttgaccagtactttccattatgtcattggatcatgcagtggtttttcagagtactctgataggtgttataattttactcacaaaaacctcaagacttagatagggaaggtgctgttattgctgttttaaggagccagaaacacagaaatgcatgtgacacgggtgtttgataagacccaagaaaaaagaaagagcagagaccagtgtcctggatgactccttacaggctttcagttctatgaggtgggcatgggttggggtggggtctcatagtctgagtccaatgtggatgcccaaagggtttttaggaatccaagagactctaccagggttcaatggaaagagacttttatctaacaaataaagaaagattagggagagataaggaaacattatcaagagttggaaaatacttgaatgtaatctacgatacgagataggagatatccagaaaaatagagccagaaaagagaaacagagaggcaatatgaaaagtatatgtagcacatcactgaaggaggaagagacagtaagggagaggagatgttaagaagagaaagtccagaaagccgaaaagaaccatagatgccgtcatagagtaataaaaagatatcactagtagaaggggctatcacttaggctgggtgcagtgggtcacccctgtaatcccagcaatttgggaggccaaggcaggtggatcacttgaggtcaggagttcaaggccagccgggccaacatggcaaaaccccatctctactaaaaatacaaaaattagctggttgtggtcgagcacacctgtagtcccagctactcgggaggctgaaacaagagagttgcttgaacccgggatgtggaggttgcagtcagctgagatcacatcactgcactccagcctggtgacagagcaagattccatctcagaagaaaaaaagaaaaaataaggggccaccacttaatatcaaacgaaaggctgaatttattgttcagttaagggatagttgtgcttgtgggtcagtttctctgaacagagaacgtttgtggaagtgtggatctcggtgactggcggccttcaaaagtgagatttgttagtggttagctgacctttagtgaaagcagggtcactggagtgtggctgttactgactgtctgactttcagaagcatggggaagtcaatggttggctggctttcagaggcctgtgtactggccagaagctattgttgattaattgggatgattctggttgttattgaccatatggccaaacaataatgagttttcctagaagtgtagcaactttcaattatcagtttcccctttaggaaatctctcatctaaagctgcaggaggcaccatcaagtattttccccatccaagatgtcttttctggaagaggaccctggaaacaaaatcctaggattccccttcactgagtaggagttatagagttgctagattgagagtgttatccttgcaaaggatgacataagaaaaagtaatgatgttttacaatacgttaatggaatggcagacaactgttgaaagtttttaattagcagcagaattgtgctgcttgcaatactatcctatttattcccttttgctccaagaatactcaccagccacccttgtggctgcagcgtttatcccaagtaaatttgccatgaaatatcttgcttttattattattttcacatcactctaatatattgactttggaaacaaaagacattcttctaattatagcattctggttttagtagtggtatttccatttacaaaatacagtaattgttgatcactgaaaatgtcaaatcctggaaaacgtggctttcccacatgtgctgttaacattgttactgaacaattgttggccgaagattcatttgatgaatcatatatttttaaaatagatgattctgatatggttctgtttagaaataactccaagaacagtttatatattttattttcacattgaaaatcaatcatgtttgcttcagcctcaaagaatgtgtttacgtaaaattaaatgagtgcagcaagctgcacttttttttttttctaaacgggaacagagttaaagttgatccaagtacaaaatctccagaaccatggactaatgcagtcacctgcaattgctttgaggcaactaggatgagatgtggctactagcaatggctctttgatgtctgtcacgttttgaagtgatacccctagagcatggcctgtttgtttatttatttatttatttatttttatttttccgtaagttattggggtacaggttgtatctggttacatgggtaagttctttagtggtgatttgtgagattttggtgcacccatcacctgagcagtatacgctgcaccatatttgtagtcttctatccctcgcacccctcccactcttccctccaagtccccaaagtccattgcatcattcttacacctttgcgtcctcatagcttagctcccacgtatcagtgagaacatacagtgtttggttttcctttcctgagttacttcacttaggatgatagtctccaagccgggcacggtggctcacgcctgtagtcccagcactttgggaggctgagatggatggatcacctgaggtcaggagtttgagaccaacctggccaacatggcaaaaccccgcctccgctaaaaaaaaaaaaatacaaaaattagtcaggcatggtagtgtgtgcctgtaatcccagctactagcaggggctgaggcaggagaattgcttgaacccgggaggtggaggtggtaatgagctgagatcacaccactgcactccagcctgggtgacagaacgagactccatctcaaaaaaaaaaatagtctccaatctcatccaggtcactgcaaatgctgttaattcattcctttttatggctgcgtagtattccatcatatatatatatatatatatatataccacatacatacatatataccacagtttctttatccacttgttaattggtgggcatttgggttggttccacaattttgcaattgtgaattgtactgctataaacatgcatgtgcaagtatctttttcgaataatgacttcttttcctctggatagatacccagtagtgggattgctggatcaaatggtagttctatttttagttctttaaggaatctctacactgttttccatagcagctgtactagtttacattcccatcagcagtgtagaagtgttccctattcactgcatccatgccagcatctactgtttttgattttttgattatggccattcttaaggagtgaggtggtatcgcattgtggttttgatttgcatttccctgatcattggtgatgttgagcaattttttcatatgttcattggccatttgtatatcttcttttacgaactgtctattcatgtccttagcccactttttgatgggattgtttgtttttttcttactgatttgtttaagttcattgtagattatggatattagtcttttgtcagatgtatagattgtgaagattttctcccactctgtgggttgtctgtttactctgctgactgttccttttgctgtgcaaaagctcttaggtttaattaagtcccagctatttatctttgtttttctttcatttgcttttgggttcttggtcatgaaggccttgcctaagccaatgtttagaagggtttttctgatgttatcttccagaatttttatagtttcaggccttagatttaagtccttgatccatcttgagttgatttttgtataaggtgagagatgaggatccagtttcattctcctacatgtggcttgccaattatcccagcaccatttgttgaatagggtgtcctttccccactttatggtttgtttgctttgtcaaagatcagttggctgtaagtatttgggtttacttctgggttctctgttctgtttcattggtctacgtctatttttgtaccagtaccactctgttttggtgactatggccttatagtatagtttgaaatcatgtcgtgtgatgcctccagatttgttctttttgcttagtcttgctttggctttgtgggctcctttttggttccatatgaattttagaggtgttttttctaattctgtgaagaagatggtggtattttgatggggattgcattgaatttgtgattgcttttggcggtatgatcattttcacaatattgattctacccatccatgaagcatgggatgtattttcatttgttcaggttgtctatgatttctttcagcaatgttttgtagttttccttgtagaggtctttcgactccctggttaggtatattcctaagtttttgttgttgttgttgttgttgttttgcagctattgtaaaaggggttgagttcttgatttgattctctgcttggtcactgttggtatatagaaaagctactgatttgtgtacattaatcgtgtatccagaaagtttgctgaattcttttatcagttctaggagctttctgggggagtccttagggttttcaaggtatacagtcatatcatcagcaaacagtgagaatttgacttcctatttaccaatttggatgctctttatttctttctcttgtctgattgctctggctaggacttccagtactatgttgaagaggagtggcgagagtgggcatccttgtcttgtttcagttctcagagggaaagctttcaacatttccccattcagtattatgttggctatgggtttgtcataggtggcttttattaccttaaggtatgtctcttgtatgctgattttgctgagagttttaatcataaggagatgctggattttgttgaatgctttttctgcatctattgaaatgatcatgtgatttttgtttttaattctgtttatgtggtgtatcatatttattgacttgcatatgttaagccatccctgcatccctggtatgaaacctacttcatcgtcgtggattatctttttgatatgttgttggattcagttggcaagtattttgttaaggattttagcatctatgttcatcaaggataccagtctgtagttttcttttttggctatgtcctttcctggtgttggtattagggtgatgctggcttcacagaatgaattagggagggttccttctttctctatcttgtggaatagtgtcaaaaggattggtaccaattctttgactgtctggtagcattctgctgtgaatccgtctgatcctgaacttttttttgttggtaatgtttaaattaccatttcagtcttgctgcttgttactggtctgttcaaggtatctaattcttcctgatttacactaggagggttgtatttttgcaggaatttatccatctcttctatgttttctagtttatgtacataaaggtattcatagtaaccttgaatgatcttttgtatttcactggtgtcagttgtagtatttcctgtttcatttctcagtgacgttattcgggttttctctcctcttggttaatcttgccaatggtctatccattttatttaccttttcgaagaaccagcttttgtttcatttatcgtttgtattttttttatttcaatttcatttagttctgctctgatctttgttatttcctttcttctgctgggtttgggtttggttttggtttgttcttgtttctctagttccttcagatgtgaccttagattgtcagtttgtgctctttcagtctttctgatgtaggtgttcagggccatgaactttcctcttagcaccgcctttgctctatcccagaggttttgattgtcattcagtttgaagaattactgtcattcagcttgaataattttttaatttccatcttgatttcgtttttgacccaatgctcattcaggagcaggttatttaattttcatgtatttgcatggttttggaggtgccttttggagttgatttccagtcttattctactgtggtctgagagagtgcttgatataattccaattttcttaaatttattgaggctcgttttatggcctatcatatggtctatcttggagaaagttccatgcactgttaaatagaatgtatattctgtggttgttggatgaaatgttctatatatatctgttaaatccatttgttccaaggtatagtttaaacccattgtttcattgttgactttctttcttgatgacctgtctagtgctgtcagtggagtattgaagttctccactattattgtgttgctgtctatctcatttcttaggtctattagtaattattttataaatttgggagccccaatgttaggtgcatatatgtttagaattgtcgtattttcctgttggacaaggctttttaccgttgtataatgtccctctgtgtctcttttaactgctgttgccttaaagtttgttttgtctaatataagaatagctacccctgcttgcttttggtgtccttttgcaagaaatgcctgtttccacccctttactttaagtttatgcgagtccttatgtgctaggtgagtctcctgaaggcagcagatggttggtgagttcttatcggttctgtggttctgtatcttttaagtggagcatttaggccatttacattcaatgttagtattaaaatgtgaggtaccattgcattcattgtgctttttgttgcctgtgtactttttgtttttattttttaacttgtattttatttttgttttataggtcctgtgtgatttatgctttaaagaggttccgttttgatgtgtttctaggatttgtttcaatattgagagctccttttagcagttcttgtagtggtggcttggtaatggcgaattctctcagcatttgtttgtctgaaaaagactgtatctttccttcgtatatgatgcttagttttgctggatacagaagtcttgtctgataattgttttgtttgaagaggctgaagatagggccccagtccctcctgtcttatatggtttctgccaagaaatctgctgttaatctgataggttctcctttggaggttacctggtgcttctgtctcacagctctaaagattctttccttcgtcttaaatttggttaacctgatgacaatgtgcctaggcgaagatctttttatgatgaatttccctggtgttctttgtgcttcttgtatttggatgtctaggtctctagcaaggccagggaagttttctttgattattcccccaaatatgttttccaagcttttagaattctcttcttcctcaggaacaccgattattcttaggtttggtcatttaacataatcccagacttcttggaggctttgttcatattttcttattctttttactttatctttgttggattgggttaattcaaagaccttgtctttgagctctgaatttctttcttctactttttcaattctattgctgaggttttccagagcatttcacatttctaaaagtgtgtccaaagtttcctgaattttttattgattttctttaagctatctatttgcttgaatatttctcccttcacttcttgtatcatattttggatttccttgcattgggctttgcctttctctggtccctccctgattagcttaataactaccctcctgaattcttttttgggtaaatcagggatttcttcttggttcggatccattgctggtgaactagtgtgatttttggggtgtgttaaagagccttgttttgtcatattaccagggttggttttctggttccttctcatttgggtaggctctgtcagagggagggtctagggctgaaggttgttgttcagattcttttgtcccataggatgttcccttgatgtactattctcctcctttttctatggatgtggcttcctgtgagccaaactgcagtaattgttgtctcttttctgggtctagtgacccagtgagtctaccaggctccaggctggtactcggggttgtctgcacagagtcctgtgatgtgaaccatctatgggtctctcagctgtggataccagtgcctgttctgctggaggtgaagggggtgcaatggactccatgggggtcctttggtggtttaatgttctatttttgtgctggttggcctcttgccaggaggtggcactttccagagagcatcagctgtggtattatggggaggaaccggtgatgggccagccctagaattcctaaggttatatgccctttgtcttcagctgccagggtggataaggaagagccgtcaggtgggggaggggctaggcatgtctgagctaagactctcgttggacatgtcttgctgcagctgctgtgggggatgggggtgagattcccatgtcactggagttgtgtacctgggaggattatggctgcctctgctgagtcatgcaggttgtcagggaaatgggggaaagctggcagtcacaggtctcacccagctcccatgcaaaccaaagggccagactcactcccaccatgccccgccccaacagcccccagaccatttccaggcttgaaaacctgccccaggctatctgcctcccagctgcagaagaaaaaggcttggttcttccccacctgtggagtctgcacaccggatttgcgccctcacaagagttctgtccaggaggcgtctcaccctgttcaaattgttacaaagttcagctagagattggcttctccctgtgtagttttaccccctgctcctctcccattgggtccctgtggtgccaggcaggaatggccttctaggggacccagccacctcccaggccctttccgctgcttccccctacacctgtatttccctcatctcttcagattgactcagctccaggtaaagtcggaaacttctcccacaaacagaccttcagcttctccagtgggggtgtgtgttcgggagaggagggtctccttttcccacttctgcagttggggcactctcagttttacgggggggggcggtctcctgggtcctgcaggtgcaatctgcttccttcagagggtcatgttgcctaggctggtcacgaaccatggcctattttttatgtacgtataaaagaaaaggattatgataaaggagaaagggagacaggagacctgtctcctgataatgtgataatagaagattcagtgtgggtgactgatgaaggagtattttaaaatcgtgaagatctgttccatttctgtgttccatgagaatggccccaagatatttgggtcaaatgtagggaggcctggtatttcagaaaagattgacccccattgtcttcaagactcagttaatcctagaaatcctcttatctttccttcagtcattggtcttgggaaactctgaagacattgtaacatttctttatataatattatttcctcagccaatagattatgtctgagaaaatagcctagtttttgttttgtttcattttgtttgttttacaaacttggagtttttccttagaagttttatgtccatttttgcccaactcaatgaatagattaagaaatgtctagatctatagagtataatagaggtgacctatgcatcagatcagagaagatgcaggtatgagctttgtatcccttaggccgtatttaaaacttggaagaagatggttgtgttcgtttttcattgctgcatgacaaataaccacaaatgtaatggcttactacaatacccacttgttatctcacagtcctgccagcagaagtgtgggtgggctcaacttagttctctgcttagagtctccttaggctgaaattaagatgtcagcccagctgaagtcttggctgaaggctctgagaatcttgcaatcgagctcacccaggttgttgacataatccagttcctcgtggttgttgaaccgaggtcacagctttgttgctggttgttggtcacggaccactctcagctcctggaagccaatcatattccttaatacattgcccctccatcttgaagccagcaatcttgtgtggaatccttctcacactttgaatctctgacttcctcttctgctgctggctagagaaaactccctgctcttaaaaggctcataaggttaaaccagatccactctattagtctctcttaaggacagctctgccatatcacataaggtaattatggaagtaatatctcattatgttcacagtcctcaggattagggaaagaaatatttgggggccatcttagaattctgcctatcgtcaaggaaattcctagaaaataactgtccagataagccactgattttcccaagcaaataatatttatctttatcaagtgagacattaaacaaagctgaacataaatatattaaaaattttggctttaggtgagactgaagagattgtagtaatctggttaggaggtacagggaagtgaggtatacctattttgtttattgcttgcagacctcaaatcatccgtagtgtaggtatactaatggtcaggtcaactatacatagatcatgtgtcagagaattttccaggacttctaaaattagtccttcttctgaacctttaatctggtagttctatttgcagaatagatccctacctattacatttatagaggttttgttgaaaacagtgttcctcagataatggtctgaaagtaatagattactggttgagatgtggaaacattcagtgatttttttctcttcttttatagacctacttgtcaaatgtgttacttactttggacatgacaaaacctccccattgcaagccagagtcattttagggaaaattttgccagttattaagaaaagtacaagagttagaatcatgatgaaagtatacagaggaagtgaacattttgtcggggagattatggctttggcaaagacaatcccgtgacaaacagcaaagaggccactatatttcagtataagtgtgaatggtgtgttccacatgaatgaagcagaaactgaaaaggggacatatgattaattacatgattgtagttgactccagattacatactaaacaaaatgattttctttcacaaattgacaagacactaggtgccctcatgaaggttttgatgagggacccaagaaaaaatgtgaccgaacatctttgcacagtttggctactgtctaatggacccacatccattagttttaggggctggcttgaattgaggacttatcagaccttgaccaccagctgtttgctttggatcactgtcttctaacattcagaaagcacaggaaaatcaggaacaagcacacatgaaataagactttttgtttttttggtggggttttgctatgttgcccaggatagtctagaattcctgagctcaagccatctgcctgtaatatgacctattaacaggcataagccaccatgcctggcagagataagactttttaaaaatagacagaagaggccgggtgtggtggctcatgcctataatcccagcactttgggaggccgagatgagtggatcacctgaggtcaggagttcgagaccagcctggccaacatggagaaatcccctctctactaaaattacaaaaattagccaggcgtggtggcaggcacctgtaatcccagctactttgggaggctgagacaggagaatctcttgaacccaggaggcggaggttgcagtgagccgagattacgcggttgcactccagcctgggcgacaagagtgaaactctgtctaaaaaaaaaaaaaaagacaaaagaaaggtaacagtagatgaagtagtgaaacaagtaaataagtaaataagcacattaattgagaaaatgtttgctaagtggtgtacttccaactgaaaatatctaattgtatctaattgtatacccatgtttaaataagataaattcagaactaggagctcagtgaaacaagtcagagttcgagttgttgttgagaaagattcacttggcagtaggtcagaaaaatgacctgagctggacacagtggcctgagattcatgcctgtggttccaagggtcccacaggacactccccagcaagaatcttcaagataatctcggcaggaactccaatttttgaagggctaggctactactcataatctgaaactaaaagctgatttattcctagctaagcaaggcacctagtgggaggaggccctgtgcttgtaagacacagtctctatagaaaaggaaactgcagttttatagagagttttaggaagcatattgtgtagggactccagaccttcagaaacaggagtgtttatgagtaatttagcatttggccatcaatgcaggctttgtggagggggtgttgctgactggctgggcttcagatatgtagaactgccagtaatgggctcgctttcagaaatgtgactggggatataagtagtcagtggccaattgggatgagtttaaatagttgcttttcactattgtcaaagaacagtagtattttctggaatgataagagtttccttgctttattctcaggactacaagtacaaaaataaaagtagagaaaaggaggatgaggtgcataacatggggagagcgtggctctgttatgtgtcaaatgtgattattggagcaggtatatttttttccagagaacagttcatcttagctcagaatatcagtgtgcagtatagcagcactggaaactcttctgtggtcattgtctcaggatccttggacaataattttcttgtttctcattagtgtctagtgaactagaaaatcacccaatgaatgaagaaggagaatcagaagagcttgcttctagcctgctatatgataatgtaccaggtaattatgacttaaaaatagtgaaaacagaaacagagttctgataaagagaaaaaggaggagaaaaaatagacttaaaggaagagtcaaatataaggaggagcagtgaaaggagaagatttcagaggaaaaagtaaagaagggggagcaacaagggtgcagaaaatagagtcactgggtcaaactgaaagtcttcatgaatcacaattttggcccaggagcggagcaatcagcatatgaaaatgagaagtgttcctgtgtcatgtgtttctcagaagaggtgccaggaagcccagaagcaaggacggaaagtgatcaagcgtgtggcacaatgggtaaggctgtctgagggccgtgggatgggggtggctcagtgggccccacagacccccagtagggtggaggtaggtgctccagtctgtccagaattctattctccgcatttgcttgacctgagcctttggggagctgcagggaggcaagagatcgttataaagtactatttaagaggatggactctgttgattagacatagatgatgtcatagaagtatactctttgcaatggcacttatcttgtgtattgcattagtatattaagttacacccaatcttccatgaagcccaggataccccagtgaacttctgctggtagataatagtgtcactttgctacaacttagaaaggccacactcaaaagacaactaatcccggtacttaattgtcaggaggaaagactgcaggtctactcttcttagcccaacacgtatttttgatagaagacccagggcccatcctagactcctagttctcagttcggtgggtttttggttcccctagaagaaagagaggaatgattatccaagcatctgtataaactcaagccttctgtagtatacattgtcctaaaatctataacttttatttattaatttctgtttcctcaccaccacttgttattttccagatactgtggatattgcaaacaactccactttgggaaaacccaagaggaaaagaagtaagaataaataagaatttatttgcttttggtattacaaatacgtttttaatgccagagttttaattttgtcattgttactatttctgttattatttgtaatactgtggtagacagaaggatgacctccctaagatgtctacctcctaatccctggacctgtaatctgctatcttacatgacaaaagggactttacagatacaattaagctagagaccttgaaatggggagatgatcctgggttatggggtgggcacaatctaatcttgtaggccttaaagagtggaaaacttttcctggctgtggagaaaggaagatgtgactatggaagaatcatcagaaatatgtcatgttgcaggctttgaagatggaagaagggaccaaggaatatgggtgacctctaggagctgaaaagacaaggaaatagcttgtcctttccagctcccagaaaggaattactttagccagtgagacccatgtcacacttctcactgacataactggaagaaaatacatttgtgttgttttaaaccactaaattggtggtaatttgttatggcagcaattaagagtaatacagattttggtacttagaagtagggtgtggctattaacatattcctgaaagtgttggcatgcctttgggattgggcaatggacagaggctggaagaattttagattatgatcggaaaagcctatattgccttgagtagtccttagtagaaacatggatgctaaagactgtgctagtgaggactgagaaggaagtgaagaacatgggagagaaagcctatattgcgttagagaaaacctggatcatcatgagcagactgttagtaaaaatatggaggttaactgtgttactggtgagcactcagaaggacataagaaagatgtggaaagggcctccttattatatagtggtctgtcctgtactcatgtgaaaagcagaactttctggatctatagctaaggagatttccaaacacagtgatcatggtgtgttgtggtgtcttttgctaattatagtaaaatgcaagagggaagaggtatattgaaggaagagctgctaaacgaaaaagaatcaagtcttgatgatttagaaaattcccagcctatccaggtcaaaaaacatgataaaatgaggagattcactgtcagggacgtgtgcttggtagaaacaacaaagactttttgccagttccctgggaagtagtgaaaggtcagattatacattcacaaaaaaagttatttgaagagacgtagcatgtgactcataagtccctcagccatctcagcagaagtcaaaaatagatgtgcgttgctacaaaaagaataaaatacctaggaatacagctaattagggaggtgaaagatctctacaaggagaactaaaaaccactgttcaaagaaatgacagatgacacaaacaaatggaaaaacattccatgttcatggataggaagaatcaatatcattttaaaatggtcatactgcccaaagcaatttataaattcaatgctattgccattaagctaccattgacattcctcacataactagaaaatacgattttagaattcacatggaaccaaaaaagagcctgaatagcaaaggcaatcctaagcaaaaagaacaaagctggagatatcatgctacccaatttcaagccatactacagggctacattaactgatatggtttggctgtgtccccactcaaatctcatcttgaattgtatctcccacaattcccaagtattgtgggagggacccagtggcaggtaattgaatcataggggccggtttttcctgtgctattctcataatagtgaatatgtcttcatgagatctaatagttttataagggggagtttccctgcacaagctctctctctttgcctgccatcatccatgtaagacgtgacttgctcctccttgtcttccaccatgattgtgaggcttccccagccacatggaactgtaagtccattaaactctttttcctgtataaattacccagtcttgggtgtgtctttatcaacagtatgaaaacagactaatacagtaaccaaatcaagatggtactggtacaagaacagacacatagcccagtggaacagaaaagagaacccagaaataagaccaaacacctacaactaactgatctttgacaaacctgacaaaaacaagcaatgggaaaaggattccttattcagtaaatggtactgggataatcagctagccatatacagaaaattgaaactggaccccttccttacaccatatacaaaaattatctcaagacagattaaagaattaaatgtaaaacccaaaactataaaaaccctggaagatgacctaggcaataccattcaggacataggcatgggcaaagagttcatgacaaagatgccaaaagcaattgcaataaaagcaaaaattgaaaaatgggatctaattaaactaaagagtttctgcacagcaaaagaagctatcatcagagtaaacagacaacttacagaatgggagaaaatttttgcaaactatgcatctgacaaagatctaacatccagcatctgtaaggtacttaaacaaatttacaagaaaaacaaacagccccattaaaaagtgggcaaaggatatcaacagataacttttcaagagaagacatacatgcagccagcaatcatatgaaacaaagctcaacatcactgatgattagagaaatgcaaatcaaaaccaaaatgagataccatctcacaccagtcagaatgactattattaaaaggtctaaaaacaacagatactgacgaggttgtggagaaaaaggaatgcttatacacactgttgctgggagtgtaaactagttcaactattgtggaagacagtgtggcaattcctcaaagacctaaagacagaaataccatttgacccagcaatcctattactgagtatatacccaaaggaatataaatcattctattataaagacatatgcacatgtatgcttatctcagcactgttcacagtagcaaagacatggaatcaacctaaatgtccagcaatgatagactggataaagaaaatgtggttcatgtacaccatggagtactgtgcagccataaaaaaagaataagatcatgtgctttgcagggacatggatggagctggagagtattatccttagcaaactaatgcaggaacagaaaactgaacaccacatgttctcacttataagtggtaacgaaatgatgagaacacatgaacacctagaggagaacaacacacactgaagcctatcagaaggttcagaaggtgaagggttggaggagggagaggatcaggaaaaataactaataagtatgaggcttaatacctggatgatgaaataatctgtataacaaacacccatgacacatgtttagctttgtaacaaacctgcacatatatccttgaacttaaagtataaaaaaaaaaaaaaatagatgtgtgaattcctaggaaagatctgtagggaagcttcatgtctaatggaggaaatcagaaatccccatgatatatgcaggagatccataagactcttgagggttttgtaccaagagaaacaaagatttccatgtcctatctcctagaacctataatctgttactttacatggcagaagggactttgaagatgtaattaagttaaggatcttgagataagatcacatgggccactaaagtcagagaacatatccttctgtcgagagagggatgtgtgactatggaagaatggtcagagagaatagagctggatgtggagatggatgcaggggtccatcaactaaagaatgtgggcagccttccgaagctggaaaaggctcctctgtggcctccagaaaggagcaaagccctgcagacaccttgattgattttagccctgttaggtgcatgtcagatttccaaccctcagaattatgagaccacaaatctgtgatttttttgtcactaaatttatggtaatttattacagcagcaataccttttgtaagacaaaaaaaaaatttcaccctatacggttatattcaatcttctaaactaacaatttatattttttcaaattacttacacctttatgctttttttttctgattttaaaatacttgttccctgtaaactttgctgtacatatttctatatttttttctatgctttgttagcacatttagaattatgtgatatatctaaatgaatacatttaaactgttacatttctttttaaatcaatataacatgcactggatattataaacatttaatatcttgccaacttaactgtaaaaaaaagttttatttcattcctgttttaacttacattgctttcatttttggtgcagttgagcattcttcatttgttattggccatttttgtttcttctcctacgagtgcctggaacttatattttgccagtgtgttgtctttttttccccatgctttaggacaacaggaatacttatatatgatatatactaagggttgactacgtgtgttgtcatatttgatgttattcttttacgtttctttgtggtataggcacatctcgtttgattgcacttcactttattgtactttgaggatattgtgagttttacaaattaaatgtttgtgacaaccctgtgtcaaaaaaagtctgttggtgccctttttccaacagcatgtgctcactttgtgtctctgtcacattttggtaattctcgcaatatttcaaattttattattattcttcttcctgttatggtagtatgaacagtggtaacaatgatctttgatgttactattctaactgtctatggcaccacacactgtgttcgtataagatggcaaacctaataaatgttgtgtgtgtttcaactgcttcactgaccagctgttcccctgtctctctccctctctttgactttcctctttcctgagacaaaaaaatatggaaattaagtcaattaataatcctacaatggcctctaagggctcaagttaaaggaagcgtcacatgtgtctcactttaaataaaaagctagaaatggtgaggcttagttaggaagccatgtcaaaagctgagaggctgaaaactaggcctgttgcagcaaacaatcagccaagttatgaagtgctactccagtgaacatacgaataataagaaagtagaacagtcttatcgctgatatggagaaagtatgagtggtctggatagaagatccaaccagccacaacattcccttaagccaagccttaatccagagtgaggcctaaactctcctcaattctatgaaggctgaaagatgtgagaagctgcataagaaaagtttgtggctagctgatgttggttcctgaggttgaaggaaagaagctgtctcataacattaaagtgcaaggcgaagctgcaaatgctgatgtaaaagctgcagaaggttgtccagaagatctagccaagatcctagatgaagatggctacactaaacaacagttttacagtgtagactaaacggccttttattggaagaagatgccatctagaactgtcatagctagagaggagaagtcaatgcctggtttcaaagctccacagaacaggctgagtctcttgttagaagctaaggcagcaggtgactttcccttgaagccaatactcattcaccattctgaaaatcctagggcccttaagaattattctaagtctactctgcctatgctgtataagtaaaataaagcccagatcatagaacatctgtttacaacatggtttactgagtattttaaacccactgttgagacatactcctcagaaaaaaagattcctttcaaaatattactgttcattgacagtgcacctagtcatccaggagctctgatggagatgtacaaggtgattagcattatttccatgcctgctaacacaacgtccattctgcagcccatggatcaaaaagtaatttcaacttgcaagtcttaatatttaagaaacacatgttgtaatgctatagctgtctctatacataatgattcttctgatgaatcttggcaaagtcaattggaaaccttctggaaaggattcaccattttacatgccataataacattcatgatatatgagaggaggtcaaaatatcaacattaacaggaatttagaagaagttgattacaatcctcgtggatgactttgaagtgttcaacacatcagtgaagaagtaattgcaagtgtggcagaaatagccaagagaaccagaattagaagtggagcctgaagatgtgattgaattgctgcaatctcatgataaaccttgagtggacaaggagttgcttcttaagaatgagcaaagaaagcagtttcttgagatggaatttatacctggtgaaaatgctgtgaacattgttgaaatgacaacaaaggatttagaatatattagttgataaagcagcagcaagatttgagaggatctaccgtgataaaatgctactcaatagcattgcatgctacagagaaatctttcaggaagagccaatcaatttagcaaacttcattactgtcttattttaagaaatttccacagacacctcagccttcatcagtcaccaccctagtcagtcagtagccaccaacatccaggcaggactttccaccagcaaagagattatgacttactgaaggctcaagtgatcatgagcattacatttagcaataaagtatgtttaagatatgttcattttattttagacacaatgctattgcacacttaatataccacagtatagtgtaaacataactttcatatgcactgggaaaccaaaacatttgtgtgatttaccttattgcaatattcactttattgcagtggtctgaaaccaagtatttctaagatatgcctgtatctttatcccaaagaagcttgaaatttttatctgatcaaatctgtcagccttttcatttatggtttccaggttttatgtaaaatttgcaaatatattgtccacctcataatttagaaacatgtttacttacttctagaatatttggaatactttttaatgtttaaatctataacacacatggaattcatttattggtatatgatgtgagatggtaattaagagatataacactggtagtttttttcttcatgattcaaaatactattttatgtatgttttccagtatatacagaactgtgtcttatcacatttctttatccattcatctgttgatagagacttaggttgtttctatgtcttaactactgtgaattatgctgcaatgaacatgtggatgcagatacctctttaagatattggtctcatttcctataaattcataccccaaagtgagatttctggattgtatgtatttctgtttttaactttttgaggaacctccatactgttttccataatggctgtaccaatttacattcccacttagagcatacaagagttccttttccccacaacctcaccaacacttgttatctcctgcctttttgctaatagctatcctaataggtgtgaggtgatgtttcattatggttttgagttacaattctctcatgattagtaatgttgattgctttttttataatccattggccattatatgtcttctttgggaaaacatttattaagatcctttgcccatttttaaatcagattatgacatgcttttgttttgttttgtttttttgctattgagttatgtgagttccttatatatatttaggtagtaacccttatcaaatacatggtttgcaaatgttttctcctattccgtaggttgccttttcatttttacaattatttcatttgctgtacaaaagctttttagagtgatgtaggtccacttgtttatttttgcttttgttcctgtgcttctggtgtcatatctaaagaataattgcccagactaacctcaaggagcttttcctctgttttcttctaggaattttatggttttatatttgacatttaagcctttaatctattttgagttaatttttgtatatggtgtaagccaagcgtctaatttcattcttttgcttgtggatattcagttttcttaggaccatttattgaagagactgtcttttctccattatttattcttggcacccttgtcaagattaaatgccccttcttgacatctgtattcagcatagtgatgtaagtcctagtcagagcaagtaagaaagaaagaaaaggcatccaaattggaaagaagttaaattgtctctgtttgcaggtgacatgatcttctatgtagaaaaccctatagactccatcaaaaaactgttggaactaacaaatgaattagtaaggttgcagaattcaaagatcagttgtgtttctatgcactaacaatgaactatccaaaaaataaattaagaaaacaatcccatttacaatagcaacaaaaagaataaaataggaaccaagttaacaagaggtgaaatatttgcacactgaaaactatgacattgatgaaagaaattgaaaaatatacaaataaatggaaagatatctcatgttcatgaactggaagaatagtgttaaaatgtccatattacccaaagtgatctgaagagtcaatgaaatctctatcaaaatttaaatgacatttttcacagaaataggtaaaaggaatcctaaaatttgtattgaatcataaaagactccaaatagtcaaagtaattttgaaaaaaaaggaaacaaactggaggcatcatactgtctgattttaaactatgttacaaagcaagagtaatcaaaaccatatggtactgtcataaaaacagacataaaccaatgcaattgaatagggaacccagaaataaacactcatgcatgtatgttcaagtaatctttgataaggacaacaattacagaattttctttatgtagatgttccacgcatccacttttcttatctgctttattgagctgtaatttgcataaaacaaattcatcaccttaaggtataacctaatttgttttaacaaatgtgtgcagttatataaatacctccacaatcatgacatgtatcattttcatcaccccaaagtccacttgcattcttctctccattctctggttctcgacaacagctgatctgttttttgctagtttgttttttaaaagatggggcctcactgtgtgttccaggatgaccttaaactcctgggctcaagtaatcctcctgcctcagactcccaaataagtgggaatacaggcatataccacccctaaaccaaggtgtttttttttttaatttgcaacctaatgtgtggtcaatatttgtaaatgttttctgccccttgagaataatgtacatttgaactatttgttaggctctggcttcactccatatatatcttttttatcaagcacaactttcttgtttaaatttgtgtccatagtaatttaaattttatttgctccatcagatttgcatacaaatgtgttaaattcttgcacatggttgtatatttgccaattcctctttatcttgttgctttactttaaatattttgaggctatttatgatttgtaactttttaatggatgtttttcttttatcattatacagcattctgctttatccctgttaatgcttttgccgtaaaatctcttttgccaagtactaacattgttacacaaacttttatgattttttaaaaatattttccactcactttatgtgatgcccttttgttcagttttcttttatgtctcttgtaactgcacttaacttttgtagttttgtctgatattcctagcttcttaataggtaaatttcaatttgtttacatttattgagtttccagatgtatacggacctatatcttctgtggtattgttgaccattctctatttgtatctttcgtgtctccttcctgctttttaatggattggtataaaactatatattctcccctttctccctgctggtttggaaattaaagataaaatttctgtaagcttttaaattatgccccaatcccaaaagatgacaaggatcttatcatggtttcactacaaactgaacaccccatctctaccattttggctattgtttaatattttatttttaactataaattttgaaactattatcatttttacagttgatatttacttaatttaaaaaaatattttgtatactcaccattgttctttttctttggtttcactttttgtctagctgaagtaaattctttgttttttctagtgagtgatctctaagtggtaaactctgtaagtgttgggtgtacaactttttctttactttgatagaactttttagctacattaaaaattccaggtcgataatttatttcttctcagtatagtaaggtgattactatattatttcctggaatctatggtgtggctaataacaattattctcttattgtaactaactgtaacttcttggtaaatattctgtcctttctctctaaaagcttttattccccaaaatttaatcacgaaaattttaagcatacagaagacttgggagaattgtacactaaacatcaatatactttcacatagattcacaattaacattgtatcattcctgctttatcacttttctattcatctatgcatttctctatccactcactaaccggtggtcaagtttgaaacatttcaaggctgcagacgttagcactattccccctcaactacgtcagaatgtatatcattaagtagagttcaatgtatgtttagagttcttttgttaagataaaatttacaatgaaatgcacaagtattaagtgtaccatttgatgagttcttataactgcatttttctgcaccatcaaaattcttatcaagatacagaacatgatcatcaccctggaaaggttccttacgccctttctggtgtatctccacccactatccatcagggcaatcactactcttctttttaactatgataatttggcttttaaaaaactttatataaataaggttttatagcatattctctttagagtgggatttatttcacacagcatgtttttgagattcatccatattgttggatgtctcagtagtttgttctttttcattgctaagtagtgtacattatctggatataccaaattttgtttataattctcctattgatggacacctcgagttttttaagtttttgctattatgaaaactctgctgagtacattcttgtaggagtcttcctgttttttcgtatctcctgcataaatacctagaaacaaaattgccgggatatagagtagatgcatcagttctttcccccaggacccatgaaaaggatggtgcagagcaagcccaggtggatgctgcactcataggtgtgtgcagcagcagaagaatgcttcactgaggaaacctatgggattataaggggaccaatagcaaacctgcccaaaccttacctctgagggagacattatctttttagctggaatttaagcaattctcctctggggatattaagcaaatctcctctggggatcttaagcaaatctcttctggaggcatctcctctggaaaatttctaaggagggagatgttctctactttatactggtcagggatacatttgccctataatctggaggctacatgatctctagcttccaaggccgctttggtattcaaatatccttgaagtgatactctgaggcacgtagaaatgccatggagaatggcctcccagcaaattcaccccacatttttgcttctggcaaatttccccatgaagacaccaccccatcagccactctgattattcggacccatgggtccacatccattcaatttttttcctgcaacatttaacaaatcttgacccagtgcagcggctcactcatgttatcccagtactttgggaggccaatacaggaggatcacttgaggtcaggagttcaaaaaccagcctggacaacatagtgagaccccgtatctacacacacacacgtacccacacacatttcataaactgtaaacgatctaggtcccttatgagcacctctaaggtacaagtccttatgtgagggaggcaagttagtgcctggctttcatacaagaagcacaatcccaagggcacacgtggtgctcccagaagggaagtgtatacaattgttgggcttccctgagtgggatgtacattagtaagggagaaggtgaacagtgtctcttacgtggctcctggctggctgtaagccttggggttcccagttctgtttatccttgatttgtttgtgtgtggctggggagagggtgggcatatgggggactgcttgaggacagtctgtccaatctgtcctatttgtccatgtcaccaaccaggtggcagtcccccctaacaaatgactgagaatagtggtggagactatgtctagagggttctgtgtgggacctcagaagctgggcccagcccctgccatctcatggctggtgcagagaggctgactcagcattctcagaggcgggagcgctggagtagtgtgttttccttctggacaaagcatccttgggttcttctgaaagacagatatcaccaatgctcctgttttctcccatacctctttagatgtctggatttttgctcttgcttcactgctgcaaaatctgctataccattccagtggctgtaccttcatcttttgccctaattatctccttttctcacttagactttccatctacaaaattagatagaagtagaggaaaagcattttataaaatgtgcctggagttaaatctgaatccctaggcactttgaaggccatagccaccaggctggtaggggaaagaatgaggcatcatccctaggaatgaccagggtcacaacagaatcctgaattttcaagataggtctacagaacactcgcaatccccaccacttttgtcctggtcactatccaggaaggagatgatccctttctggagattgctcccttcaatgagcctactgccctcccatagtgtgcggacaggaggagatgagggacagtcagaaaatcagtgcactgtggagtcacttttctgataaagggcacgtcagactgcaaatggcccagatggccagtttgaggacactgatgagtttctggggtcaccatagcgttcctggagtcagctgctctgcagcctgaaggagggctgacagtgtggaggcagtgctgagattatttaaggaaactatatagaaattctataatgattatgtaattacataatgaaaactctccatatcagagttcagaatatctcccaatttccaacacagaatattatccataacaccatcaacctcaaggaggatgtcctctcattgcacatttgaatttacacaacaaacacttgaaaaagcaacatgaaacagcagttatcattcactttaaggtgccagcaagagttaattttccattaaaaattttgttcaaaggaacgtcatctcctgtagtctctcccaagcccatggcccaaggctcatgcagaggtaaaatataactctgtactcaacctccacgctgctacactgatcataaagtattttgccccattcctgcggaccaaagtatgaaaaaaaatctttaatactattggcatataaaactcagagaattatatttatacctctgcataattaactttattctctttggtttgaaggaaaaaagagggggcatggctggagcagaatgagaatgagaaggcaggaaaacagccaacaaaatggtaagcaggcaaagtgaagtagttacagcttttgagtttattagggcactgtccattgtattctggaaggcctgcagttccccagagccagagttctatacctcctgtatccattaggatgtagactaacaggctgtgacaaagaggcctgagaatgcaatggcttcaacaaaatggtttctaatgcatgtaatagtccagaggcccacagttaatagggaggtgttatcatcctcagtatgactttctttcctagctcaaagtatttttattaatttggaaagacattcctaagagggctaaatgaagaaatcagggtgtatgtgtatgtgtgcacaatagtaaacatacatatatgtataaccatattttatgtgaaattcatacttgtgaagtatatttttatgtatcctgatatacacatatgtaattatttatctgtacatataaaaagacataaatatagaaaaatagatggcagttcattcataaaaatatatgcagtggttacatttggtcagtgtaatagaggtgatgtttatatatttttatctgtggtttttaaatgtatgtgtatatattaaaatattataaatcttcaacatttttaatgaaaaagtgttattcaaaaagtaacatatgcaaaaagaaaagactaggagaatatttttgcacaaatcatcatctggagatagccatcctcatctgtggctatctccaatggtgatgtttcatatcattttattttctgaatttcctgtaaatatatttattctttataatcaggcccctgaaattttcaaaatttattttagccatggtctgaggacttccattcttctagacgatgaaggctaagtctcattttctaaatgattgtcaattttgaatcagtggatctaaatagtaagattttagagtcctattgaaagttattaatttttaccaatcttgccagttgatgtggcttcctggttggtggatgtgacagctttgtttggaaagaaaaaaaagtggctgcgtgcattttaagaatggctgttttcaaattgaaaatttgtttggactcaatcattataacattttcatttaagtctgaatcattataacattctcatttaagtctgtgtgtatgtagacaaattctaagagacttcaatgtgcaattaaatcctgtgtgtaacttaaaagtcgacactcccaaaagcaaaaaatgctctggacacctgctcgaggggatccagaatgagacccaggactccctcacttgcgtttgttcctgcctgacagctgttgttctgcccagttctattaatacattttcccctgcctatccccagataatagcaaagccgacggccaggtggtctccagtgaaaagaaggcgaacgtgaatctgaaagacctttccaagattaggggtaagataaagtttgtccgctttccctttgccctacaggtcaatacaaattttactgaggtattgacgagcctagatccaccttaattgtttactcatcaagcttagtcaattggagagcagtgaaatctaaaagagcaaactcattataagcaggggttgtaagttgattgtattcatatcatagatcttatctgcccagtttctaaaatagttttcctctgtgttttatctcattttcctggaaattcctttgcctcaaatcattgttttattaaaatggctggacctggtaaattgtaagccgaatacaggtttattctctcactgccctttcaagtcctcctcctagatgagttctttcctgtcttgagcaagctctgtcgctttcttgttcccttttaaaaacagtaagagtctcatttcagtagttgggacctttctgacctagtattaaactacaatgtcttccccagtttaaagcaccttcgcttcttcagcctaggcaagccttagtctggaacacatatagttgggggtgacatggtcagtgtcttctcttattctgtcttggccctacccccactccatagctgttggcttggtcccatccaggattggggaggtgagagagatgggtgagatcagagtgtggaagtgtcttgcctgacaggtgcagccgtgaaatgacattgcaagtggttgatgcacaatcactagctctttcttccatgagatgctttcatcaagtccactgcaagggaaggggaggggtcaggcatcacagcttgacttattttgaaagaaatagagctttacttctacaacctggatgtgagtgaagggctgaacctggcataatcagttccaccaactctttctaaggttacatatgtggcctggtgcattgtcctaggatgcgggtgctcaactcaacctacttgcttgggactttctcaattttcccaatgaaactctcatttccaagccataggtccactttgggtctgattggtcctttttactttggtggcctaatatgctcatgatatgcttagaacttatagtacttaggaatgcataggctggaaaatatttcctcatgggcctacatgaccctgatcagcacccccagatggtggtcattggatggtggacatccagcacaagaaggaaggaacattttgctttcctgccttggaaaataaaacacatttggacaatagtaaacattgagatgcccattcacagccaattaacatgcacttgggagaatatcatcggctgcagtgtctgccatgtcaatccttaattactatttggaatgaaggctgcggaaatctcaattctacccattcctcatggttaaccttcttctgattagtttcttagatcctaatatttattttgtccaaagccatgtggacaaagccctggtcacatttactattactttcagcacgagggtacaaatatcttcccccaatgtgacatgtgcagcatacatctcacctatgggacacctaatagggtttcccttaagtcacagaactgtcatttatttgtgtctctgctgagagaaactgaaacgccttcacttaattttgtagttttgtctcaattttctctgaatattttagtttctgtaatgacggtaatcatcattttgatcttgcaaagattaaataaattaatggatatgtaagtgtttaatgtgtattatatgtcatatatatttcaaatatatatgtttggaatgaaatatgaaatgaaccttcaaaatatggaatgaagcatttatacttttgcttgagatatacgtgaaatactgatttcaattagtttttttcctaacataagaataggaaaatgaaatataaagtgaacctaacattagctatctaattcttcataccttaaaggctagggtttaaatctttttatttatacattaaacaggcttttggaaagttacatttaaatggaatttttgaaaagctgtaatatgtgtaatacagctgctcataaatgactgtgattatattattctactttctcagggagaaagagaggcaaacctggaacccgcttcactcagagtgacagagctgcacagaaaagagtccgatcaagaggtaaaaaagaaaacaggaatgaactttcaataactaaacatctaatttcctgtgcggtacactgtactttcagtaataaacccatttccttaattgttttatgaagctgtactaactagtgagaaatgtatcctatttagtcattttccaaaatgtgtcaaggaaagaaggaagtaagttggtgatggatctacaaccagatcccaggggcccaggggccactaaagtgctactttcactgaaatgataaatttcaaggctggagatagttcattgccgtataaagggtataacccataagtgatttaactgaccttcctctgactactcagaaagccacaggttgcacactaagggtgaaaaagagttgtggttagagatctgtgtcctaagactttctttttctttgtgtgggcttaggctgatcatttgactttctttgtctcagttttctcatctggaaagcaagagcatgaattaggccaactatctttctttctttctttctttctttctttctttctttctttctttctttctttctttctttctttctttttttattctttaagttctgagatacacgtgtagaatgtgcaggttctacaacccatcatctacattaggtatttctcctaatgctatccttcccctaacccccaaatcccgacaggccccggtgtgtgatgttctgtccctgtgtccatgtgtccttattgttcgacttccacttatgagtgagagcatgtgatgtttggttttctgttcctgtgttagtttgcccagaatgatggtttccagcttcatccatgtccctgtaaaggacaggaactcattctttttcatggctgcatagtatttcatggtgtatatgtgccacattttctttatccagtctatcattgatggacatttgggctggttcctagtctttgctattgtgaacactgctgcaataaacacacgtgtgtgtgtctttatagtagactgatttataatcctttgggtatatatccagtaatgggactgctgggtcaaatggtatttctggttctagatccttgaggaatcgccacactgtcttccataacggttgaactaatttacactgcaaccaacagtgttaaagcttacctatttctccacatcctcttcagcatctgttgtttcctgactttttaatgattgccattctaactggcgtgagatggtatctcattgtggttttgatttgcatttctctaatgaccagtgatgatgagcttttattcatgtttgttggccagataagtgtcttcttttaagaagtgtctgttcatatcctttgcccactttttgatggggttgtttttttcttgtaaatttgttttaagtttcttgtagattctggatattagccctttgtcagatagatagactgcaaaaattttctttcattctgtaggtaggccaaccatctttcttattagtccatcctggtcctaatagtctgcctttctaaaaatttgtctcaggaccaaggacagctcccccgtttatcatgacttctgttgcccaggctggagtgcagtggtgtgatctcactgcagactccacctcccaggatccagcaattctcctgacttagcctcccaagtagctgggattacaggtgggcaccaccatacctggctaatttttgtatttttggtagagatggagtttcgccatgttggccaggctggtctcgaactcctgacgtcaagtgatccacctgccttgccctcccaaagtgctgagattacaggtgtgagccaccacgcctggccctacacctttggttggaagggaaggattcactgctcaccctcctggagttcctttgaagacctttcacccccttctctgtgaaatcaggtctccagtcccccacctgcaaccccatataattttcagattattctagagctccctgagctcttctcttagctacggggaaagcagacaggacagagaaatgaactaaaggagagaacaaaaatagaaggcagacatcatctccattaggttatcccatcattaccctctccctgcttgccccgtcagtgctcaaatggggagactgaatatgatctctggagtcatctaaggctacccacctgcagcaaaacagcatagctggagagcttctgtcagaacagtgacagcaactgtgtttcattgtcatataagaatcagtggagcttacgagattaggagttaaaccagttttactgaagtctaatttctctgctaaagcattctattttgtatgaaatttgaaaggtgaaattggggtagacattctgtaattatgtatcaaaaatgccacttggaagaaagactttgaaactctagagggttttggaatagaatttcctaagtatccctcgtgtctttataggaattacctcagtagggaggggggacgtgcctttgcaaagtgagacagaatgaagaaatcctctctttcagcttcaagaaagcacaaagatgaaactgtggattttaaggctcctttgcttccagtgacctgtggtggggtgaagggaattttacataagaagaaattgcagcaaggtaggttttatggtcttctttaatttgcagctcctatctgaaggcatcacaagtagtggggaattatcatgtgaattacacatcattcaaggagtttggtcccagtttggcttgagggaaggaggaagggatttctaagatgacgtttacagactttaagaaatcgcaaccaccagatgctcacttgcacatggaatgtccagagggtgcccaaagaaccaaagagaaggcaggaacatcaattcacagatgaaaaatgtcacgtattttactttgaatcagacagaaaaatgaagaggccctcaacctcgaccttcatattctctctcccttctggagtgccatcaccagggcagggtgcttggtatagggagatgatcacagaatttgggatcagaaagcctgagttccagcctttgctgtttcaggagtgactgttccattctgagtagagaagggaacctttctgaacctgaaatgtctcatccaagagagggaacaataatgaaaaacctgcctcatgatgtagctgtgagaattaatttgcatattgatgtaaaatatgtaaatttacatgtttttactgtaaattataaaactttgccaaaaaatgtctattagaatggccatcatctcagaccaatcttaatatgactctttggatgtcaattaacagaaatgtttgcattgtgactatttctaaacagctttactgagatatagttcacatatcatacaactcaccacttagagtgtacaaatcaacttttttttgtatagtcacagaattgtacagccatcattatcctctaattttggaacaatttgttccccactgaaagaaaagcccatgtcaattagcagtcagtgcctattcccacctaagcagccactaatctattttctgctctataagtttgcctactgtaggctttctagaagtggaatcctataatacatgccctttcctgactgccttcattcactaattgtgatattttcaaagttcatccacaatgaatgtattagtatttcatttcttttattgacaaataatatatgtcattgtatagatataccacactttgtttataaactcatcatttggaactatttccactctttggctattataaataatgctgttctgaacatttgtgtaacaagttttgtgtgaacatatttcagttcttttgggtatatagtcaagagaggaatgactacatcgtatggtaattctatgtttaatttattgaggaatcaccaaagtgtttccacagtggctgcactattctgtattcctaccagcaatgtatgaaggctccaatttctctacatgctcaccaactttgttatcgtctgtctgtctttttttattacagtcatactgtcatcctagtgggtatgacatggtatctcattttggttttggtttgtgtttccttaatggctaatggtgttgagcatgtgactatcttttacatataaattaaattttttatcagataacatttcacaattagttttttaatatcagctacctgtgattgcagggatatgaaaatttctgtttaataatgccactagactgcataaaacatgttataattgagagtgcagatgttgcgggagtgaccccctgagccacagggcacccatctgagaccgtagccccaagttgaggattctgcctccaacattgccctcacagccatctggagactcaggcctggcctctacttccaaatttgaatagcaagttggagtcctctcatctttcagaatcacttgcttttccttctgtaagtgcttttgaaatgcttaaaaggttgctcttgatgataaccatcactctcctcatggatgaaggtcaaagaaatgtgcacccccaccaggaaatatccttagaggggattttcaggctggatttggggcctctgtagtctgagagggaaggccagactctcctgctattgatctgcatcacaaattgggtggctctagatccagtgtggtgagtggccatagtctgtgcgctgggaaaaaagagggctcaggatcaagttaccctggtcttacaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggaggtattccaatgacaaggggccaggcctgtgttccttcttgttccctaataatgaggagactgtttattcaccaaatatttgttaggttatagctaaagccttgatgccagtgggtttatcctctcactcaggagagagggaccccacattcataaccacactacagtgcaacacattgacgttgtaccaggggctccgtcaggatagactcagcagcttggaggaggaaagggtcattctgactagggtgcatgcagacagctttgtgcactgaaagaaagaagggagttgacagtcaagcagtggaagaagacacttcagagaaagaatggcataaaagccagaatgccatgaaaaccagaaccatggcaaaagtagctctgtggatttaggtagcacaggttgtgtgcaattaggtataatttaacaattggggcaggttgtgcagggctttaatgccaggctaaggagtttaaacctgtaattgagataacaaggattcagtgaaatcttctaggattggaaatgacatttaaaacaatattttattttatttatttatttttaggagacagtctcactctgttgcccaagcaggagtgcagtggctcaatctcggctcactgcaacctccacctcccagattcaagtgattcttgtgcctcagcctctcgagtagctggaactacggttgtgcaccaccatgccaggctaatttttgtatttttagtagaaatggggttttgtcacgttggccaggctgatctcgaattcctggcgtcaagcgggaggcctcctcggcctcccaaaatgctggggttacaggcgacagccaccccgccccgccataaaacagtattttagacagccacggggctttccccctagcaaacctatactcaatctagaatgctcagttcaagtgttaccccttcctgaatgttcattgattgacctgtcatgggccattgaccaggccttcccagggctcctgagccctctactaaggcctttcattcactgttttatatttattattttgtgagtgctttttgtccgtagactcctttaggttgtcccatcttcatgtgcccaagattgatcagaattactgatacccagtagcaggcaatgtgtgtgctgcttggatagctctggtgtaaggactccagctggagtggcactggtgggactggaagagaggtgataggtggtatgagattgtgaaggaaaacctcttaggacttaggaaagaagcacaagagaagggaaaatggtcctgaagatgcttttctggcttctattgattgaagtctagaagaagcacaggtgaagacagggagatggtttctcattagacaccttggatttgagctggcagtggaacactcaggtagaaatatttgggaggaggttggaaatgccagactcacaaaacggaaacacaggctgaccatatacctgaatctttttgtctttcagaatggatttctgcctgatcctccaagaatacgttacaggaaaaaaaaggtgattattacatagctttatacagcttcttgtcacataactgatttagcatgcacaaaatcttattttatggggtctgaaattgggtaggaataattaagctttcaccttcttcactactcaccttaaaatactttttgcatgtattccttcagagtcgctaatttgaacactaaatgtatataaagctaggtcctgtttggattcaaccatttcatatgaagatgataaggagccatcagaatatacgtcctgggagtgttttagcaatagatgcagatgtcttaagagtgtccaagttggaaagtcaagcatggtcatgggatacataaaaatatttcatagtaaggtgagaggatcaccttcaactcaaaattcagatttttttcattgaagttactattttctaactttagtgaaataggatggagcagatatttgctcacatccatttgagacatgcatgaaaccatatatcatttaatgaaatcggcaacaaaaagaatatttcttttctgatccttcacattctctttcaccttccaaaaaaatgtacacacagacacacagaatgtcttctcaaggtgaaattatttcctgttaccacaatggtgccactgaggaggaagatctccagaggcaaatgtattttataggaggggctgaccaggaaaatcttttatgttgatgccacctctttggctctaccagagggactgtgcagacctgctttttatctgtgaaagtgatttttccctctcttgaagaatgcaacaaacaaataggttaagtgcagtgtatattcaggacaaggtgatggtttttccaagactgggtatgaatgagaacctgaggagggggaagagaaaaatgtcatccttatgcacttcaggtagaaatacgcattcaagacattcacagacttctaaaacagctcacacatagctagccactaagcttcatattccactgggaacctgagatgcaggcctttacattatctgatatactggctgatttgaattttcagccactgagacatttcatccactgggtttcccgaagggaaactatgatgtcacctattcagtgactacactaaagaccagcatctctacctttcaccgggtgccaagagtaactgagtctggatgacccaaatgagctggcaatttccgactaaccgactctccctctattctggggtgcaaaacttagcagcgacaaggtgcagttgcctctatatgttgtgtctcctcatgggggagaacagaaggtcccttaagtggcagatccaggatccattatgaactccatgggtcctctgtgcctctcagagcttctcttacttgcagagccatttggctttaggaaatttcagtgtcactatgagtgccacatgatagcatctctgctcatgacaagggccacatagaccttttggtggcacctgagatattgtaaagcaatctgatatactcacccagaataattgttgtatgctaatgtttgcttaagagcctccagtgatttctaagtgaatcaacattcatttattcacccactcaacatataattatcaagcacacactaaatgccaatggacattacagaagattgacctcaaaaattatttcaggccaaacatggtcacttgagcctataatgccagcattttgagaggctgagatgggagaatcattggagcccaggaatttgagaccaacctgagcaacatagtgagataccatctctaccaaaaaaaaaaaaaaattacccagacattgtggtgtacacctgtagtcccacctactcaggagactgaggtgggaagatcacttgagcctgaaaggtcaaagctgtactgggctgtgatttcatcatagcactccagcctaggtgactgagtgagactctgtctcaaaaaataaaaaaagttttaaatttattgtcaacatggatgaattacaaatggggtggggtgggagattctagaccagttggagaggcattcagtgacaaggtcatctctcaggtgcttgtcctttgaatcacacttgtttatggcctctgtgccctgggctacagacaaaagctgaggctgcttgtatcccagaagggaaggatgccaagtcatgccatggatatccaaaagcaatctaaataaatgtagtgggttacctcttaaaagtcagtcaacctggcatcttcttgtgatttggatagaagggagagggagagagtttcaggaaaaagagctgcagcacagaggaccttggaggcattttatcaccagggctgtgtccctaggggagctgcagaaagcagtgctcttcttgtctgggacacttgcatggcctctaggactctgagtcctgtggtcccaggaggctgtgggagataagtcctcagcctgattattattgaggctcctctgggtgggatgacacaaaggccaagtttaggaaatatgcctgagggccccttgaagtaagaggacaagtagagcttctctgacttggcctgtgcaaactaggtccagactccctgcagggaatgggacttgcattgggattaacggtagtacttgcacactttttattctttcagtagatatataggtccaaaaaatcagatatgaggtaaagggaagactgtttacaaaaataaaactttagacaaaataaaatttatagcatttatttgagcaaagagcaattcatgaattgggcagcactcagaacaaggagaggttcagagaactctgctgtagcagcccagacagtgaggccaacacaggagtaagacagagaaactatatttaatgggttatcatagaaagatgataattagaggttagatggcagattctagttggtaaaatctctagtttcattttactgtttacatcaggtttcagtttgcttacttagaaacttaaaccactggagccaccccagcctactggccttctctcttcccaattattttttaacaactggttcctgaatcccttcaaagaatactatttaaatttaaataagtgatagatggaaacaatgcattcaatatcataaatcaatctttctgttttttcaacagagaatactgaagtctcaaaacaatagctcagttgacccttgtgtaagtacaaattctgaactacgacccccagaatattccactcctttctccaggcatatgttctgtgtcatgactgctgttgcctgaatcatgttcagtctcagctggagtatgtggctgtgtgaattcagttgcatcacccaagccaggtagatgtgcctgggccttggatgtctcattatgaaagcaccctttccatctgtttcagtagaaaccttccaatgtccttatttcccctggaaagtgagtatgggaggctgagctccagaccactgaggtctcttgagacagagcctgaagtggtaatgggtagggctggcctggtgattagggggaaggaacaaatgtgagaggataacagcattttcaagtaagtggtgtggatgaaagggaaagtcctaaaaatgcactccaaggtgcaggtagagttgaagatggtcataagcatcagccagaaggaacagaccaggccaagctattatgttccaggtgttgatcctgtcattagccctgtaaaggagtacatacaaggcaaggggtcctttacagagctcatttggatggtttcagggaagccattagggtgctgagctggttaggactgaaaccatcacgacctagcaaatcctgaggcattttaactcaactgcttatctggtgctcagtactatgcaaactttctgatgccacaggccccatccattctctgcttgctatatgactgcctgctttggattctgccaaaatcatggatgagtcccttctctaaatgaaatcgtgatttgattcttttcattgcagtgagatgtctgttttaggccgggtcaccttcttgcacaactctgggggacagcactcacatagaatatcatgcaatagcactgacacatgatacttaacagaggagggatgctcaaatagttttatacacaccttacctccaaagcagtcctccaatcagatttaggtcttttccacactgattttgatgtctggccaactgagggacttttcaataattaaaacagccctggaagtcagtgtttgtgtggctgattttggatggactaggcatggaggtttaggtttcacagctcacagccagatatgtgtggggagaagagggaaacagttccagcaaaggtatggtcacccctgttaataatttttccaaggccagtaacaacattgacttataatatccccatgcgtccataaccagactttgcttaggttgaatctcatattgtcctgcagcctggaatcacttgaagagctttaaaaaaatattgtttcctggatcccacttctggggaaattataatttaatcattctggactatgtatgactggaacattaggatttgtttaagatccccagatgtactaattctgatacatagaattgcctattctgtcacctaaagaagaataccagtgcctgtgcctcaaccctgacccagtgattcagaatctctggtgttgggttcaggacattagcattttatatactctcctgagaggagtctaatgtacagccaggccaacaaccaaagaaccagagaaatcaaatctcttcttgaaaagatgggtttggagaacaaaatggcagataggaggcaggactaacttgctcctcctactcagatggacagaacagcgtgttgagactcacactgtgaacttttgctccaagaaccactgcaggaatataccagcaaaactgaaggaagtcacacaccctttaaaagaagtggcttgccaccgcaaactctgggagatagccaaaaaaccgtgagtcctcaaagtgtgagagggaaaaagtccacctctgaacacatatcctcactggggaacctggaaatccagatcacaggagaaggatttcacctaacctagagctgaaatgaatttagaaagctgggtgaaatataaaagtagaataagcagcaggaagaggtgccttccccaaggatccctataagcatttcagtccccagggaagccatttctgactttatctcacagtccttggggagggcagccagtacaatttgcagagagccatggggagaaggaggcttccagctgaactttgtaataattttaaccaagcacaaattttcctggtcagaatctgggggtgtgaacctgaagtacagatataagtgcagaagccatggcaggcagggaggggtgagatctgaaagccctgcttgctttctcaatgggggtgcttcttcctggggcaagatcttagctccaggcaaaggatgcctggatataaatttggctctgttggctgttgggcaccacagcgggagtgagactggccttgctggctgcctgggtgctgggtgaagcctgtcactgccggcttcccttacttatctggtgaactgtatgaagcagcagaggcaggcataatcccctctggaacataaatccattggcctgcaagccacccctcatcccccacagtggccacagcaagccctgtctgagaatctgagctcagacacacctaaccctgcccccagctgatggtctttctctacctgcccctgtagctgaagacaaaagacaggggctcatgggagctctatgacctcacccatcacctgagaaaaccgaatacttatccagtgaacttaggtcaagcttgtatccccctcatattacttgcagctgatggtctcttgaaagtgccacctcctcgccgaaggtcagccaactcaagtcattacagacactcatacgagaaccaccttgctccaggaaggagaaaacaacaactaattatactgcctgtaacatcctggctaaccaaagatcctgagtctgtccctgtaacaacctcactgctagcataaccaacatttgagaaaaccagtgtactaaacaaaactacaatcaaggactctcacagaatccacttcactcccctgctacctccactggagcacgtgctggtacccatgactgggagaactgaagacagatcacatcacaggaccctttgcagatactccccagtaccagcccagaacccagtagctcttctgggtggctagacccagaagagcaataacaatcacagcagtttggctctcgggaagcccatccctaggggaagggggagaacaccacattaagggatcaccctgtggaacaagagaatctgaacagcagctcttgagtttcagatctttcctctaacgtagtctacccaagtgagaaggaaccagaaaaacaattctgataatgacaaaacaaagttctataacacccccaaaagatcacgttagctcaccagcaatggatccaaaccaagaagaaatctctgaattgccagaaaaagaattcagaaggtcaattattcagctactcaaggagacaccagataaaggtgtaaaccaacttaaaggaattaaaataataatacaggatatggatgaaaaagtctccagagaaatagatatcataaataaaaatcaatcacaacttctggaagtgaaagacatacttagagaaatacaaaatacactggcaagtttcaacaatagactagaacaagtagaagaatgaactacagaactcgaagacaaggctctggaattaacccaatccaacaagaaaaaagaactttttaaaaatgaacaaagcctccacgaagtttaggattatgataaatgaccaaacctaagaataatttgtgttcctcagcaagaaatctaaaagtttggaaaacatattcgcgggaataatcaaagaaaatgttgctggcctttctagagatttagacatccaaatacaagaagctcaaagaacatctggaaaattcatcacaaaaagataatcactcaggcagagtcatcaggttatctaaagttaagatgaaggaaagaatctatgaagcaaaaacatcagctaaactacaaaggaaaacttatctaatgattaacagcagacttctcagcagaaaccctacaagctagaaggctttgggatcctatctttagcctccttaaacaaaataattatcagccaagaattttgtatccaagaaactaagcttcataaatgaaggaaagataaagtctttttcagacaaacaaatgctgagagaattcaccactaccaagccagtgctacaagaactgctaaaaggagttctaaatcttaaaacaatatatcaaaatataccaaaatagaaccccctaaagcataaatatcacaggcctattaaaaaataacacaatgaaaaaaataaggtattcaggcaacagctagcatgatgaatagaatagtacctcacatctcaatactaatgttgaatgtaaatgacctaaattcttcacttaaaagatacagaatggcagaatggataggaatttaccaggcacctgctgtcttcaagagactcacctaacacataaggactcacataaacttaaggtaaaggggtagaaaaagatatgccatgcaaatggacaccaaaagcgagcaggagtaggtattcttacatcatacaaaacagactttaaagcaacaacagttaaaaaagacaaagagcgaccttatataatgataaaaggactagtccaacaggaaactagcacaatcctaaatatgcacctaactgtggagttcccaaatttacaaaacaattactcactttgggaggccgaggtgggtggatcacaaggtcaggagatcaagaccatcctggctaatgcagtgaaaccccatctctactaaaaatacaaaaaaaaaaaaaaattagctgggcgtggtggcaggcacctgtactcccagctactcaggaagctgaggcaggagaatggcatgaacccaggaggcagagcttgcactgagccaagattgcaccactgtactccagcctgggcaacagagtgagactccatctcagaaacaaaaacaaaaacaatttctactagacctaagaaatgagatagatggcaacagaatgatactgggggacttcagtactctgctgacagcactagacaggtcatcaagacagaaagtcaaccaagaaacaatggacttaaactgtacactagaacaaatggacttaacagatattacagaacattctacccaacaactgcagaacatacattcttttcatcagtacctggaacattctccaagatagaccatatcataggccacataacaagtctcaacaaatttaagaaaattgaaattatagcaagtactctctcagaccacagtggaataaaattggaaatcagctccaaaaggaaccctcaaaaccaggcacgtacatggaaattaaataatcttctcctgaatgatcattgggtccacaatgaaatcaagatggaaatgaaaaaatcctttgaactgaacgacaataatgacacaagctatcaaaacctctgggatacaggaaaagcaatgctaagaggaaaattcatagcattgaatgcctacatcaaaaagtctgaaagagcacaaatagacaatctaagttcacacctgaaggaactagagaaagaagaacaaaccaaacccaaacccagcagaagaaaagaaataacaaagatcagagaagaactaaatgaaattgaaacaaaaaaaatacaaaagatatatgaaacaaaaagctggttatttgaaaagataaacaaaattgatacactattagcaagattaaccaagaaaagactagagaagatccaaataagcccaattagaaacaaaatgggagatattacaaccaacaccacagaaatacagaagatcacttaagtctactatgaacacctttatgcacacaaactagaaaacctagaggggatggataaattcctggaaatatacaaccctcctagattaaagcaggcagaaatagaaattctgaagagaccagtaacaagcagtgagattgaaatggtaattaaaaaattgccaatactagaaaggccaagaccagatggattgattcacagctgaattctatcagacattcaaagaagaattggtatcaatcctactgaaaccattccaaaacatagagaaagagggcatcctccctaaatcattctatgaagccagtatcaccctaataccaaaaccaggaaagggcatagctcatgtcaacaaatgtgatataccacataatcagaattaaaaacaaaaattgtatgatcatctcaataaagacagcaaaagcatttgacaaaatccagcaccttttataattaaaaccctccacaaaattggcatagaggggacataccttaaggtaataaaagccatctatgacaaacccatagccaacataatactgaaatggcaaaagttgaaagcattccctctgagacctggaacaagacaaggatgcccactttcaccacttctattctacatgatactagaagtcctaggcagagcaatcagacaagagaaggaaataaagggcatccaaatcagtaaagaggaagtcaaactgttgctggtcgccaatatgatcgtatacctagaaaaccctaaggactcatccaaaaacctcctagatatgataaatgaattcagtaaagcttcaggatacaaaatcaatatatacaaatcaatagcactgttatatactaacagagacaaagctgagaatcaaatcaagaactcaaccccttttacactagctgcaaaaaaataaaatacttaggaatgtacctaaccacagagatgaaatacctctacaaggaaaactacaaaacactgctgaaagaaatcacagatgacacaaacaaatggaaacatgtcctatgctcgtggatgggtagaatcaatattgtgaaaatgatcatatggccaatagcaatctggaaagtcaatgcaattcccatcaaaataccatgatcatttttcacagaactagaaaaaacaattctaaaattcatacagaaccaaaaaagagctcatgtagccaaagcaagactaagcacaaagaaaaaacttggaggcatcacattacctgacttcaaactatactacaaggctatagtcacccaaacaacatagtccaggtatgagaatataccagtacacatagaccaatggaacagaagaaaggacccagaaataaagccaaatatttgcagccagctaacctttgacaaagcaaacaaaagcataaagggggaaaggacaccccattcaaccaatagcactggcataattggcaagccacatttagaagaatgaaattgaatcctcatctctcaccttatacaaaaatcaactaaagatggatcaaagacttaaatctaagacctgaaaccatataaattctagaaaataacattggaaaaactcttctaggcattggcttaggcaaagagttcaggaccaaaaacgcaaaagcaaatgcaagaaaaacaaagataaatagatgggatttaattaaactaaaaggcttctatacagcaaaagaaataacagaataaacagacaacccacagagtaggagaaaatatttgcaaactatgcatccgacggaggactaatatccagaatctacaaggaactcaaagcaatcagcaagaaaaaatcaaataatcccatcaaaaagtgggctaaggacatgaatagacaattctcaaaagaagatatacaaatggccaacgaacatgaaaaaatgctcagcatcactaattatcagggaaatgcaaatcaaaaccgcaatgcgataccaccttactcctgcaagaatggccataacttaaagatcaaaaaataataggtgttggcatggatgtggtgaaaatggaacacttttacacttctggtgggaatgtaaactagtacagccactacagaaaacagtacagaggttccttaaagaagtataagtagatctaccatttcatccagcaatcccactactgacggcagcggcaggcagtctgaagtggctgctgccatgaagctggctgcagtgaggtgcaggcgctggccgtgggtcttagggggcagacacagaggcaggagatccccagagccagttgccctgggagccttcctctgggagccgctgcaatggggctaggcccagctgcccgtagggcgtggtcaggcagggaggggtgagcagagagaggtcccaagatggagctgggccagtggtggttcggcacttgcacacgtagcgtgggggtcgggcccgaacgcggagcagtggccacacttcaggggccggggtgggaagtgggagtggcgcccacttccaggacccagccagcaatgcggcccctgcacccaccctgcccacagcgccaggttcccgcccctcacaggaggctgaacaaagggccgccagaggccgtgtccctaggatctgccccgagttagagtgactgctgtgcctggtgctttcagcagctgagactggggaggcaatccggtcctggaggtttcccccaggcagggtcacaagccaggagagggggtgccccaagccatccctgagccttggggccacaggaggaacttgagccaacatcacccctgcaccagatgctggcctgggcctggcaagggctggagccaccaacccaggctgcaaggaggcagacagggcagcaggaacggccagaggagcagcagtggcagcagtgggtccctgtgccctgtgtccctgaggcagggaccctcaccctcacacagccggcaggacctgctctcaggcccagagcctctatcacagcctggacctctttccccactgcatcctgggaacctgcaagcacctggccaaaggtgcagccgagactcacagaactggcccctgagtgtcaggttcctttgtgtgaggttggctggggcactgtgccacctgcacctcatccacaactgctgcaggagacacagagagggggcatggctgaggccgccccactctgcagagccaaggacaagcaggagccctgcctctcccaaattggcagggcaggagctcgccatgcgcaactgcaggtgcccaggttgcagctgtaggcctgggcctcccagtgctcttgggggcccaggaggctaccctccacctgccagaacagaagcttctgctgcctggccattccctgctcccagcacctgctgcaatcttggagcagggttggggctgagcccaggtgcagttgcagccctgttgggtgtgcacatgcttggggcagagctgacacaccaggcccctgctgcctgcacccctctggattttgggtgctgacgatcataggagagaggccaagaatgggctggggccagctcagcactggcctgcaggtgcccctttgggcaaggggcctgggcaccatgggtggtggggaaaggcagacaggctcctgggtgggaaggggcaggtccctggtgaggcaccaccttcaggcaagagagggcctgaaggctgggaactgggctgccaatcctatggaccagagtgggaacttgtaatgcctttcaaaggcctgctcatggtaacccatggaccaatcagcatacacttcctcccctctgaagcccataaaagctctggactcagtcagacttggagagaacatcctggacaaccagcagcagagaagagcttcacactccagggactacctgccagcagagagaagccacccaccctaggacctcctcctctttgctgagggctgaacactcgtcaggacacattggctgcagaaaggagctacccacagtgggtctctgagctgttctactgctcggtaaagctcctcttcgtcttgctcaccctccatttgtcagcgtccctcattcttcctggttgcaggacaaaagaacttgggatctgctgaatggtgaggctaaaagagctgtaacacaaacagggctgaaacatgccccttgatcaccgcattgtgggtgaagagaaggagagaagagctgcagccctttggggagcccagacctggaagctccctgagccagggctgtgactcccttttggaggctctgaggttcctggcatcttcaagcttctaggtgccagcacatcccctgttgccagccatggaagctgtttgcagtgtgcctggtccagacacagccttgcagagagccagtgctcatgccagcacctggagttgcctgcccttatgcaatagcaggcatgtctgactgtatgcagtggctggaccccatgcttgctcacacgcctctcccactccatgcctgacctgccccatggcaggcccttggtaggtatgcgatccaggccagtagcctgagccaagtgcagcctgccaggccaagtgggtggaaggagcccagtgggcctgagcaaaactcaggcaaaggcacaactgcttacagaggtttctggcaagaaaaagcaataccccaaggattccgtaacactactgggtgtctacctagtggaaaaaaagttatatgaaaaagacacttggacatgcatgtatatatatatatatatatatatatatatatatatacacacacacacacacacacacacacagagacacacacacacacacaccatggaatactactcaggtataaaaaggaatgaaataatgacattcacagcaacctggatggagttggagaccattattctaagtgaagtaactcaggaatggaaaaccaaacaacgtgtgttctcacttataagttggagctaagctatgaggatgcaaaggcataagaatgatacaatgggccttggggactgagagggaagggtggaggagggtgagggataaaagactacacattgggtacagcgtacactgctcttgtgatgagtgcaccaaaatctcaaaagccaccactaaaaaaattatccatgtaaccaaaaaccacctgttcccccaaaactattgaaataataattttttaaaaagattaaggattcgacatacttaaacatttggtacttcattccctccctagggttttggagatggtggaacacacagcatctgacactggacagatgagattgacagcagtgtattagtcacatttactcggtagcccggtgggggtgggcaggcatcccacgccacgcagggccacatgggggctgcgctcaggaacagaggaaacagccagtggctgtggagggcgggctgtcccctgcttccagagggagagtgtgattggcttgtttgaataattccatggctggcagggaaatgaaatcagctattcaaaaatacgcagaaggtgcaagcggtcctcttgatcagaagtgttggtaggaaaccttacctgcagcagcagagccggcggaggacttgtagatagaccattctaggccctcccagtgttaccagatgtccaggctgcacataatattgaactctaattttagtccttacagcacttttcacttgaacggcaaagggctcagtcacagactggttctttgttgtaaatacacatgtatttgtctacaatacagcatgtatgtattggtctctatatttgctctataaattctgttggtttttaatgaccgggatttgctccacaacacgtggatgcaaataccatcatattttaatttccccaaatgaaattaaatctggctaaaggtgtcacatattgagacttgtaagaaatggagaattcgttgatttaccattccttttatagaacaaagcaccagctcttttatgggcccaggaaatgaggtgagggcctctgtcttcaacactgtatggtgctgttaccattgtccttggtcatcagagatggcaccttcgcaccttacaatccaagttagctaagtcaagggggatgtatgccaggctcccagagctgaagagctctgtgcttcctggggcccacctggtcatctccacccacggtccttccccctcagaggtcggcgtagagccctccaggcacaaaacgtacagtctaggaatccctaactaggccctctcttcaactcatggggaacttatggccaagaatatgggatgtggtgatatctcagaagcttattccatcatatgtaattagctaggtctccttttcactagttgatttgtggtataggcaaattgatttaacacttcatttcaaaacctggttttatctgcagaataaggaaattattcagattcctataaaatcatcatcttgctttgttgctagtctttcttcattacaatctctggtttcataaggaagacttttcaattctgacccataccccttcctcctgaacttcactgcagaccaggatttgttctgaaatctccatgccatgtttttccttcatatcccagggagaagcatttgcctgtccatgcaggttcacacaaaggcagtgtgttctagttgcccagagggttggccttcctgaatcttgcggttcccagtgacgtggacactgttttatcttctagatgagaaacctggatgagtgtgaggtgtgccgggacggaggggagctgttctgttgcgacacttgttcaagagtcttccatgaggactgtcacatcccgcctgtggaagctgagaggtaagtgacatgcaggcgtctctctttttgtcctttaagggatcttccacctgccatgcgcactctccagcagagtgccggcttgtgtctagatggggaaagagcaggttcatcgggtactgggacccagcagtgtgatccagagagcagtgggagacgctggcagcaggaggttaatgtcctctgtgctctcagggacacctcctctgatatgctgagggcagtgttggggacctttgcctacataccggcattgtcctttccttgaagttttgcagctgggtgggttggagacaagaaacaccagttgtttatattttgtgcttattcatacaagacaggaagcacgatctcattgggctgttggaggcccgaggtccctggggctgaaaacccagtttctgaaactcaggcctgacagacagggttccctgtgctcccagcagctcagacagagaaaggagagtccacactcacggtgacaccaccttcctcagacttcctgcctgctgctaccactgatgcgagggaaaggccaatggctggagaccccatgtgtgaatcttgcatactttgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagttctgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatgtaagtaacaacagcaacccatgattacaggctgccatgacattacctgaccctgaaatgggccctcgtgagatttgtgatcttaatcccacggggcaagagcacacgctgtcgttagttgccttcaccttgttgtatttctgctggattttatgggaatccacagaaggtagacactgaactatgctggtagcttttccattggtatatttgtcaccagattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaaggtaggtggctcttcctgcttccatttcatttctttccatccttcccctcattttctggtgccaagaaaaatttagtttccctcatcctgtaataagcttgcacgagcaagggttctggaagtgattgattggtttcagttcagaacttaagctcttcttagcaaagaaacagtgaatcaaaaggtgtccctgcaaccagaaccccaggtccctgagagctcctcccccacctgccccagaggagacaggagctcagagagagcaattgaatcctgcctgctgcagcatataaagaggagagaatttcatcttaaagtggtattgtgcttcttatctgctcccaatcccagaaatcccaaactccagattctttgcatgtgaatagaccatatcccaacaaggattgccagcaaggagtagaagtgacagagaaaggaacagatcagtgatcttaccttatacccttccactatctgaattgttgaaagaacctagattgcttttctaacccactgaaataagcaaccaaaggcaaagaagtaataatcccagctgtggaaatgatttcacttttctgccctgttaataagaaaggatcatgctggtaagaaacggaagttactcttagctgcatgagttttcaagtttaacctggttaatgtaacttagggtgtttaagataagtgttctacttaataatagtgtatttcacacttcaacattgttaagaaagtaaatttcaaatgtactcaccacaaaaaaatgataactatttgaggtgatgaatatgttaattagttcaatttaattattccacatagcagtcataaatcacaacattactttgtactccaaaatatatgccattataaattgtagacttacagtacttttttttttaaagacaagagtcctgatcattctcagttgaaaggtgtctcatgacgctaatgatgaggagcattgtttttgtctttattattttttcagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 2038 - DNA, 73391 bp, Homo sapiens
ccgagttcagtcatactgcaccagctgagcaatgcatggagtggacctgtaggcgacttgcatcgtcttcaacatgaagatagccacagtgtcagtgcttctgcccttggctctttgcctcatacaaggtgagcaatttgtgtgtaatctaagcctcttgccacacatctcaaagccctggggaagggacttttctccccctactcctgccaaaaaatgtttacgtatgcatgtataatcctgaaatgtcttgccagacacagagttctgaagatttatatatgtggctttataattatgttgttatctttagaaatggcaagtagtttgagataatctgaattttctaaccatgagaaattcttccattaattctttattaattcagaaaactgaatagattcttcttcatcttcctcttgctaaatgtatcaattcataatgcatattcttatatatgtaatagacatttaaaacttaattgtaaataatatatgtattttaatgttataggtataaatgaaatattttttaaaattcaatcatctgttcttattttaaagcagtggtatcttctagcttattttagtcttgtgttttcaaatgctaaatgggttgaaagcatttctcccaaagagtgagggacttttgtgggagctggaaggtagatttttatatttgctatttaaccctaagagaacacaaattgcctagacttacgttgctctgaaacattaaaatttttaaaaagagaaactcatagatagtctgaaatcatatacaaataatgcccattttcctaaaataggtgtgtaggtacaaaagagcctatgttaatgagagagtataatagcctgtgaccttaatcttaccttctgtcagatctctaacttttgcagctgtaataaggaggtagagctgccagaattcagaaaattaaattttatgtatatatcctataaatgtaatgctatattatagtttcaactataatatagtttcaaaattataattggtatagtattttgtgtgtatgttatattgtaattttaaaagggaggctggcatttattactccgaaaggaccttttgaagataagctattttgatggggttagaattcacatgagtattattttccaaagtaattgtaactttctgagtgattagacctttgtgagtatatatactaatctcctggtccagtgcccttcttttatttgccatgataaatcttaatgtgttcaaaaaccatttgcggttttacaacatattgtcattaaagcaatcaagatgctgcattaaatggattatttgttttgtttattaaatattttacatttccttaactttggtttctatattttcatcccagatgctgccagtaagaatgaagatcaggttagtcctgctttttctgttcattgaattcattccaagattcccaaagaaaagtggtttgtggccaacaccttcatgttaataatacaaacatattatactggtaggtactaatagcttttgttaaaaacacagaaacagatttttatgaatcaggacatgagcctctctctcacacacacacacacacacacacacactcaacatattaatgatgatggatgtctgcaagaggcaatttatcatgttaaaggagcattttaaaatttcataaacaaaaaataaatcaactggaaaactactattgttccatttaacatctcaacaagccatgatacaccacataggaagctgaaataaattttctagtaatcattatgcaaaagagggtggtctgtatcttgtatatagtcggtgtatatagttcatgtaatgaatatttattgagcatctcttagatgtcagaccctgtttgagatgctggggttatttttaagtaaacaaaatagatgaaattcctgccctgaaaattacgttttagtgtaggaaaacagacaaattaataagtagcttagcaaaacatatggtacgttaaataatgataaatgctaggagaaaaataaatcaggaggcataataggatccctgagaatggaggtggtatccattctcataaggataatcagggaagttctctctggacagacagtattagaataggaatctgaaggtcataagggaatgaaccacgaaggtatttgcagtttacagcaggccagacagaagcacctgtgagcgcagaggccctgacgcaagaaggtgctttaccaactcttaaacctcttttgtttgataaattaaaaaatcattttctactagaagttaaattttttaatctatttgaaagataggatgaccaattactcacacacacacattttatatatttatatacacacacactgctatgcatgctattaattcagcacttaaagcacaatcttaaatgttttgctgaatatgtggcaaaatttgttttatctctggccacgaacattaaaggaataaaaatgtgaaacagctattctttacgttgaaactctgagaaccatggttaaaatactctcttgccgtattttgttgcaatgattttttttaaagaaacttcttacatgagtgttctagagaattttatcatgttctctactatttcatctaagtttactgatagggagaggtccagaaagttcagtagagtagaaaataagctagacatttgggaatcagagagcatgctcacttggaagttttatactgggaaaaaagaaggatattatataaatatcattgtgtataaaaccatcattttctttttcagagtccgtgatgatggttggtgatttatggcagatactgtgaattttacactgctatttttcatagcattaacctctatttcactgaaaaatattttaaaaacaaatttagtgacttcttatatttggtattaaaggcaagaacacaaagaagtaattatttatttggaagcctttctaatcagagtttttggatactgtgtcagaaatgaaaactattgatgtagtcttttttacgatgctgtgattttggttattttccaagtttagtagcttgggttcctttcagcatgataaaagcatgttaaatgtcataaacatgaacctaaacagcagggaaaagcactgcagcaatctgcaaggatcttaagcatgcttaaatttgtcatcacctaagagtcattcttcaggcaaaagcaagctggtcagtgctctaacactgagatagggcaatggcagctcctggagggttttattataatatctggagatggacaatagaagacaacaaattaggcctcagccagtgagggaaacaggaagaacttggccctagagggctccagttttcctgggacatgctgagaaaaagagaataacagcaacagtaacaaaacaaaacaaaaacaggccagggactggaagttaccctgcaagtaaacaggtgctgaaaagtcatctactcaactcaggatgacttttggtctaaatatgcttctgtttcaaccctctctattatggtcattgaaagggtattccattttgctcagagaaaaactcaactgctgctttccatttttatggtcttttcctgtttcccaagagaatacattggataatttcataactcagaaaaatagcattgaatctcatcttaactaattaatcactgtgaacaaatttcttaacctattatttgggcctctgatgctcagtttgtaagaaagggagtctttctaggaattaagttctcatctaacagtgatattggagaagtccaatttagggattattcttattgatgcaactctttaatttttcttataagtagagacaaggtctcattatatttcccaggaggatcttgaacttctggcttcaagcaatcctcctccctttgcatccaaaattgctgagttacagccatgagccactgcacctggcctgatgctactcttttatgataagctttcaaaattatttagagctttattccaggattatcatgagtcgtctatatactttctataagacttacttaataagggatatattttcattacaaagaccccaggctcttctctgattctactatatggattttaggatcaattatattcatcaaggtaagcataacttgcaaagttggcatttgatactgtagaatcagagatcagacaggtctcaagatgcccagttattaatctgtgtccagaaattactactctgctactctgatggagtcactgtgtagctataataatcttagagatatttaagcatgccatccttagctaaatttcccagggctggtctgtgatatcgtttagttattctccttcaccattaatcattttgcaagtgctaccaactgcctaccatttttaagaggctagattaagtacatcattattcatccaggcaagtatacttctgttctacctaatgctgtatctatgtcacctagcaaagtatagtaatccaataataagtgattgctggctcattcaatgatgatcataaagatataggagactactggagttcaagaccagcctgggcgatgtagtgagaccctgcctctccaaaaaaaaaaaaaaaaaaaaaaaaaaagaaagaaagaaagaaagaaaaaacaagcacaaaacaccagatatagatataggagcctaaatagaaacctttaataaattttttggaacaggttgtgtttgtcagagttgaagcaaaagctttgtttatttgtttcctgatacaagcaacttgaagcagattaaaaaaaatcaaaacaaaaaacaacaaaaatccccttagattccaaaggcctattctaaagacctagtgaattttcactgggtacagtggctcatgcttgtaattccagcactttgggaggctgaggcaggtgtatcatttgaggtcaggagttcgagatcagcctgcccaacatggtgaaatcccatctctgctaaaaatacaaaaattacctagatgtggtagcatgcacctgtaatcccagctactcagggggctcaggcaggacaacctcttgaacctgggaggtagaggttgcagtgagccaagatcatgccactgcactccagcctgggcgatagagcaagactccatctaaagataaataaatacctagtgaattttctaaattaaaagggaatataacattttaaaatcatactttactaggtagcagaaatgcaccatattttaagctcctaaaaaagaatgagtgatgtatagcaggactttaataataatatttaatattatttattaatatttaatattgaatgaatcaaagaattaccacttttgaagatcattctactttccttttccccaccaattctattatttaaaatgtttcccctgtcctccttaaactttgtataacggagttattggtatttacaaaaccaaaagcccaaaacaaacatagtaggattttagttccaagggatgtgccaaaaaaaaaattaccagagagagagagaaagagagagaaagagagagaaagccttatgcaattattgagaaatttcctcagtacttccatagattcacaaggtttgattctgatggtagtgatagtagtgctgatgacatttgtggggatggtggtgggggtggaagtatgggtactttctaaaaaatataatacaaatttgaaaatgcaaaatggttaggcctctcccagaacctcggaagggggatgtgacagtgaagggccctgaatcttaagctttattagctttaaggtaagtctgcctgtgctcataagtcaaatgatttatcaagggacatgaagttcttttcagaaaataaaccagtctagaaacttgttttccagataaatataaccaagaaatccttttttcatttaacactgttaaaatttctaggaactgatatgttgcagtacagccatggggaaatgtaggcagacattttataatgttcaatgctcaaacaccttgcctcagtccttcagcaacattttcatattcctttcacagcaattactattggcctactgtgtactaggtattttatatgtgtcatcttagcatattccagtaataatactgacaatcaccagcaacatcaaaacaataataataaaaaaggaggaagaaggaaggaggataatttattaattgaatatctactatgtatcaggcattctttgagggctttacatacttaatcttcaaaaaaccttggaattgtgtgtgtatatatatgcagacatatacatatatctacatatatatatcaaaataaagcttgttttgatgtacttttagctaacacaacttttttggcattatcttaggaaatgtgccatgaatttcaggcatttatgaaaaatggaaaactgttctgtccccaggataagaaattttttcaaagtcttgatggaataatgttcatcaataaatgtgccacgtgcaaaatgatactgtgagtaaaggtttctttctttctttccaatgtttgagttaacagctagtctctgaactggtaaatgtattctttttctttcaagtgcatttttctaaaccgaaatggttaaataaaagtgctgagcagatcactctgacatttcccatcagataaagttggataattaccacccacctggaaagattttaataatcactcaaacaagattctgaaagcattccagagggcccagtgtcaataccttctgtagcactctatagtcttttgaggatgtagttccactttgaacttcctggttttggaaaaaaatgaatttgacaaagaaagtcagattccttgggcctgttaagacctgattctgttgcagcctagggactgagaagattggcttaagcataatgccagactctcccgtgacagccaaccagcagaaggacttaagcaaggtataccctgattctgtgagctgccagtgtctttagacacctagcattattctaggatgagatgaactaaagggtagattatagtttccaactccttgcagctcagaaagaattagtatcctggaagtttaccaatctctattcaatgcttcttaacttggtttccttctctccattgtcaccccaaaggtaaaagaaggcttgggttatcaattgcaaatcctcaaaccagaatgtcctaatttgtttttgaaaaggaaggttagcctcaatttctgaccactgtcaaaacttcaacagtggtagcaagccaatactgagcttacccacttaggataattatattacaattggctttttaaatgtcaggttggtgtgtgtcacaggatttaatttggggattgacgtagtcaatcatattgggataatgaagctcagatcgtttgatcatgcactgcttctagtgaagagactgtgagactataaagaagccaggacaagatttaatagaggatgggaggcctagggcaggttgaataattctttctttttttgaaagctgaatgtaaaccagcaggtatattatttattataaaattttcttcttgtttcataagatgttttaatatgagactgaaagtatgaatataataaatttactgaaaaataatgtaaaacaaaaatgaaatgccttaagagtctaaagacagtttatcattttgaagttattcaattattatttttatgacttacgtaaattatgttagaataaaatttttttttttacctggaaagaaggaggctgtgcaaagcataaaagctgtcatcagattcctaaagaactggcttatggaaaagaaaattgatttgctctgtgggtccctagatgttggaattagaaccaatataagcaggttcaatgtgaatattctctttcaaaaactgcattcaaaaaatggtgcagatagctttgagagttggtgaccacctggctgttggaagtattccaggaaggtagtctgttatgcagttaaagttagagattcttcctataataccatgttcgagatatttttcaatgttgaagggagatctggggttctgtgtccacttctgaacatgctaccaattttgacatgccaggctaggctgaggagagcagttaaaattaagtttaccatgttagctgttattgttaaaagttgagcaaacaatgtttaaactatgctatttcttgtccttttccagggaaaaagaagcaaaatcacagaagagggccaggcatttagcaagagctcccaaggctactgccccaacagaggtgagactatttggagccaacctgtttacttttgagaggatgtttgactctatttagagctatctgtttattccttaattactaggtcatacctgttttgaagccaacaacttaggagggagggaacatgggttagtccaggggtgggctaaatatctggtacatcttgtccataggcccaacccatgatccgactctaaaaacattttaggcactgacggaaactaagaggtggagtgagccagtgtgatgtctgccttccaaggccatcatttctcattcctcttgtcctgtcttagcccaaagaagagctttcctgggactgtagaactaagttcaaatcttagaattcttattgcttgtgtaacttagaaaatttatgtatctctggatctcaatgttttcatctgtaaaatgagttttagaccgaatagaaactaagttttaaaagccggtctcagggtttaacatgttctagcaggcatttgactcattctgtttcctttttcttttactcttttgctttttactgtatatgttccagtacctggagggtcctcctaattcaactatagttgcttgtttatatctattttgcagacagggactcaggctaatattttgtttaagaaaagtgttctctggtaaaaaaaaaaaaaggtcataaaacattaagaagtaagatagaaggaaggaaagaaactgcaaatttatcctactatataaaccatttcacttgataatttttttcacttagaaacatttttaaaatctttacaaaattataaaaataaaatttaaaaaataaaaatttggggtccagattggtggaaatatatatctagcctacaatatctcacaaatgggttactgacaaagctgggactaccaccagctattctaaccactactcacatcaccccaggtctcctatgcagtttcttcactaatttccactttcttttccttctctgctggccccaacacgtaattaaaataatcagtcaaggttagtacaccttaattacttataacatccatggtctaacaacgctgacatcttccttggcagtgttagccaagaacatctgagaacctcagcctccacagtaaacatagtctactaaattatttgcctgggctcaaccagtctcacttttaaaacaataacagacaccacaaaattgatccataattgaaaactctttatctgtagcaaaagagagctacttttatattctacaaaatctgtgggggccagaaaggtttagtggcaactttatatgtgtcttatttgtcacattcaaagagtggctcactttctaacatccattctcctcttcctcctctgtcttcatcataaaaaaatgatatatctatagtgtttaaaaatataaaatatgaggaaatgacaaaaaagcaaaatacacacaaacataccaattttaacaaacctatctaaaaaatatagctagttagatgtttccatatgtagacacaaatttattgaagtttaataaagtaggagttttaaaaaataaaattacagtcttaagaaataaaattactttttgttaatatattatgcctgagtcacacacacacacacacacacacacacacacacacacacacacacacaaaactgtaaaaaaaaaaaaaaccctctagataaaactcttaatagcgatgtggttcactacttaggaaactacttacataaccaagtagtaacttacattaagttaaggcagttaacatttggctgtgtgcctttcaaataagttctgtctaaatttttccttgtctctgtatttaaaaggattcatccaattataccatgtgttttttgttgttgttgtttttctctccactataaaacagaacaatgtgctgattttttctgcttagactccgcccatcagaaatcaaccctgctactccctctcagaataaggtgctctgcatttcaaggagtttcctcctacagacatcctctcactctctctttcatcactaattttcttttcactagtatgtcatcctttcatttcccgactctagtattccctccattaacaagtcttgttggtactgcctccaaagtctaactccttttctccatttccatccctaccatctcaatccagtcatccataatttctgatctctggtgttttggtacatgtaaagacttgtttttttaattgatgaattcattcattcaatgtttatcatgatttaggttgccaactttatagaatattaagttcacacgagtctgtgtgtttctgaggtccctcttttttcagattcatttattgctttaataactagtatggtaagtcccccttcttagttcatgttgttaaaggttgatgggacctatgcatagatatatggtttccatatacatgttagagataaaaataactgagtttataaaaacttcatcttgaatttggtaacccagtgtgtttatggatacaaagaatttgtaaattaattggggtaaaattgactttttacagtattaattttctaaactcatgagcatagaatagtttatgaataagtcatataattttgatctactttataaaatttacaaaatattcagatttttataatttttgttaatatttttaaaatgtgtaaatttattactattttgaatatattttgttttttattgtgttttatctgtttattgttgatatagacaaattctattgatttcttcaggttaatcttatgtcagacaacttttgtttttgttcttggtagttgatcatattacctacatataacaagagttttataatattcctttcaatcttagcacatctttctttcttttcttatataattggtaaaggatccagacttcaatagttaaacactagtgatggtaatgaacatcaaataatccccttgtctcttcatattaaagggaatacctctaaagtttctccattgaatgtaatatttatcatagcggtttttacctctacacttcagcaagtttggaaaattcctttctatttttagtttgctgaatatgtgttgcttattattaaaagtcttctttgcaactattaaaataatttgattttttagtctattaatataaataaatttctggatatatttcttaatattaaactattattattttcttagagtaaatcatactttataatatattttaaataaatttatgaatttggatactaatatcttaattagaaaatttgcaattatgttcttaagtaaggtgaatctccacttttatcttttaaataattcttatctggcttgggaatttacataaaattatcctaaggtgtgacactttagactctgactaaatcaggtggtcagcagatcctctcctcagaaagcaactataaagctagacaaaattgaccaaaaaccattttagcaatctgaaaattgatcagcagtctataccaatctgagaagcatttatcttgaaaaactgctgactttaggaataaaacgagaggtctgtgatgttcttgctcagggatattcccatttcatcccctggcttggttggcatggaggttctatacagggtacaaaggtcagcaaaggcattgccattgttgaagaaggctaacctaatttggagtaacgagcaaaagtcatacccagaggtgttttcagtgtaagtgataatcttcaccaagggtaaggaaaatggtctgaggttgcagtcataattgaagcaagtgtattcctggctgagccttcacacgtagttgaaagagcccaaagagggtcaagagattcgcaaactcctaactgactataaagctgcgcatatccgcttaataaacacaaaatgtcccagtgagaagcaaatgctggagtagatgcaaaagtggcctgaactttgcatgccctcccctgtacacaaaggtctatctgagagggtgaaagcattgttagcttgaagtatttgaacacaaactgtgttaaatccttagctgaccattaaactacaaaaacataggggaaaaacataggaagccaggcttaaaaaataaccatgatagaaactatcattttcttagctgcacatcagcagctgcaattatgagagaggaagatttcaaagatttaatccagccacagaagcaaaaaaagaataaaaaagcagtgaaaataatctttaaagaaaaaattgtaaacctgagtacctatattatctaaaatgttgtttttataatcaaaatgttcagtttttataatccacgttagtgaggttaaaaaaatgtcagttttcaccaaaagttataaaattttcaaagtaacaagaatatacaacccatactcaagaaaaataattaatggagtttgtctttaactgtgtacagatgttagatgtggcagacaaagacttgaagcaactattaaaaatgtattcaggatactaaaaaaaatcatgtttgagggttcacaagaaagtataataacaatgaataagccgataaaaactttcaatgaaaagacagaataatttttaaaaagacccaatgaaaattctggagttgaagggcacaataactgaaatgaaaagttcagtagagaggctcagaagcagatttgtgaatccttaaaaaagggaattaccaaacttgaggaaagcttaataaaaactaacaatggaaatacagagacagacaatagagaagaaaaatgaacaaaattatacactttttgagacagcagcaagaaagccaacatatgcataatgggaataccacaaatagaggtgagagaaaaaggaatacaaaaattatttgaagaaacaatggcctaagatgccttaaatttgatggaaaaaaattaattttaacatttaagaaactcaatacaccccaaataggataaatatgaagagatccacatatggctcatcatgattaaaatgttgaaataaaaaaaaaaaacaaagagaaaatttagaaagtggcaagagaaaaatgacacatcctatatacaggctgtatacaattaaaagctggcccctcatctaaaataatgaaggccggaaggcagtaaaatgacatgttcagaatgctgaaagaaaaaaaagattaagcaatattctatattctcaaaagctatcctacaaaaattaaaacaaaataaagatattactgtactaaagaaatctgagagactttgttgttaacacaactaccttaaaaataataatgaaggaggtcatttagctgaaaggaaataactaccagatggtagcttggacctacagacagaaatgaaaagcaccagaaatagtgaaaattgagttaatctcttagcctttttaaaagaaataatcttaatatataaggcaacaattataatgctgttttatcaggtatatatatatatatatatatatgacaacaatagcataaagggtgatagagaaaataaagctttattaaggcaaagtttctctattttaccaggattaagtattattctgaagtggtttgtaataaattaaggtgcatattgtaattactagagtagctactaagaaaatagcatatataataaatatataacatcaacaaaggaattataaaggtgtactagaaatatttaacccaaaacaagatggtagtagaacagagaagcaaaaaaagacaaaagcatattgaaaacaaatagaaaagtagaaatgtaaatacaaccataaaagtgattatattaaacataaatggtttaaacatcccaatcaaaatgcagaaattgtcaaatgataacaaaggaactataagctatctccagtaggtgctccttagattcaaagacacaaatagttgaaatgataacagatcggtaccatgctaagtttaaccgtaagagagcaggattggctatattaatatgtgataaaatagacattaagacattattagagacaaatagggatattttgtaactttaaaagtgtcaatacgttaagcaatataacaatgataaatgtatacacacctaatagaggctccaaatttatataacaaaaaatgctataattaaaagaaatgaaaagaaatgaagaattcaaaaataatcgttaggaatttcaatactccacttaaaatactgatagaacagctagactaaatatgaccaaatagaatacttgaagaatactatcaactaattcaacctaaactgaaatatagacagtgcttctccgttgattgtagaatatgtattattttaaagcaacagaggaacattttcaggatacactatatactaaggtacaaacataataaattttaatatattaaaatcatatatagtatttttttttaaccacaacagagttgaattcaaacccagcaaggaaaatgaatcgtgaaaatccccaaatctttagaaattaggcaacacacttctggataattggtgggttaaagaaacaatcttgagagaaattggaaaataatttgaattgaatgaaaacaaaaagacaacaatttaagacttactggacttgtctaaagcactttctagagatttaaatggcttaatcagaaataagagataggattcaataatttaatcctctaccttgagaatattagaaaacaaagtttagcaaactaaacccaaagcaagcagaagaagaaacatataaggattggagcagaaattagtaaaacacaaaacatacaaataatagaaaaaattaataaaaccaatgttggttctttgaaaagatcaacaaacctgacaaacccttagttttattttcccttcaagaaaagaacagaagacaaacattaccaaaatcaagagtgaaataggagacatcagtatgtgccctggagaaactacaaggcttatgatgaatattatgaaaaatattatgccaccacattaaataacttagatgaaatagaaaaattcctagaaataaccaaattattgaaaattgacccaagaagaaatggaaaatcataatagacttacagcataagtaaagacattgaatcagtaattaaatttaaaaaaatgcccaagagcagatgactttattggcaatttccattatatactgaaaggagaaataatatgaattctttacagattcattcaggaagaagagacactttacagctcattatatcagtccagcattattctgatacaaaatgtagaagacatcacaaaagcagaaaactactgacaaatattcctcataaacatagacagaaaaatccttaacaagacactggctggcaaatgaatctgcaatatgaaaaaaataaatcattaccaaataagaattatcccaagaaagcaatgttggtttgggaacagaaaatctattagtctaatacacaatattaacagaataaagggcaaaaccacatgattatcttaatagatgttgaaaaatcacttattaaaatccagcactcattcaagatgaaaactcacacaaaatattatcaatagaagtaagctttttcagtctgataaagaacgtctgtgaaaaacctacagctaacattataattaatggttagagaatgaatgctttgcccttaggattgagaagaaagcaaagggtggtttactgtcaccactcctattcaacattgtactggaggttcttagccagtataaggcaaaattaattaattaattaattaaagacactttttattggaaatgaagcaactgtctttaattccaaaacatgataccatatatgaaaagttctagggatccacaaaaagaaaaattactagaactaataaatgagtttagtaagatttcggtgtgcaagattaataatacaaaattgtatttctatatactagcaatgaacaatttgaaaattaaaatatttcattcacgatagcataaaaaatgtggaaatgaatttaacaaaatgagtacaagacttatacactaaaaactataaaatggtactgagaaaaatgaaagatccaaataactagtgagataaatagtccatgttcatagatgagaaaactcaatattgttgagatggcaattttcccaatattaatcaataaattaaacatattcccaatcaaaatcttgtcagtctttctttttggtagaaatagagcagttgatcctactagttatataaaaaatattgagacatttaacagtaactgaatttaaattttgttataatgcaatagtgatcataacagcgtgccgttatttcaagataggcataaagatcaggggaatagaatagggattacttacttttatggtcagttaatgtttaaccaacatgtcaaggtaatgctgagaaaattgaatataattaattttaaaaaacagttttatcttataccatacacaaaagttaacttaaattttattttggcactaaatgtaaaagctaaatatatgaaacttctcatgtaaaatataggaggaaaaaaattcatgaacttgggtaggtagagtgactttagacataaaactaaaagcgtaatccatgaatacaaaattaataaactgaaatttataaaaattgcaaatttgtgtgcttcaaatgacaacaagaagtcaatgaaaaagcaagttatagactgggagaaaaatagtcacaacctatatagcaggtaaggacttaaatccacaaaacataaaaacctcttacaaccttattataaggagacaattcaattaagtatagatattacaccaaagatatatgaatggctaataagcacacaacaagatgcgcaacaccgttattatttaggcaaatgctaattaaaaccacaatggtgtatcactacacgtacccactagaatgattataatcacaaagacagaaaatgcaaaatgttaagggtgtggagaaactggaacacatatagtcagatcggggtaatatacaaggttacagccatattggaacacagtttgagaacttcttaaaattttaaacagattgaccatgtgatccagaaaattcagtcctaggaattcagtgaagtgaaaatacaggtccatagaaagtcaggcatgtgaatatttatagcaacaatgtttttaatagttctaaactaaaaacaatccaaatgtccaaatgtccactggtgaattgataaacaaaaggaatatatttatacagtgaaatattattcaacaattagaagggatgtgctactgacaattttgcaatatggatgaacttcaaaaacactatgcaaagtgaaagaagctagaattaaacaattacatatttataattccatttatatgaaatgtccaaaaagggcaaatttacagagtcagaaaaatgtttaatgattgcttgaagctggaggtgggggctggatatactgtacacaagcacaggggaatctcgtagggtgatgaaaatattttaagaccagattctggcgatggctgtacaactctttccatttactaaaaatcactgaatcactttcaatgggtgaattttatagtatataactaatacctcaataaagctgtttagaattttatttttcagttcatatgattgtaactgctttggaatgatttgtacattactattatttaatacaaaatttcctagaccttcagaaaaatagattataaagctattgggactgagttattttggggtgggaatatctcagaccaatatatcaattggattaatgtttattgacctgtgtaacaaatgtagttatcttatactttttcatagtcatatatgcaatttggtttttgtaatgtattagcatactgatactgatgaaatgctttcatcgtattaatgtctcaatatttatatggtagtttttaattatcattccatatatttttacttttcatattacttgtctctttggtcagtcctactagaaatcttttatatcaggttgtttgataatatactctgttgtttctgttttctatggtgttaattcctgtttctttatgtttgttcctgttcattttacaatggggttgaggaatactttattctttaaatttaatttttaaaaaatttatgacaaatatttttgaagatattaataattatacatctcaggatttatactttaagtatttctatttatcattattttccaaacacttcttaatttctctacccctaatgttatttagtaatagattatctaattttcaaatatgtggaacttttaaatattttatattagcttttaattttattaaattttggtcagagaatataaatgatgtagtattgattatttgttatttcttaagactttgtgacctcacaaatattctgcttttatgaatgttttatatattctttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctatatattcttaaaaaatgtttattttctgtttcttggttgtagttgtctataaaaatctaatggcttaatattcttttttttttacttaatatataaatttctgagaagtgtttgcttaaatctctaactccagttattgatttatttaagtctattacattctgtttgttattgtttgacatatttaaagtctatattattaggtgaatatatgctcatgattgttatactttcttgttcttgttcttgtcattttttacttcatatattgtccttctttgtcacttatgatacatttttggactcaattctaatttttaagtgttaatattgctgcatatgctctcttcctcttcatttttgtcttgtatatttttattatcttactggtttgatatttgcatgccttttcattttaatttttctcaatacatgggttcttttttaaacatcaaattaccaattgtctcttaatttgtaggtttagcacatttatatttattgttatttctgttatagtgagacttggttctttcatttttaaaatattttcggttactatatttagtagtttcttctttctagctttttttgggtggtgatttatttttgttcttattatgactatccctaaacaaatagccatacttttgattatttattctattgctaatatctgtgtctattgtcaatttctttgtcttctctccaaatgtatgttaatccactctccatatattttctgtaaatataattttgttattaacttgattttagcttaaaattcttattgcttttctcttttattctttttttgttaattatagaaattgttcctttcttcagatatttctttctatatttatttccttcttttggagacttctaattctattttaaatgttctttagcttttccttttttagaaaaattgtttcttatttccattgccttctaggagaattccttgatctgatcatctggttcacaagttcattatttatttgtacctatcccatctttattctttatattgctagatttattatcatttgaatattttccatatacaaaatttccactttgttcttcctttataacttctttcttgttattgttttacatttgtttatgcagatatcttctcttatctctccataacataattagacttgataaaatatttttctacccattccaatatttctacttcaattaatacatgttgtttagtatattctattttttacttgtcagatatacagatattcttattgtaatattccataatggctgtatttattttttctgctaaattcagttaggtagtgttcaatgtcaagcttcagtctgtagcccttctggtgagtataaggatagaaaaagagataagacccagtgctggaggttctgaatcccctcttttccactccagcttgctgccacttcaccaggtcaggaatctatctgtaaggtctcaggcattgtcaacattaggaagaggtgttttctgtaggttgtgatccaccacctaggggtttggaggggaaggagatggagtcatatatccttgcgcctgttttcatcatcccccagctggccttttgacttgctctgtcattcccctctctacacctgtgacctagttagtacgttgctgttgattttctggggaagggggatagtagtgattgttttgagttaattactttgatctgtaatttccctatgcttctgtagtatcttcaggaatgatttttgagagaaaaccaagagccatcctgctttttctttatgcttcggtcacatttcccttctttctgtccattccttaaaaaggacagtctagtttccaccacaaatcctttgcaattgccgttctctatgcccagaatgttcttccctcaaatgtttttgccactatatctaaaatagtccccattctggtcactattgtatttttctgtttatttgtgagagcacttactataatttatagttgttgtgcatatctgtctctttctatcagaatgtaagctccttagaatatgtattccatttttttctctctctctcttttttattttatattttctgtggcagcttcacagtccagaagagtgctaaaatgtagttaatatgtaataaattttgtggaataaatgaacaaatgaatgaatgaaataacttatatggccactgcttatcttattttcaatgtatttttaacttctttctaaacatatgaatagtggagtatgttctttagcttttcttttctattttcagttcttttccttctagataagagtttctcaacctgatcttctgtatcctacttttattctttatattatgtgacatactgatacatcataggtctacattctaagtgtttcatatttatcattaaaatgtctttattttgacaatgataacatgaagttgtattttgcaatgtgatattctaaagaaaaattatccagttttattatttggttttaggtaaaagttaaagtcaagttaactctatatcttttttagctaggttatgtcacaataataagttgccaaataatgtttcataagaattcacttgatccttattgcaaatctggaatgtaggtagggtgtgaatttccatttttctgatgaggaaagtgaggtgcaaagaggtgaagtgagtgggtggcaggtctgagacttgaacactagtcttcagttattactttgtacatttgtttttctttaccatcaggtttgttcctaagtgtatgtcacattattagaatagagatttgggctttctcctgccgtacctaaaagatgtttagtttacttggcttgtcagtagagaaaacattgaaaataacaacaacaacaacaataaatggttctgtgtcaggcactgttccaagtgctatacatgaattaacatatgtaaatccctatatagtcctgagagtttgacaaaattataaccattttgcacatgaggacactaaagcatagaggtgttaaataacttgtccaagtcccatagcttaagtggcagacttagaaatatgaaacaagcaatcctgctcttaattactattctaatctataataatagaaactttgctgtagtttatagtttacttagagctttcatatccgtaatctactgggcctcactactactctgtggagaaggcaggcaggattggacagacgaacaacatgccaagtttcagagtggtgacgtggcctacttcacccagacagcaagtggctgaagtaatactgaaattctttcttttgaaatctaattttatctgttcttggatcatgttttattgcccataaatttattagctcaatgtagccttcatgatatgtttttcttctccagcaatttacattattgtgggcttaaaatgttaatctatttatacatctaaggactattttgtttcttacattttgacgttccttgatcatgtcttttgcagctgaattgtgatgattttaaaaaaggagaaagagatggggattttatctgtcctgattattatgaagctgtttgtggcacagatgggaaaacatatgacaacagatgtgcactgtgtgctgagaatgcgtgagtattctctgaagtaggctttctccctaaaacgtgttctctctataattacatgacacaattttccctacagtctttaagctaacgattcattatgtgggagttagccattcctaaattattagtaccacttcttttactactcttaagacaaataaaggtgtatagcataacactttatattttacaaagcacttttatgtatgatttatcagatggttatcactttatgaagtagacagaatagggagattatagattatatgttcataatctataaaatgttatagattttatatttaaaatgtataataaaatatagctttaatataataaaacagatttaatattttaataaaatatagacttatgattttataatctataagttatagattatatgattatcatatataacagattatataatatatttacacacatacatacatatatacatatatatacatacacacatctatcttctatctatccatcatctattatctatttgtttatctatgtgtataccctttttcacagagaattatttcatcatcaaattatgtttattaagtgcttaataatttgtaatattagagtagataattgagactttcaatattaaatttcttcccatctctcaacatttaccaaatagctaaggcatcttactgtcctatatcttgtccctgttttgttctttctctaccttcaatgctagatttggttatcaattgtcttcaccaacaagatgacatacctgcttggcgggttctggcttgtgatctcaatcttgaattgtctggtcttaaggttttgcaaatatgaaaaccaaggtgtgtacaggctaatgaggggtattataattattcactttttgagatcctgcaagctttagctctccttgcaataaatattttcagcaaaataaaactgcattaaaacactctcatcttttgcaggatggtattttcagaaattcactttaaaattatgtcctcaactctcaccaagggtcaacatagagaaaccgaaaacaaacgtagatatatgaagaacacacagatttttatcagatatatattgtgtagcacaagtatgagcatgctatatatttaattcttactgtgtcttatgtggggaatcccattataaatctttaaatctctggtccaggtgaaagtttctctcccctaatttctggtatatttctttgtactatgtactttgtactatgcgatgagaatcatacttctccttgtgttgtttcccttgcagctctagctgctaggaggctctacaataaaattgaaaattttatttttatagtgcccctcagctgatatcctttgaaataacttttttcttatcacttttaaatatttagtttttttctttatattgtttttactaaatttttattgttttacagatgttatcattgtaatctgctttaactttttacaaattaggaaatatgtcttacatttgcggttctgtgttttcagatatactttaaaggtctacgagactgaacaaaattaattatcaagactttatgtactttctatgaaaaataaaatactagtcttcataacccaaataaagagtagtatagtgggatgttagataatacaaatttgactttgtttatttaaaacaacaaagttccttgggtgctgagtgttatctattatccagttacaagctttacttttccccatcttctgatgtggatccctcctctaaacaaaggttaaaaaaagatttctataaataacatttacaagtctgaatctttaccatctcttccatgttaactacatttctttgacttgaagttataaacagtgacttttattagaaaaagtaataaaataatactatgtggcagctgttttcgggagtaaaggagaatgacaatgcaatgtagagcagttaggtttgaatggtgggaagttctgtgatattaaactgctgtgtctactaacttttgattctaggaaaaccgggtcccaaattggtgtaaaaagtgaaggggaatgtaagagcagtaatccagagcaggtgaggtcaattgtcagcctgatgggaaatactgggaggctaacttcaaatagtaagtaggtgctctcctcttccttcttaggtgggagccttggaaggaattaattcttgctttatgtgaaatggaatacccagtactgcccactaatatgaaaaagctaattatagtctctgaaactggatcagattactttggtggttagatctttcaatctattgctgctttgtataaaaaaaaaaagaagaagaagaaataaaaaggaaactacatgtgtagtagaaagggcacaacacttcagtcacttagcctgcgttaaaaccccagcagtgtcacttgctgtttggagaccttggacaaattacttaacctaaaatgagatttgaactaaatagattttttttctatgatacagttttgtgagcctgtgatggtaggggaaggggaaggaagaaaggatctcatacatgtcacacttgtctttttccaggtgaatgattttcctaattttcaaggtctgatgccctttttataagcttccagagcacctgaggtgacttgcaccaagtcatttagcatcatgcaattttaaatgtctctttttatcacctaggagattgggagcaagttgatggcaaggactgtgctctgtctgagttctggcacatagtaggttatctgtttactaaataaatgaataaacaagtaaaaaagttttatatttaaccacatgaattatagagtacttactgagctacatctacacagctggtactgctctaagtggcccatagcaatgtcagagggactgagttcaataaaatttctgaaaacagtgttgtcagcattacaatcttggtaagtttcaagttcttttccctgttcttcaggatgtatgcagtgcttttcggccctttgttagagatggaagacttggatgcacaagggaaaatgatcctgttcttggtcctgatgggaagacgcatggcaataagtgtgcaatgtgtgctgagctgttgtaagtagcatcatccccaggtggacttgatgatgatgcacttggttgctgtcccgagaatcactcagcagagagataaaatccttttcatgaagcatgcaattctttgtctttacactgtgaaatagcctttctcacagaaaggcttcttttctttttcttcttatcattgattgaagtttcttaaaagaagagaataaggtggtcatgttagttattaaattcaagactctcatttcttttaaattacagtaatttgaaaatgtatagtgttttataaggcacaatattttaaaatttagaaagcactttcatatggaatgatctaggtcagtcgtctgacatccattgcttcatttgggcatatgtagagacccttcctgagtaatgtgaggctaattaaaataataatagtaataatgccatgtgtctgaatctatttattagcttaaaaagtggaacgcggatcattacaaaaggaagggctattgggttaatctttatctgagtgcctggcagtgcttgggcattaaagacgcagatgtggataagatctaattagtctttcatattctggctgttaaacaaggtttagactctctaattcacgtgccagcaaaccttaaattgctatatttacatcactggaactttaaaatcaggacagagatttaactgattagcaaacaaacgtcacacctgcctttgaaaattacagttagtccttgtagaattcaaggacatgtccaatcaggtttacaaaacagtgatgataactggtttccagacaggaaatcagcctgatttccactttcttatctaggagacatgttctctcaatgttcaaatctgccctaattctgtagggtttttttttctttttatgcattatgtgaaaaggggaatttgacctctctaactcctggtttcttactctgtggaactgagatagccacacctatctccggaatgagacgctaatcaaatgatagatgtgaaagggcttaaagctcaattcaaatgtagctttcattaacaacttagtacttttacatgaaagcaaacaaatactttacaaggtatacaaagttatacttaagggtgtggatggcaatgtctcaaatgctcagtttggtttcacccttgtcacagcattattttaaagctcttggttctgcctgttaaagggaattttcctgacaatcttctgtttgtcaatcaaggtgtcacacccattcagttttacagaacaaagcttctaattgactgtcagtgagtcagtttcacaccctttcttactataggcaagaaagctaatttacagaaagcaagtttcccagataagctattgccgtctttctttctttccttatctttggcaatttctctggctcaggcattgaagacggaaatgcttgtctcttgtaagaggatcattttcagcaattcgtagcagaggatatgaaagtgtttagcacaggactgaggatactgaaaatatgattgagtcataaactgaccaactgtttacttttcttaacagtttaaaagaagctgaaaatgccaagcgagagggtgaaactagaattcgacgaaatgctgaaaaggtaaaatgactcaccaacgcaattttgttcttgtggccatatttattaacaaatgtatgcctaaacctttgagtaatgaaataaagtcattgtcttttattattatatagatatttttcttaatatcaaaattccccaaattgactattcctagaatattaatcattagattcagatttaaaacagcatttcctacctaaggcccaaaatgtgcagtttccacctgtgtttctccagtcctctagcccccaaaagaagatataagatagaaagtttgtataaaccaaattctgcttaatttctagcagccttctttttggtttagtgtaaacccattttactctgtataaattgtttaaaattggcaatgaaatataaattaaacaggaataattttaaaatagtgagagtgttttaaacactatatccactagtgcattttatgtgcaattaaattgacacaagttgaagttattcactttgccattgtgattattctgttcagaaaaacctgcatttataaaggtcttgattctgctttaaaaaaaaaaaaagacaaatttttagaatgtgttttaaaaaaatccttaaaattatttttttgaaattacttgataatttaattattcaatctagtataaaaagttttgaataagcactttaggtaatgcagcctggatttcttaaatcacctactttcaatgagagggatagcagtttctttgctaaatggctaaccttttgttgagaagtcagaacgcctgagttttagccttggttttgccatgctctgggtgtgggagactaagtaaataatcatcctgggccttaattttcttgtcagcaaagtaaagaggttggataatgacctgaattttaccttcctgttggactgtgattctacatcctgcacacttttgtactaatacaagtgcactcctttttgcagatcgtagggcttatgttttcctaaaggaagaaacaagcccaccttttggtagtcaagagctagcccttcagttcgtaatgcttatttaatgaagcaaagctctcaacctaaatagggtattgaaggtttacatttaggaaaactaagtattcagaaccatctacagtttatgcaacacttgccaaggattgaaaaggaattcttttgtggtggttgttaaatttcagtctaaaactttgggtcatcctgtgatagttaacattttattacttcataaacacagagagttattttcctttgtttttcattaggtctctgtacttccctcttcctctctgtggctagggtcattgttttggtggggtcaccgggcatgatggtgtgaataggactgctttattgtgatggctcaatatgttccctataattaacttgtcactaggttgcaaacacagtgtttcttcagaatctccttggctgaatcacaacttataaactgaaattatcattgtttcttttacgagaatcattgagcattaattttttataccatgctatgattatcaggtgactgtcttctgcttctctatttctaggttgttacaaccatgaggtttggagcacatccattgctcctccaaaaataaatatcttcttaataggaagcagttaggattctctgttaaagcatcccaatggaatttgaattattttttaaaaaaccaaagaatgctagatctagaaaaggtcctacagagcatctgttccaaaaacctcattgtagaagtagtaactgtggttccaaaggagaagggactttgctgtggtctcccatttgggtgagagggacaatctagtggcccaggtcatttgactcctagccatgctctttatgcccatgttttcttgcctgaaattgaatgacgaaggtcacacagttgaaaagaaagttatagaccaggattttttgtaggtcatattatagtactatatctcaccacaaaatgtttaatgacatagagatccccaagcctagagtagcttagagtatcatttttttggtaaagtttagccctcctcacatagtagagttttcaaaacacagaaagtagcctgaaagtattgaaccaaagcatcaggaaatctgaaaacaaatctttcttggattttttttggtggggggaagtcactcctttttagcttttctaaatgagtatcagtcttgatgatctatctgtctaaggtgagggtgaaaggaaattagatctactctctctctacaatgtcagaaattattatggataaagaaggcagaatacacaaaaattatccacagatccatagagaaaatcaactaaagtaagcataacactgttggataacatcttgtttctttatacttacaaacttagctggattattcttgacttgatccatattaagtcacttttagacatctcatcttctcacaacttttttttctttttttttttgtgatttggctgctgcattttgttgtgtttgtgctggaacctcatgaaagatatcccctgacccctattgatctgaaagttaaaaagaaatacctagttttaatccaagaaaactcttggtcagccttattttttccgaggctgttttttatcttttaataaacctaccacataacagatacaagtgccaagtagttgacaatataattactgtttcttagtaatcctcattaatatgttgtatgtatttgccaacttctagacctgatgttttgtggtaataaatctattataaagtttccagattaaaacgtagaaaaatggtaaataaaattacttgttggctggatgtgttggttcatgcctataatttcaacactttgggaggccaaggcaggaagattacttgagccaaggaattcaagaccagcccgggcaacatgatgagatccagtctctaccaaaaaggaaaaaatttagccgggtgtggtggtgcatgtctgtagtcccatttagttaggaagctgaggtggaaggatctctgagcctagaggttagaggcttcactgagctatgatcattcccctgcaatccaccctgcgcaatgcagcaaaatcctgtctcaaaaaataaaatatcctgaaatgaaatgaagtaaaataaatataattgtcttttcaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttgtgagtatagaagtggttttttcagagtgattcaaagggtgggagtggagattgattggattgatgagtaaaaataactttgaaaggaagctttgttgttgagaaccatctgagcagttttatgccctccacaaatcataatgccacctagtgagcaggcactactgatgtttgtctatttctgaagagaaatggattccattttccagttgaaatattgacttacagcatagcacacttcttaacattcccctgtgactgtgacctatgtgaaactgtttgtgaactaattctagtatagaatgggggtaaaagcaggtaccacgacttcgattgtttttcttcagtaattatcccatggtaacagtgttgatgcaacactctcagatacttcaggtttatacattaattggattactcttatctttttatctgggacatatgaccttgggagaagggcaaatctcacaacatacaaattatcacatttatgaaaatgtcttagatgacatctcatgacactttcggcttctctagctctacaagccctttcctgtgtcctgtcctatgccagttcctcccggtcttggccagatgatgtcccctcctcttgtagattacatttcagattatctttccttggacaagaactcctaaagtccttccctaattgaaattaaattctcataatccttagtaattgtcttttctaaccaccatcacagttggcaattatacaattatttctccaagtttttgttgactttcagtcttttctaccagcctcaagaactacaagagggcagggtatgtgtttgtattatatactcctgcatgcccagggcccagccaacacttgcccaaaaaaccataattactcactaaatgaatgaatgaagatatgaatgaagatctcccactctcaagaagcttaagttcagtagcagaaataagccatggacatgtgcacatatttatatattgcaaaatagaataaaaactgctgtataagagaagactattcgatacaaaaacacagcaatagacatagcgctcatttgtatttgggaactggaatgtcttcttcaaaaaggtagaatttaagctgcagagttttaaatttcttttaagaaagggagatgagaaaaaagatcattttagtggaagtaaatggtataaaggtgaaattaaagggtctttttggggatttgaggtgtttttaaagtgtttgtactaaaactcaggacaacttagatatttttccatctatacctaatgactgttttgtaacatgaagatcggaagcatctctactcatttattttactttttccagcaagcagcgtttttcagaggaaaacagtaaaacagatcaaaatttgggaaaagctgaagaaaaaactaaagttaaaagagaaattgtggtgagaatcagtttgatcaatctagttacaacttgtgtgtgtgtgggggggtgcgtgtgtgagagagtgcatattacatagtatgcactttcaatattgtttaatattttccacactactagtaggtttgctggaaactaatttctagttattattttgtgaaacttagattaaaaaattatggcattacaatttctagctgtatatggaggcaattaatcaagtcacattaataatgtagttttgcactcctaaatgaaggtgaaatatcaaaacattgtctgaattcaaagtgtgatatgtagtcttcgatgtgtggtagctattgtgaaggtatttacttcaaaaacaatatcaatgttgaattttaatgtgcttccttttaaattatactgttctctgctttctaagtatcttttaactagtcacctgtctgtttttctactgctaccctcttagctcagacacttaatagttttcttttgcattgacgtattggcattgtacctggtttgtacactgttggtctccatctttctcaatcttcaagatttaattcatcctccatgttgttttcatatgtcatagaatatgagaacaaaaactatggttccacgagtcagcgatgctataaaattccaatgtttgaagatattctagagtatattcagaccatttcacttcttatagaaaccctaacttatttcttacagacagttttccagacttctatgatgtgcagtcaacagttctcctaagtaagccactccatcaggccaccctctgccagtataactccattttctttctttctttctttttttctttttctttttcttttcttttctttttttttttaagacaatttctttctttcttttttttctctgtcacccaggctggagtgtagtggtgggatcatggctcactgcagccttgacttcccactctcaagctatcctcacacctcagctttccaaagtgctaagattacaggcatgagccactacacatagcttaagcctcattttgaactgctttcttcccctcagtcctaggttaccaagtccttttaattttgatattcaaatatctgtcaactactattttatcatttatttccaatttttctccttccttccctttcttcctttcctttctcctttttctttttcttctctctattcttttttctcttttcctccctctctttctctcttttttaataatataattactgttctaacttcagtccctagttaatcaaatcctccacacatctggttgataacctttgtaaaacaaagatttgattttgccattttctgctataaacatttataattttcccattgcctaaaagtaatatccaaattcctttcaaagtttagtggtctttgattttcaaggtctccttttgaccatttcccaaatattattctctttatccaactaattatttagccactatattcataaatatgttagattacctcaaaatagcatgttctttcacacccctgtgtgtttgtccatttaattcctcttggatggcctttttccacattatgttcctgaatatattctcaagatagaacttagacataagttccctgaacttccatgaattattcttttcattgtacttgtacacacttaattcagactagtgttatatttcttagctttttatattgcaattacttatcttttccatttgactgataaagaacataaatataaataaatcatatttctatttatatattcctaacttaagcattcgttgaaaatgtaaatggatattacaaggagagaaatatcacaatttttggatggtcctaaatcttaaaagttttatttttcatccttaatttctcttttttctttgtaaaataacatttaacattcatacatagaaaacagaactatatctcaactttttcttattcattattcagaaactctgcagtcaatatcaaaatcaggcaaagaatggaatacttttctgtaccagagaaaatgaccctattcgtggtccagatgggaaaatgcatggcaacttgtgttccatgtgtcaagcctacttgtgagtatagagttttagaatgtcaaagaaagaagggatcttgcaggtaatttaatagaaacagcttctttcatagatggggagactgtggctcaagacagggaagtgagttgaaaacattacatggaaaatatcagtgatagagctgggagtaagtacctagagttatttgttttaagacgccttgttcctctgacactccctcttttagcactggaatgtcctgacaaacatgaacttgtacaaatagtagatgcccccttactcctgaaacttcacacgttagcctgttttagcaatttataggtatctcatcttccatgggagttaagagtccaaaggtgatgcttaatgtagaaatggaataaagtcaaaattcccatgaaacaacactaaactcctataaaattacaatgggtattattttatgtaatgcaatatttctcaataagttagaatggacagttttctttcaagatttacgatagctctttatttggctgagctcaaattaagtatttaacttatatttagaatctatggctttctttgttttgattgacaactacatatggttgaaatatcatcagttaactgtacatactgtgcaattccattgtacaaagcaaatttaggcttatttgttttatcagtatatggaaattattgtggttttttttttcacatcttgtcctttagatgaaacagctatgagtaagcaaaatatttaagtttaaagcaaagctagggtacacatggtgtgatagatagaccatggtcttgagggaggagaccttggttgtagtcatatcctgagatgtagcaaagaccccctctacctctcatcttctctgattaacaaggggatgagtagatgtgctttgttaaggccactttcagccttcaggttatgccaccatgattttagttttggtgcctctgttatgaacattgatcatgctccttttcttactatgggcaagaaaactaatttacagaaagcaagtatcccagatccactattgccgtctttctttcaacattaaacagacattatgaagaaatcatagcaccatactatcctggaggatattttgttgcttctcattgatatgcagtgataaagggacaaaattgttccactctaaggagggagaacagttaacagtgcaaggatgtggagaaatcatggcatgtgtttgttcctaatggatctgcttctttttccctcttattcagccaagcagaaaatgaagaaaagaaaaaggctgaagcacgagctagaaacaaaagagaatctggaaaagcaacctcatatgcagtgagtggaatccatccaataaatcctatttggtgctataatttgaacaaattttaagagcctaaagggtgagattttgccctgcagaaatccccagaatatcttaactcttcaatctggggatggtattgagatgaattatatgggaagattgatccattcttgctgattaaaaactaactctgcaaaaaaaaaaaaaaaaaattgtttaaaagctgaaaaactgagttctacttctagttttatcacttatagactgttagcttttgctaactactttccagagaaattctacatgtatgctttctacatatgagtttctgatatttcacatctaatttgagataaaaaataccttgattcccccaccaacgcatgatttttatccctgaaatattacaatattagtttccaaagccttagctcagttatcatcaccaatggttttgatgataaaagtctcctaattttcactctggattttatcctttcccttgcccaaccagtctccctaacatagttggagtaatgtttcaaaatgtaaataagatcataatattgctcttaaaacccacaagcagctcatcatcatatacaggatatgctttaatcctgttatctctcctcttatttgtatccttatctccattcagaaaatcatgctctgctatgtgccatgtcttttcctacctgtgtttttcagctagttttattttcataaacctgtgtgcgtatttcccaattcacttttttttgcccagtcaaatcctatttacacttccacagtctcacctaaattgttcttgctccctgacaccttccctggtttcctttgagttctcagattttattgtaccctgtatgttcgtacctattttattctgtttagattatagtggaatttgcttatatattgcttgtattatatggggacattgtgctatgttttattttttcctatctcttggcatatgatgtttttcttgttgtcaaattgaattttacatttgagaaaaacacaattaaaatcctcagctcaaagagatgtaacattagtttctgccaatgtagatgtttgaaccttctgctttaagtagaaatgaaatatatggccaacttacttcttctatctcggcaggagctttgcagtgaatatcgaaagcttgtgaggaacggaaaacttgcttgcaccagagagaacgatcctatccagggcccagatgggaaagtgcatggcaacacctgctccatgtgtgaggtcttcttgtgagtagccctgcagctgggaacatggaggaatgattttgttctttctatttcatttccatgttcaattatgggagggccacttcaacataaaaatgaaagaattaaggcatatttagagaaactgtctgattggagacatgtatttgaaaatccatgtcctttgaagattgtcaagacttcacacttaagcaaggagaaagtcataatcttgaaatattcaagtagttttgtcttttaagtgtggaaacaggacaagttctagcttatctccgtgaataaaagtgaggccagtgggccaaagaatgaaaggtctggaagacaggttccaagtggatgccaggaagaacttcctaacagtttgcggatttcaaagatggatgatttaccatggaattccaaggatgatatcagtacagactttacaggcagattaaagcaaaggcttgggagtcattagagatacagtaatgagcattggaaatttagaaaaccacctctggactagggtttaaatcccaagtctgtacttattatttctatatcttcaggtgagttatgcattccgtctgtcagtttatttgtatgttggggttataataatagttttgtaatgcaattgtgaggatttcacagtgtaagcacagggttaggcacatcacattcaaagaatttaatcgttgttaagtgtaaaattaaattatatttgagatcacttctaatgtggcgattctatgatttttacttatctcttcttaaccatccttttttagccaagcagaagaagaagaaaagaaaaagaaggaaggtaaatcaagaaacaaaagacaatctaagagtacagcttcctttgaggtgagtttatatcctccagcaactcagagggatatggccctgaggatccacagatcatgttcagggaacacgtgcattccttaaaactgtatgaaacaattgtacagtttgtgttttcatatgtgttttcatgtgtgcagttatacatgtgcatatgtgactatttcttggttgttgggttcattgtttttatcacttaaaaaatccatgccttcaaagttaatcattctaaaataagccaattgctaatcctcgtttaagaaaaaaagtacaagctttagctatttttgcaatctgattcagcctatgttcaacactttcaacttcctgcctcaatttcacaggagttgtgtagtgaataccgcaaatccaggaaaaacggacggcttttttgcaccagagagaatgaccccatccagggcccagatggaaaaatgcatggcaacacctgctccatgtgtgaggccttcttgtgagtagagcagtagccccatagcgtctgaggattgagcagtgggaatttccatgggaagttttcaaaccattgtgaataatgcattttcttcttcagtgtagcattcagtcttgggtgtcatatttaaatggactaaaaacaaacaacagcaacaataaaacaagtggagggctttctattatgatataaagagatgcagaataagccagacacagaaaaacatataatgtgtgatgtctcttatatgtgggatctaaaaaaagctaactcatagtagagagtaggatggtgcttacaagagaatgggagtagggaagggtgagggttgggaatgaggaaatgttaatcaaagggtgcaaagttttagttaagcaggaggaataagtttatgggatgtattggacagcatggtgactacagttaataataatgtatcatatatttcaaaaacattaaaaaagtaaatcgtaaatgtccttacaccttcccaaaaaagataagtatcatgagacaactatgtaaattgcttgatttaatcatcacaatgtatacatataccaaacatcacactgaattcaattaatatgtacaattattatatgtcaagtaagaacacaatttaaaaaagtgaggtgcagaataatttcttctatgacatttaaaaagtaacctagaatcattcacccagagaagagaatacttcatgataattatactaattgcttttagttttatgaaaacattatcagatgaaataggaaatacatatgattacacataaaatattacaatgcatggaaaatttatgggatttttttgttcactatctttcttcctacttattctatgtgattttaaggaatataattaaaatggaaaagagctataggaagaaagatttgggctcatgatgaagattaactttgtaataaagcagaaaaagacaagaatggagattttattatgtaggagttgggagcctattgatagggtgcctaaaataggtctttaggatgaatgtcatggtatggccggcccttcaaaaacgtgactaggcttttcttaaactcttgatttttgactaaaaaaacccccattttatttcccatgtgccaagaatcttagaaaggacttaatttatttagtcttcccatatagaaagcaatataatccagcatattttcccatagcatttgaggcttggagcactaaaaatctattagaaggaaagttgagatcatgaccatataattatcacaacaaacgtttgttgaacgcatataattatgtgacacttgctcagagatttgttgcctaatctcatttcatcttcacaacaaccatatgaaatagatgaaaccagataaaaagcaagaacaaaaaacaaaactaaggcccagaacagttgagaatgacggaaaagtcaggacaggatatgggacttacagatgaaggaaaagttaatgtatttcttgttgtggggtataatcacttagtgaagtctttcagcctgttttttgttctcccttacattaatttttcagtagcaagaaactaattctgccacttagtggtcatctttgctgcctcctctgacaattttccattggggaaagaaaatgctgcttaaatgttttagtcaacttagactcgtgataaaggttagatcggttttcatataaagatgtatgaacaatcccataattttagatctattttagtcagtttatttcataagtatataaattctttattgaaaagaaataacctttatcacctcatgttttatagatatgttaacaaaggtgattgattttttttgagaattattctaccctccatagttagtttttgcacactttcataccatgtgaaaacagtcttttcaatttttaaaaaagttttagtttgatctatgtgcaagtattttgttgattgggacacattaaaacattttcacaaattatgtaatttttttctacattttgaactatttgtgttatatatccaattatgctgtagatccaatccaccaagctcaatttgcaacactgttagttatccaaaatgtaacagctatcactttcacttcatttccatcatatgcctagttttggaaggaaagtttcctttcaataatgacaataatgattatgtcaatctcttataacaattatatcaattattttattttgtaccaggtactgttctaattgctttacatgtagcaactcatttaatgctcttaacattccaataagaaaggtacttttattacctcttctattcctcctaaacacacacttaaagatgaggaaggcacagagaggttaaggtacttcttgtcttccttgcagaatttggctccagagtctttcctcttaaccaccatgctatactgcctctcagaagataaatattacctctccataaagagtaatcacacatgcaaaagaatcagcaaataagaaagtactattgcagtacatatactgggaagttaaacaggtttactccctaattcaggggctttctcttgcacaccattctcttgaggtagagtgaatcataattgtttattgtctaataaaagtataaactactatgggtggatatttggcagtgtttgagaatagtcaaaacaataaatgatcaagctatgaaagttaaggatctagtctactatattaagatccatttctggccaggcacggtggctcacacctgtaatcccagcacttttggaggctgaagcgggtggatcatgaggtcaggagttcgagaccagcctggccagcatggtgaaaccccgtctctactaaaaatacagaaaacttagccgagtgtggtggcatgtgcctgtaatcctagctacttgggaggctgaggcaggagaattgcttgaacccgggaggtggaggttgcagtgagccgagatcgcgccactgcactccagcctgggtgacagagagagactccgtctcaaaaaagaaaaaaaaaaatccatttcttctctctttttcttttcggtttcttaaagtcaacaagaagaaagagcaagagcaaaggctaaaagagaagctgcaaaggtaatattctcaggaatgctgatgctgtgccctgacatttttcatttctttataattctttacttatcctattagaataaatgttttctgtttaattttcatgcctgaaataaatgaagaacatttttaacctgaacaaaaagggtcctgataagaagtgtccagagtaccaattttatttcacaattattcaaattttgaggtttatttcataaaaagtggaatgttaactttttgtaaggaattttccccatatttggcttttattagatttctgttgttagagtattaacttatgccatttactaatttcaatttacattattcatatctctgttatttcaaatagagagtataagatctcaatcattccaatttacaaaacgaaagcacatatattatcatatttgagctttgtcaccacccagctatggagcaagtggtggttttcttgcacccaattaagattattaagttgggcctctgactttccagttatttttattccactctccatgcttttataattttatacatagcagagtcaaatttatctgtgtggagatgttgaattattctcatataatagctacatacaagatttatctttctttctttttttctgttttttttgagatggagtctcgctctgttgcccaggctagagtgcagtggcgcagatctgggctcactgtaacctctgccgcccgggttcaagtgattctcctgcctcagcctctctaatagctgggattacaggcacgtgccacaatgcccagctaattttttttttttttttttttagtagaaatggggtttcaccatgttgaccaggctggtctcaaactcctgacctcaagtgattcactcaccttggcctcccaaagtcctgggattacaggtgtgagccactgcacccggcctgtttattctatttcttaacaatagccacaacagtacaaacctcatcattacttggggaaaagttgacacagtttaaaatttgccttcttactgactcttttttttttaaataagtgtttctactaggtgaaactatcttttcattgatcatttagaattgaaaatgtgttttcatccattatgtttgatcagctgccaaatcctcttagatatttccagtggtattaacatattcctccttctctccactcctattcttaccctcttgcttcaaatccacatctcccattcctggtttttaatttttttaaatcaatttactcccagaaatatgttagtttctccagggatcagacttattctcttctctatgtataaagatatgtctttttaaatttatttatttatttatttttgagtcaggtcttactttgttgcccaggctgtagtgtagtggtgcgatcaaagctcactacaacttcgaactcctgggctcaagtgatcctcccacctaagcctcccaagtagctgggactacaggcacacaccaccatgcctggcaatttattttatttttttattttgaatttttctgtagacacagagttttgctattgtgtccaggcttgtcttgaactcctgggctcaagcactcttgcagtggcctcctaaagtgttggaattacaggtgtgagccaccatacttggacaaaatatatatttatttcttaggttaagcatgttttttctcttctttctcagacccctaaagacaaatcacaggtaagcaatattctcatttcctccaggaaggcttctcatctaagcctgcctatggaatcttcccacctctgatctttcctagcttttacagaccatgctatgcaacacaacacacacgtatgtttttgatgataaatattttcagatctgctataatgatgggacaattctgattgatgacggaagctttgtaaatacttactgatttactactatgtgttatcacttttgtttttactttttactctacgttacatattcctcataataggaaaagatgcaggaaggatagaaaactactctgagaaaatattttcttcatttcccaggaaatctgcagtgaatttcgggaccaagtgaggaatggaacacttatatgcaccagggagcataatcctgtccgtggcccagatggcaaaatgcatggaaacaagtgtgccatgtgtgccagtgtgttgtgagtgtccaccccatctctcccactgaatttcttcatccatgatcgcccctgagtctcagatccttcatgcatgtgtagagtatagaccgtgagttatatattagaaaggtttacaagcagatggataagacattaagtaatattgaatcatatagtgacaatactattatttattcaattatccttctattttccaattaagtcaagggaaaaagctcaatttaatggtttttttttaacacttgataatcttcatttgtgaaaaagagagagcagaaatttcatgatttggattggatgatctttttgatgtctttcccactcctgacattttatgatttgttagtctattcagataggagctaaggagaagccagctggatggaggtctgtggggtcagtacataaagactattaaaatagcctgaacaataaatggaataggaaggattgttatttatcctttcaaggacattactatataatgcaaacattcataagtggtttagtgtggagtaaaacctttaggaaacaggctcataccctaaatgtttactaaaatgtctccttgttaagccaggttcatggccttctaaggtctttgttttgctgagtggtgtaggtaagcctgtgactacagctccatcgtgtgggacaatatagaggttaattattatcacttctaattctcctttttaggctcttaatctgctcctgaacttaaccctaaaataaatgccgagaaaaacgcttatttaaataatacctgctgaggtgcaaagttaatgtctcctaactttcacatgtcttgatccaaccttaagtggatgcatacaattccctaaaaggagaggttgacagagtagagcactagaagaaaagtggcctgaaattcaagaagccagggtttttctctcacccgttcaatttgctggtgttgtggtaatgactaaatgtagtaaatgctaaggattttccagcattaacatgctatatgtcagtagaaaatggcaagaataccagaatattaggcttgtgttcaacccccaaagattagcagttgaatctaactggacttaaatcactactgcaatctaaaccttgaatttcaacttcaatattagctccattgaaataatatttaaaatttttagtttaaagtaaaacatggtttattatgattttgagcccatcatctgacttagcatcaccctttgcctttatcacggatatggtagttacttggagaggaaaggtttaagcagtgaaataaaatcaagacaattgtagctttattcggaatgttaattaaaattagcgacgtacaaaaaataagatcacctgagggccacagactgataaagatgcatgcttgttttgtaattattcttctttagagggggaatgtaaacagctaagtttatctgtactattggttaaagcaaaagcacctctcagactagataaatttgtattgaagactgaatctgactgttggtttggaagatcctcattccttttaaaaatgtactaccaaaaagagtagggaatcatattcagcctatatcttctttttctattacagcaaacttgaagaagaagagaagaaaaatgataaagaagaaaaagggaaagtcgaggctgaaaaagttaagagagaagcagttcaggtagttgtttgagatcatcagagccacataaatattcaacgatcactctccctagggagggctcctattccctcctcctcattccagtattcttagtttctttgcaaactgggaaaatgtgtttggatccccatatacaagagtactcccctttccttattcaatttattcacattaaatctattaattgctcgtgcaggagagagatcaatcaccattttctcccctgattgtgtcaattatattacctaagaaagaagtatatatagattgttatcttactgtctgaatgcagactaatagagacagatgttcagatttttctcaagtacatttttgaatatgaatatttaccttaaaaacagcaacaactagggatcccacttaattatctgtgagattttgaggagataaaagcatctctgagtcttgagtttgcattctttaacatctcacatgatggtgataacaatgataattgtacattcgttgctactgtatgcatcatggcataaagttttatgactgatatttgtagtagccattgaagggacatattattatctgtgttttatagaagaggacttggaagctgacataagaagttaagaaatatatttaattagttacatataatacaattatatactgatatattatttactatatattaacataaatattatatgatacaaataatatcatatataattataattatatgtagttagtaacttgagaaccaagaattgaaccaaaagttctggctttaaggcccatgatgcactttagattttacacgcttctgccatttgtattattcctgcagactatgccttaggtcctcattattcttttcttttgtccttctgtgatttagaagagctcatttctactgctcttacctttgctctctacaatctactctcaactcttaagccaaagtaattatttaaaaccataaggcaggtcgtgctacccagtggcttctcacctcactcaaagtaaaaatcaaggtccttgtagtgtctggaagtgccatacatggtctgatccctgccacttttcataggtcacatttcctattattctacattgttctccatgcaccaattatactggccaccttttggtttctgggacatcccaagcattgattcatggctttctatcacgtggtcacaaaaacaatgtggttaaaaaactggactctaggctcagactgtcagggttcaaatccttgcttcatttccctaccagtaaggtcctacagttaacatcttcatatattagctttctcacttataagataaggacattattattacgtatattatttttatgaagtcccaagaaacttattaatgtataacagcacagtgtcacacatatcttaagtagtcactctttaatattatatttattgctgttaatgtcattattggtctaatctcattgtccagtggggtgttccatactggagagttcaccaattcttcaacatacaatgaactttaccttctatatgccattactcacagtcagaatatccctcttgtctaccaaaattctggccacttttcatggctcagactgtgtgttaactgctccctaaatattttcccatgtgtgcaatatacttaataactctatcacttgttatgccaacaatttaaaaagtattttagttatattattcattgtattataacttatagttgcctctatgtgttttcttcaaagaaattaaaaactctgtgctagttttctatggttgcgataacaaattagcacactttagtggcttaaaacaacataaacttctcattgttcaactcccacttatgagaacacatggacacagggaggggaacatcacacaccggggcctgtttggggactgggggaaaggggagggagagcatgcaaatatctaatattagccccctcatgcaaatatctaatgcatgcaaatatctaatattattagccccctcatgcaaatatctaatgcatgagggggctaaaaacctaggtgacgggttgataggtgcagcaaaccaccatggcacatgtatacctatgtaacaaacctgcatgctctgaacatgtatcccagaacttaaagtaaaataaaacaaaataaaataaaataaaaaacaatgaaaacaacaacaataacataaacttcttatcttatttcataggttagaaggctaaaaaggatctcactgggctaaaatcaaagggttggcagagctgtattccttttctggagtttgcaggcgacaatccatctctttttctccaaatctagaggccgtccatgttccttggttcttggaccccccttctctgtctacaaagccagcaatgttatatctctctgactgttcttctgtggttacatctccctctcactctgtcttccatctcgctcttgcagttttaaggactgatccttgtgattgagccttacactgagcccattatggcaatacaggataatctcttcatttcaaggttattaacttaattatatctgaaaagccctttttgccatgtaaggcagcatattctcaggtctcaagtattaagacttagacgtatttggtggaacggtattattctgtataccacagattcctttaccaatttaagaggccatacatttttcttctctgtatctttcacagtgcctagtgcagaataatatttgacctgaaggttttctaatgagataaataacagcaatccatgttccaaatgtgtgacctagttctctgaaaagcattttggttactatcaaccttcagcatcaccttttccatgcaatcattatgttttagtttttaaagcagtattgtggaggaagatttctagtgtttagttattggactcttaaaacctgcttctgcttcatttggcaggagctgtgcagtgaatatcgtcattatgtgaggaatggacgactcccctgtaccagagagaatgatcctattgagggtctagatgggaaaatccacggcaacacctgctccatgtgtgaagccttcttgtgagtgggcggcagccactgctgctactgagtgtgggagaagatcagcatcgggtgggcaagaggggtgacattggaagttttctccaggagatagataataaaggctgtctttgcactgagtttggaaatttactattataaagccatatattcagcccatttatttctggtgttcttcaatagtctgagaggtacttgaatcaccatcaagaaaggaccatgtgctaagagcaaaattacactggagttaatggcataaaaggattaggacttctgttctctgcaagcataggtcactgtcaaataatccaaaggtgtaatcattaggtgctaataaattgaaaatgagttaacatctaattgatatcttagtttatttctggggagaagaacaatatctttatttttcaaaagagatatagtcataaaagtttcttcactggtttgctatggcatgtgcgtcttattctttaaacaaccttaagaacaagaacggctgggtgtggtggctcatgcctgtaattctagcactttgggaggccgaggcgggcagatgacgaggtcaagagatcaagaccaccctggccaacatggtgaaaccccacctttactaaaaatataaaaattaactgggcatggtggtgcacgcatgtagtcccagctacttgggaggctgaggcaggagaattgcttgaacccaggagaaggaggtttcagtgagccaagatcgcgccactgcactccagcctggcaacagagtgagactccatctcaaaaaaaaaccaaaaaacaaacaaacaaaaggacaagaacaatgatgtagagagatgtgtgtttacctttccactccaaagctaagttggtggaggtatagaagtaatggaccatttttatgtagagacatttctcctttagggtagtatgtattgggtgctaggaatgattgttttgtcctcccttttcttatagccagcaagaagcaaaagaaaaagaaagagctgaacccagagcaaaagtcaaaagagaagctgaaaaggtagtaatcctgaatgtttatactgcaatgaaaggatgagattttgcagtatctctgtaaaaataactatggaattactgaaaccccagttgtgagggaactaggggttcatttagtccaggggttgagaaactttttcttaacagaacagatagcagatatttctgtttttgtggccatagaatctctgtcacaactactccacttggctgttgtgactgtaaaacagccctagactgtatacaaacatatgggcatggctgactccaatacaattttatttataaaaacaaacggctggccagatgttgctcacaggtcacagtttgcaaacccctgatttattctgttcccatatattaatattaagatttaaaattcagagaaaaagaagaacttgcatgtaaagttaatgggagtatgagtatcagtaccaatagcttcatatttcaaagttctggaacaatagaattcaatcctagacttcctgataccacagccagccttctttctagtacactatttgtttttggattaccacatttggtcaacacatgtgttccttgctttacctgtggttatattttggtgccagcatttaggaaaaagattaaaaagtagcatccccaaataatattttcttggattcaaaaaggctggctccaagtagtttattccaagttgtggtcatttccctgcccccatcaaagactattgagattaaaaataacctctaaagaagtatcgccctggaactctgtatgtttggcttgtttacagttgtattgcacagttgtaataattctaaatttaaaaataatagcagttcatatgaaaaatagattcactcttcaacatctacaagagaaaattcttcagtatgagctaatttctgatttcacattactactacagacaaactctcctctcattattttttcttttgctaaatataactagttaggggatctggcaatgaacctttaagcagagctaggagaaaaattccctctttcatcctcattgaatttcaacttgaactaaagaattcagaataaaatacaaaatcaattgtaattgccatttgtaattaactctttgaacttcagtgattgcttattctgtctcaatttctcacgtaaccctaaacaaggagtgtgcccagtcatcagagaactaagtttattgagagtcttgtgtatggttgcaggtttagtctggattttggggctatcaaggaaaaagaaatacagccaccttcttaagtcctttgtgtttaatataaattgaacactataactgccagaaaaaaaattctcaggtcattttctctctcttttttttttttctataaagcacttagtaggaacccagtaaactaatttcccagaagatactcaagctttctccttttcttttccttttaggagacatgcgatgaatttcggagacttttgcaaaatggaaaacttttctgcacaagagaaaatgatcctgtgcgtggcccagatggcaagacccatggcaacaagtgtgccatgtgtaaggcagtcttgtgagtgcacaaagaaaaccactactgtgggatggtggaattggggaagcaatgagccaggcaaataatatgtattgtgtttgtcctttccttacatgtaatagaaacagaaggttatctgtaaagcatttgaaataaatcttttctttataatggccaagattcacagttctagaaataaaataaatacaactaagctattacattctctgttagttctggggtagaccctgccagtagatcacacttccttgataaaattcttaagttatttgctatcaagtggatcctttctctggattatctcgcaactcatgttggaaagaaaacacacagattttaatgtcaaagtccttacctacattgttgaaaataacacattttcagaaaatgaaaagtaggtctttacacaaagtttggaagtacacctagaatatttaagtccttcaatagcatttaccaaacatctacaatgtacaatgtgtataatgtgtataatgattatacaaaggtgaatgaaatagataatcttctcagaaatcatatagtccactgatattagtcacagacgtaaggtaatataatacaaaggagggactgttgaatgaaaaatttgtctgtggtatgttacagtacttcaagaaagggataattaatagaaagttttatggtgggataaaactagaccttataatttggataaaatgtggacatgacagaaagtaatgagaggagaagaagggaacagcaagagtaaggatctaaaattaggaaaaaaacaagtcatttagtttagtcagaacttaccaactttatcaaccttgaatgcacaccagagatttcgaggtcaattctacatgtaatgggaagctgcaaaagttgttcagataggacagtaagtggcataaatattgttcctttaggaagattcatttgttagcagtaaacaggagaaaaagagaaagaaagtactaaacttaagaattgctactcatgtagagggaggagctgcaataaataacccaggaagaggcagctacgcagagcaaggaggtaggctagaaggcgagtggatcaaggtgggggatgctgtgaaggtgaagtcaatgtcatgtggtgacagctatgcaagctgaaggacagtaagcaattagagatgattccactgttttgtgtttgtttttttgtgaaaggtagaaaatccaggagaaagaatacatttggtagagaagataatgattttggggcctcttgaacattaggtattggcgataaacacagctggagatccccagtgaacatttatgaagtgttagttaattgctcaccttgtcttttttttttttttttcttatggagtcccactctgtcgtccacactgaagtgcagtggtgtgatctcagctcactgtaacttctgcctcctgggttcaagtgattctcctgccccagcctccctagtagctggggttacaggcatgtaccaccacgcctggctaattcttgtatttttagtagagacagtgttttgccatgttggccagactggtctcgaactcctgacctcagggatccactcacctcagccttccaaagtgctgagattacaggtgcaaaccaacacacccagctttactcaccttgtcttgtttatggtgatatatatgtggtgttcttttattttaatgagacccttcctggcaaaggactccatataatttatatttttatttttagagaaggcctgcagcatagtagatgttaactcaatgctcgataattctgtacatatgtgatttgttcatataatgagaaactcaaagaaatgcacaccactctctgtaatctattgttccctacctcccactttctaatttccagccagaaagaaaatgaggaaagaaagaggaaagaagaggaagatcagagaaatgctgcaggacatggttccagtggtggtggaggaggaaacactcaggtgagagcaacctctaatttcagtaactggggcgggctcaactccttgacaataggactgtgaatagcgtatatagtctatggtaaaggcagtgctaagtccttgagagaacagagaagtttctccttaaggttgcagggtaagatatcagcacattttcactgctctggggttcatttggatttctttacaccttgaaataattaacaatatgtaatgaccttatcccagtctcctgagccctctttatggtaatctagacctcatatcaataatcgttctcatcagtatcacatgctcttcattttctttcattattctttcttgccttggacagagccactttttttaggtgtcttttctgttgatccaaggcagcatgataggacaaaagagcacaggctttggagtcagattgggttatgattctgctcctactacctggacttgtgagacattgagtaaattacttcctctcactgaattctactttccctgatttagcagtactcttccagggataaaagaaaataatttaggcaaaggtttagcatgtttcttgaggcatttttaagtgtcagcatggcaatgttgcacataaggtcactccttgggtctctgaacacagtttcataaaattgcagtcgccttatttatctttttacaaccttggaatatcaaaaccatgtcttcacttccagatctgacaaaggcccaatatttacctttgataaactctggctattctgtttttttcccatcttttttgctttaggaggctgagttctcccttttaaggaatagccctgttgattagaattgtctgatagacattttgtgtgtcttgttcataacttggtcaaacctaccttccttgacattttgcataactttgggttttcctccagcatttttctctctcttctatctgcactagagacctgcacatttttttctgtataaggccagctaaatattttaagcaatgtgggctttgtgggtcatatgatgtctgctgcaactattttactctgccattgttgtgggaaagaagcaaaaaaataatatctgaataaatgagtgaggatgtgtttcagtaaaactttatgtgtaagaacaggaagcaggaaagatcttccctgtgggctatacaattgaaccttgaacaacatgggtttgaatttcccaggtccacttgtacttaattttttttcaaccaaacttagataaaaaatacaggatttgtgggatgtgaaacctgcatatatggagggctaactttttgtataggtgagttgtacagggccaactgacagacttcagtatacatggattttgatcctggaaccaatcccccaagtgtaccaaggggaaactgtagtttgctgacatttaatatatgctattaaattcagtcatatttataatttccttgtgtagatccttaaaagcaacattagtagccatgacaactcatctcttataattacaacatgggtgattctggtccccttttctctgcagatgccagacctagatgttaggggtttttttgtttgtttgtttgtttgagatggagtctcaccctgtcacccaggctggagtgcaatggagcaatcttggctcaccgcaacttctgcctcctgggttcaaacgattctcctgcctcagcctcccaagtagctgggattacaggcacccgccaccatgcccagctaatttttgtatttttagtagagacagtgtttcaccatgctgtccaggctggtcttgaactcctgacctcatgatccacccatcttggcctcccaaagtgctgggattacaggcatgagccaccgtacccggcaatgttatgtttcttataaagagaggtgaaagaacttctcttactcagactgttaaaacaatttactaagaatacagtagactaagtaatccaggggctcttcgttcttctctgttttcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattgtaagtatttctctcaacaggcatgtctaaaatatagtcacattcctcttgaatgaatggctatttctcatttgctatggctccttccatgcaaattattctttttgctaatttccaaatattctatttttttctcttgcgttctctaaggaacaatgagccttagcaagggcagctaaccaagtggctgatttctattgtattttctattacaattctgtgaactctaagtgctatcatgatagacccttgttctttattgtgccagaatcctaggaagactttgtcacggccatttggaatcattgaccagcacagttgaagaaagctgacttcttgtcatttgcacgggacacacttagtgcataatccagggtcaatatttgttaacaagatgaatattcacttttttctcctccagggaaagagaagcagagagaaaaaatgagtattctcgctccagatcaaatgggactggatcagaatcagggaaggtgagttattttttgggttttggcaagaatcgtctttctgtgagtcagcagttggcgatcaaaactatagaagaaggtgtcaacatgatcaagctagagcttgcccttagaaggtcaggagttaccaagttatcagtgactctcactgataacttgttcagtgaagaaacctaatgccaagtggacatctttaagtctgacactttacaaggcatttttataaattacagtttatttaattatttcaacagcctggtcaaatttggccttttaaccttatttcgtagatagggaaaatgaggttttgcaagtatactgggatttatttttgtttttgcattattttgctgctagtgtaagttactataagcagatgcgtaaaataacacacatttattatcttatatttctggattccataagttttaaatggtctgattgtgataaaaccaagatgttggtaatgccgcattcctttgtggaggctctaggtgaggatctgtttctttgctttctctaacttctagaagctacctgtattccttggcttgtggccacccttaagccagtgatggccagtcaagtccttcttatgctttatcattctcacactgactgtcctgccgctgcctctctctttaatgagtaagaacctttgtgattacatgggccccacttggataatccagggtaacttccccattttaaattcaactgattagcaatcttaattccatattcaaccataattcctccttgccacgtaaagcaacatatttggaggttccaggaattagaacatagacgtctctctctgtgggacattattttgcctatcacagcaaggttacatggctgcctgactcttggaaagaaatcctctgattctcaaatccaatcaaatattatgtaaaaacagcacttccaatataatcttcccatcttttcaggatacatgtgatgagtttagaagccaaatgaaaaatggaaaactcatctgcactcgagaaagtgaccctgtccggggtccagatggcaagacacatggcaataagtgtactatgtgtaaggaaaaactgtgagtatgtttcaaaatgagcttttgactgtgagtcttaaagtacaataatcatttcttaccagtttgggaaaatgacaattgttttagaagcagatctggtaattaatgaggcgtttgttcactttgattgaaatgtttcattgttttccccccagggaaagggaagcagctgaaaaaaaaaagaaagaggatgaagacaggagcaatacaggagaaaggagcaatacaggagaaaggagcaatgacaaagaggtaatagatgttagacacgctaatacctgaattcagttagttcattgtatggtatatttattcaacaaatatttgtgaaatgctgactctgtcccaatcattggtgatataacggtaaacaatgaagtcatggccagatcttgaaaataaatagcatgctcttcagttccccaggagtgactctgatgcaattgtagaaccagtgacaactgtcaaattattgtagttagccagtgaatttcatttttgaattttttctttcctttgagacagggtcttgctgttgctcaggatggtctcgaactcctgagctcaagcaatttgccggagctcaagtctcagcctcccaaagtgctgggattacatgagccatcgcactctgctgtttctgaattttttaaacaaataaatatcaagcaatcagatgccaaaaattacaaagaaaatcagtatcaaaaatttggagtttgaggccaggcacggtggctcaggcctataatcccagcactttgagaagctgaggcgggcagatcacgaggtcaggaaatcgagaccatcctggctagcacggtgaaaccccgtctctactaaaagtacaaaaaaattagccgggcacgatggcgggcgcctatagtcccagctacttaggaggctgaggcaggagaatggcgtgaacctgggaggcgagcttgcagtgagctgagatagcgccactgcacaccagcctgggcgacagagcaagactctgtctcaaaaaaaaaaaaaaaaaaaaaaaaggaaaagaaaaagaagaaaagttggagtttgagataataaattcttgatctggcatttcattgccacctagtgttcagttttggtccttataaatagtattcaacactacaacaccaacacgtagaatattacacagcacaatcttttaatgcaccgacggactccaattagaaaagataaatagcgaaatttccctgggaagatttttcctattagtagggcaacttttcattaagcctgtagtggctaaagaaaatgaaaccttattagtaattatcattatttaaaaatattttgggaatatctgttgtgtgttacggtagatgaaatggctttgagaaaataaccttattgcacaacttcacatgatctctaaaggacatctatttaaaatcttggtaaatttttaattttatgatccttatttaaaaaattttgaacagaaaaatgctatatatatttatatatagaaaatactgagtaaaaaaaaaataaagaaaatatggaggcagggtgtggtaactcactcttttaatcccagtgttttgggagaccagagcaagagaattgcttgagcccaggagttcaaaaccagcctgggcaacatagtgagaccctgtctctacaaaataataataattaaaaaaaaaatagccaggcatgatggtgcacacctgtaactctagctacttgggaggttaaggtgagaggatcacttgagcccatgaattcaaggcagcagtgagctatgatagcattattgcactccagcctgggcaacagagtaagaacttgtcttaaaaaaaaaataaaaatattgagattgtgtgtgagtgtgtgtgtgtgtgtgtgtgtgtcaaatagagaactaccgttttatctacacatgcaacgttaaataaggtttaccaataattatatttaaacctccccaaaatctattcagtggtgatattgttccaattttttagaattcaggaaaacttaagagaagtgaactacacataattaatgaatagaagagccaaagactgaattggagggttgcaatacagtcagaggagtgctattataaaaatatgtggtattgtgagcacctggaaaagaaaatacttccagtaatttgtgaaaatggtggttgtgagacatttaatatgttgataggtatttaattccagagaattttttaaaatgctgcaattaaaagtaaggcctggaattgtttgtttacggacatcacaatttaaagaaagaagggtaagtacaatctaggttactgtgttattttttaaggtaatgtttccatatcaccactttggctctttgggcttacaggaagttccagagacttctgtagctctctgaagattttagtacattctagatcctatctgtagactcggttctattggcttctttttatgatcattatgtttcaatgaacacaaaaggcagctccatatacttatccacacataggagttttattctctgacttgtaaaagcaaataagtaaaaaggtataacctggtggttagcaggtttctgatcacaaattcaacactgactttatttaatagctctgagatttatttttctcatctgtagaatggggatgatgcgtatttatcttataagatttttacaaccactaaaggaaatctattaaaccacacgataaagcacctcgcacaataatttttttttttttttttttggtaaattgtggttgagaaatgaagctgaaagtttacgtgtttttatgttttgccagaagagtgtcgtttagttcattccagggcttttgaagtagacttatgtgtggaatactgagtgcactcatagggagacaggtttggggctctgcctcatagaaaatggtattaaaatgagatgggacagggcactgggggctcatgcctgtaatctcagtgctttgggaggccaatgcgagaggatcacttgaggccaagagtttaagatcagcccaggcaacacagagagactcccgtctctacaaaaaattttaaaatattagccaggcatggtggcacatgcctgtagttctagctacttagcagactgaggtgggagtgttgcttgagcccaggagttggaggctgcaatgagctatgattgcaccactgcactccaggctggacaacagaacaagattatatatatataacaagattatattatatacataacaagattatatatatatatagatagatataatatattatatatatagatatatattatctatctatctatatatataatcttgttatatatatgtaatcttgttctgttgtccagcctggagtgcagtggtgcaatatatgtgtatatatatatatatatatatatatatataatcttgcttgcaatatatatatatatagtttttaaaggaatgggctgctttagtgaaattccattagggcaagacaatcatttgatagagatgcaatggagaagattcaaacttcttaggtagagattgaataaagtgcctttaaaacatatttcttctctgaaatttcacttctctgtttttttcctgtgttatgagtttatatctaatcggtcaatcatgttatcaggtttgaaagattataccatgacagtaacaactttttctgctactgttggtaggatctgtgtcgtgaatttcgaagcatgcagagaaatggaaagcttatctgcaccagagaaaataaccctgttcgaggcccatatggcaagatgcacatcaataaatgtgctatgtgtcagagcatcttgtacgtaaaaaggtttatcaataaatttgatagttgtgcctgtttgctagaaattagtttttgttacttttaaaacctaagatacttggcatcacacattaatgatatgatacctcctctcttttgaagagacaatttccaaagcactttcacaataatttttttattttgatgttgaaaagcataatcatacccagaacctctggggtaggaagaggtagcttatcagctaggtaacctgggacaggccagttcattgtgcagagcctcagttcctcctgagggaaaaatgactgaacaatatagttttgtggagattcaaggacattttaaaaatgtttatgaacttcaaagcattatacctacgtaaataacattcaaggacattttaaaaatgtttatgaacttcaaagcattatacctatgtaaataacaatcaatattgtgagtttggttataatttaattggaaaagtaaaaatgagaattatagcaactttctagatgagagtcttaagtctattatattaaggaaaaataaagaccttttaggatcatatttttctggataagagtatagtaacagcatctatgaaagttgatagcattgccacaaatatattatcatgaaaattccaacaatcagaactgattagcttataaaaatattcttagatttttttttaggtataagaaaacagtgttagatttgctaatgtttagaatcgcagaaatacttggttaaagacaattcagtaacaacccttgaaaaattaccctatctttttttttaattattctgcagtgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaacttcaaagaaaattgatttttcttgtcttgtcactttgtatcataacaagatttttgggggtttgggggtttgataccttttttgattttgtagaaaattctctgagagtgtgtgtctattattgttttagtctttcctccttgggagaaatatggattgaaaagtagagggtaacattctttaccaactcaactgcatgcttatctttgacactttaagtgtgaaacaaggctttgggtagcttgctgatgtttattttaataattcaggcaatataaaccaatctaagtctcccttttagcttcccttctgttttcaccagatgattctatcagcattaaagaatcagcagtgtgcatgcgtgatgctttcttttctatttatttttcaagactacaaagaagacatctttattcaattctttaacagtaacaatcacatttgtagagttagatccctgagcaattgtccttttgtcaaaagcatgcttcatggggaaaatggggaaaggaaggatggatgaacgggagaaaaaaacaggaaggtctatcaagtgttgttttatgtttccctacatttttcaggaccagtgcagacaggttcagaatgaagcggaggatgcaaaatttagacaacctgggcgttccttggcctctgttgccaggatgagtacagtgagtctgagcccagagctaagagaggacttcctaaaaccaagtttgaagaaatcactaagccaaaaagggacaaagccatgttcactttccctttctcattttctaggatgagtgcagtgaatttcgaaactatataaggaacaatgaactcatctgccctagagagaatgacccagtgcacggtgctgatggaaagttctatacaaacaagtgctacatgtgcagagctgtcttgtgagtaagaggattctgctccccctgtagctagcaggggaactgcatttttagaaactgctgcttgaataagtttgtatatttatgaaccccatgggattttaaaaataagtctttagaattaaagccctcaaattgagaacacctgatatagtagaaagaacactgagacttggagacaaaaattccgtatgtaagttctaaccaagatgtatactagctgtgtcattaaacaatttgttttcaactttcagcatcataattagaagaaattcttcaagatctttattccacaactagatcagactcaattgagatgcctttaaaaataaatacaaatttttacaccccaaaatatattatatcagaatcttggggctatggaatttgttttttagaaagagtttctaggttattctaaaaagcaaatagaaatggagaccaatggacattataaatgatgatgatgatgatgatgatgatggttgtaaagcacactgtgaacacaacaataatcaaatttctttagcttttcatagtgagtgttctttgagggggaattaccaaatactactcccattttatgttctagaaaatcaaaacttcagaacattaacccacttgtcatctgttaagtgatgaaagttctaaaccagctcctaattgtgtacttttcttaatatgtcatcctggtcactatctcaatgttctgtgattctgttttatttatttatttatttatttatttatttatttattgagacagagtctcactctgttgcccaggttggagtgcaatggtgcgatctcagttcactgcaacctctgcctcctgggttcaagagattctcctgcctcagcctttcgagtagctgggatgataggtgtgcaccaccatgcccagctaatttttgtatttttagtagagatggagtttcaccatgttggccaggctggtctccaactcctgacctcaggtgattcgccagcctgggccttccaaaatgctggggttacaggcgtgaactaccatgcctggcctctgtcacattttatgaggattgcttaacttctcactggaagttataggaactgtttcttattttaaattattttttattttcttctctagtctaacagaagctttggaaagggcaaagcttcaagaaaagccatcccatgttagagcttctcaagaggaagacagcccagactctttcagttctctggtaaggaggactatttctgaaaagctacttatcaatttaattttcttgattttttttgacctgttgctatttgctattttcatagaagggtctgaggtttgctgattcagtgcagcctgaagtcctttgaggactatatgcagtttatgcttggtgagagttctgggatttctcattagtgccttatcctgtgccctttgagattatttgccctgcttcaatttagtacattttgaaatttacaatgtgtgtgtggaataattgtgactaatttcacatatggtaaaatacatagtcaggtgcctcaattctgtaattttagcatacctcttggtattcttagcttcctcacctagcttccgcttatttccctcctccaaccaaatctgtttctacatcctggaactctatgccaagcatgctcacaggtataaatttccgccaattagcaattcgcagtagctaaagcttcttgtttaaaatataggctgagctgggtgcggtggctcatgactataaccccagcactgtgggaggccaagcgggcagatcccttggccccaggagtttgagaccactgtgggcaacatggtgaaactctgtctctagaaaacttacaaaaaaaaaaattagctgggcatggtgccttgtgcctgtagttccagctacttgggaggctgaggtggaaggatggcttgagcccaggtggtcgaggctaccatgagccgtgatagtgccactgcactccagcctgggtgacagaacaggaccccacccttctctcttcctctctctcgtagctgatggtcaccagtaatgtaagtattagtctacattagcatgataagatttactttgtagagccttcacaagatgaggagtagaaaggagcaaagaggatatgagaacatcaagcagattctcagattgggccctaaaaggaagattttagcacctaggctgatgacccagaaaaggagaaagaaaggtatcaaacatgaattttacttcattattcacccaattcaactagggtaatagatgagttacatacatgaaatatgcattaattacatatttctggtaaattgagctccacatcagggatccgaaggcatggagaagagctattaacaaaatatgtttttttttttaaatactaaagtataatagttacatagaagaaatgtacatatgcaagtaaatagctaaatgaaatatcacaaagtgatcatacctgtgatagcagcaagaaataagatatcatcagcagaccagtagccccctcattctccctcataagctacagtctgctttggagctatttcttttggagaaataaatctttcattattcatttttttcatcaagccggcagtccttttgtcagtctacaaatacttactgagcacctgctatttttccaggcattatttatttacttatttatttatttatttattttctgagagggagtcttgctctttcgcccaggccggagtgcagtggcgcgatctcggctcactgcaagctccgcctccgcagttcacgccattctcctgcctcagcctcccgagtagctgggactacaggtgcccgccaccacgctaattttttgtatttttagtagagacggggtttcactgtgttagccaggatggtctcgatctcctgacctcgtgatccgcccgcctcggcctcccaaagtgctgggattataggcgtgagccaccgcgcccggcctccaggcattatttacgtatgctaggttaatagccataaacaaaacagatagcgctcactacatgaagttcatagtatattggaaaagcagatacaataaataatatgaataaatgaaaaaataatgccaaggaggaaataaggcagaaaaaaatggtacagtaaattctgagatggggaggggaggggatacaattttaagtgacatatacagagaataactctctcagaaggtgacatttacatcaagacctaagggtattgattctgtaggtatatctgaggagaacatattccagagagaaaacatagcaaagcgtttagtgttgttgaaatagagctacctcagctgtagaagaggaagtcaggaagctaatgggaggccatgttataaagggttttgtagacaattttaaagactttgcctaatattctgaatgaaggttctgagaagactaatatgatttgatttatgttttaaaggaataactttgcctgatacctattgaaaacactgcagggaggcaagggctggacagctagttagctattgcagttgtctacagaagagatgatgctggtttataccatgttagtagtggtggagctcttgagaggtggtaagatactgggtctgttttgaaggtggagtcaacagaattttttgagttgatgtactatgttaaaaaaatgaagagagagagagagtaaggaacattgtagtaccttttgaacattatagcaccagttacctgaaaaaatacaattgatatacctggttgagtctaacctttgccagggtttcatataagttacttatctaaattctctgtgaatatttgtaccaatatggaactcaccacaatctaaagcaattcatttaggtgtttgaatcatttatcaaaacaaaggaacaagtacacaaatactgcttgactcctccaaaatgagtattagcagatataatactattaaattttctatgtcgtctttgtatctgttttcagtaagtagttttcaaggaatttattaatttcatctatgttgtcaaattttttggcatgtagttatttataacatttctaaattattcttttagtatctacagctcatatagtgatgacctgttatctctaatattggtaatatatgttttcttgactctggtcaattttgcaaatagcttatcaacttattcttttcaagcagctaacttttggctttgttctattttctatttcatcaatttctcctctttattacttattttaaaaaattttctatgctcatcattggctagctccttcagatgaaagtttagatcatccattttagaacctctttcttttctaatatatgtattaaagttataattttcccccaaattactgctttggctgctgggatttgataggttgtattttctttgtgattcatttcatttctaaattctatgattactttgagtcatgagttatttagaactcatccttttacttataaatatatttcttataaatattatatagttgattctttttgttcttccagttggataatttctgtcttttaactggagtacttacttcttaatattctatgtaattactgataccattggatttaagtcttccatcatcctatttgcttttgaatactttttttatattttggctctactttttgcctttttaaaaaactaatcaaggtcttggaattatcattaattattaaactcatacttccaaaacactacgaagagcaaatatgtttcttcttttacatggaaaatatacatatgttttttaccgtggaaaacatactaacaactaaaatttactgaacacttagtatgtgacagatactgcgttaagcatgaacttacatgcattatctgttttaatcccttcaagcagtaatataaagtaaggactactattatttatgattttctggtgagaaaattaaggctgagaaaagttagataagttacttctctagttagtggtagagctaggactcaaaaactcatgcaatttatgagtatttacctctgagtctttcctttctaggctgtatataaccaataccttcacttaaaaaggcgaatattatttctggcatgcctatcattctagatttcttcttatgggcaggtaattgtgtcacatattataaaggatatttgctttcttattgctttgctactccttgtttctttgtttacttaccttgtcaagttaaaaattgccaaatacaggaagttaaatccacctcatatggtgcaaaatcaatctttgagtttgaataacatatatcacactccttttacaaccatttattcaagttggattaaggaactcaagaggttttcttaagcccacccctcttcttgaatgccataaagtacgtctgctttattttttgcttcttcaggattctgagatgtgcaaagactaccgagtattgcccaggataggttatctttgtccaaaggatttaaagcctgtctgtggtgacgatggccaaacctacaacaatccttgcatgctctgtcatgaaaacctgtaagtattcaagttgccccatcatatcttccagtttagaatttctcagctagagtgttaacccatagtaatgcactgatataaattcgaaatgtgttgcaagtaatttattcatcatagaagttaaaaattcaaaatttgtgaattatctttcttatatgtaaaatagaaaagatttaaggctattcctttggtaaattgcttacctacattgttatatgctctactgagaagaagagaaagaaaaaaaatagtggagttacaattgcagaatattggtataatcctgtgtacagtcatgggagtgtgaacatcattcattctgtgtgtagtggagaaaaacagtagagaactactgctatataacccagcccagtgtattatatctaaaaggtcctgtgactataatatagctacatattccccatttctttaaccctgcctcttgaaagaagtagtaccttgcaaaaggaaagtgcactgtacaaaagaaagcccaataaataaatagctgatctgatgtctgctctcatatttatgactatctgggtatctggaggcatattatttcatgattctgaatctcactcccttcattggagaaatggagacagttctctgagctgctgacttcacagatgattgaaaagaactgctagatatgaaaatatttttatcttaagttaaatacaagggattcattttaatactcttattattggctttagttttgttgttgctactctgctcaaatgctgtctgaattttaaaataatttttaaataatttccccttgtctctatatgcatcccttcccttctcctggccaccatttggccagctttcaaggagagaatggtgacaaaccttggttttcccatctcacctgaccccagacctacattgtagtactactttatccttcttaggacactataagcaaggcccagaacatgaggataggactccctgatatcctgctttttaatcctggaaaaatatttaaaagaattcatcttttaggtaaggtatggtagatataggtaaggtatggtaggtatggtatggtaggtatacttcatctataggtaaggtatggtagataaggcactttcagatttcagtcactgaatccctgcaacctgctatggaatgttattatctttattgttcagaaggttaatctgaggctcagagagtccaggtaatttgtttaaagttacaaagctagggagtaaatcagacaggattttgaccttattgatttggatctaaatacagttttcttttttctccactaaactactgttatttctaagacagtagttccttaaattgtcaaagaccaaagattccttagataatatgaagaaagttactcctttcaagaaaatttaaaaaaatgtgatatgaacaatccacacacataatattcataggctcgtggagtacttgaaattcatctgtagaccttataggtttttaagaattaagaaattcccgtttaaggaataaatataactgtccaggaattccattactatatataccttatctccagcccagaaatcctttaattcctctttcttataaatgtcagggcctaaattatccatataattttcttcaacattttcatcaactttatagacccataacaagtgatctttttaagggaaatttagcataagaaactgaaatgatgaaaatattaagaaagcatacctcaggatagtttgtttagctaagggagctgggagtagatattataaagaaggatcaggttatctgaggcaaaaggaaacaatattcatttctaaggttttagagaaagttatatgagagcaatttcaatttaagcaatgctaaaagacaaattgcactgccttgatagataatgagtttcccattaccagaggcaaacaagtacatgtctgattcataatatttctccagtgagaggcattaaaattcgtactccttaagattcattccaactacaaaactcagactgtatcatttgtgtcttgttatatttttccccaggtcgtattattggtactcaatatagtcaaacatctctctgggatctgattctcgcatctataaatgcgagatcacctttagaccagatgatctccaagtttatttccaacattctctatgaatatatcagtgaatgaaatgtgacaggataggtccagggctaggggatgaatctggagcagaagagagacagcctggatgatacctactgaaaatgaaagtagttgaatgcagatcccagatcctccctctaaatacagtttggtttgatacccaagtgtcctgcatgttggtccttatttattttcttattataactgagaacttcctcgttgttgaagcatcctctgatctgttttaggatacgccaaacaaatacacacatccgcagtacagggaagtgtgaggagagcagcaccccaggaaccaccgcagccagcatgcccccgtctgtaagtacataagtagactggcctccatggttacgttgtgaggagcactgggttctggttttgttctcttccactgagtaatggacatttatctggccagagaggtgacactaggtcaggtgacccagaattggtcacattttcactataaggataattaagtaattactgaaataagtggaaataatgtagcagttaatattttaaaatatttaatgggtccattaatagattgtttatgagcaatgtctccaacataacgttacttatttcaggataggttttgttttctgtgatctataataaaaagatgagacagagaccaagagaggtcagagagtgacagagttggatttaaacaatttctatataatgcccatattcttgaactttacattgtattaaattatttcccagcattaaaagttgaccaatttcatttaaactcctgaaaggatgtttcaacgtacgttactgaatttaacattctccctggtggctatttgaatagtcatcctcagggagatggtatgtaacatgaaaaaataggaattttcaaataagagaaaaatgttttgttatgggataaatgtgagtgcaaatttcagtttttgctgtgcttatacgagactcttggcaaatcacataaatactctaaaccaaatatcccaatgacctatgaaaatattcaataaatactgacttttatgcatttggcacagtgtctgaaaaattaatgtcactattattattatgcctaagaccaaagtatgaatttagaaaaagagtcgaaagtatgaactttttctaacagaccatggtatagtgcttatttatttttaataaattattgtcaattgtagtttgataaaattatgtgtaataaacaatattttaatgcattatatttaataaagctatttattattattcacattctctttgctccattccactgccacaaaaagctttggcaataatggaatcagaaactattcagccagatttgaaaatcttagtcaagcaatactagataaggccatattaaaaacgtctgcccaacaatctttgttaagggaaattgtgaaaacaagaatcataagctagagtcttcctagtttcacattagcagctgaaagcaatgtagaggaagccgaggactggaatgaaatcagaagaccttatctttctcatgtgggcttgacaaagttatttaccacccatttaaagacctctactctggttctttaccaggatccataaaaagggagtttaaactttaactctagtccctatattgtgtttgctgtcttattatatagaaattcttagtagttggctcccattttattgacagaatatactgttccccgtcctcacaaactcacctttacatatatctcaggagagaaaggtcaaaatagctttatgccagtccaatagaccacaccttagaccacacttccctgtaactctcatcctgtgtaggcaacttggaaaaactactttataaagaacttgccataggtttatactgataagatgtatttctttaaataatgaagaatgttgccggggcttatcacacagggtgttgtaaaagagtgccgttcttccatttctgagtgtatgctttccactggagttgcatagcaggcattaataatgacagaaattattatgctgttagttaatgaaacaaaaattaacgtgtcctggacacaggtggaacttcagtccctgtgtaagattcaagtgtgtgatctcgggtacagttggtacagactggtcatggcctagcattgttctgatgactagtaaggatgtatatattggggtggaagcctgttgtttgaactttatttctgggtggaagtttctctaagaaagtctggaatctcaagaatagaataagagtccaggcagtcacaagtttcttggaaaagtaggttgagtatcttggaacccactcttttgttactaagtacataatactttctattatgcaataactattatacagtaactactaagatttacataggtctttagagttttatgtacattttctgtttgtactcttacaatagtcatttgattagggcagggatcactgtctttcccattttacagaaaatcatcctgggggaaactgtcacttattaaagtcccttagtataatatcttgggttcaatgtagatatcctgacttcaattccagtgctctactaccattccttagttgtcaggagattctgaaaactaagtgctgttgagaaggcattatctcaattaaaagatgatttgctatattggaaggaaatttctatattaagaaaaatacaaatattattttgtgagataaatgactattcttatctatatctgtcaatttcatgacagattttcaaggattcaggaaaaccgaagcttgctactttcaaaccaaagaaaacctcctggagttgatataggcaatgaagtggagatttgagtttggaatgacagtgctgctcgtgccccaggtggtactagttgaagatgtgcagttatgtgaaagaaaacttcctgaggccctcgccccctttaagattatttttaaatattcatttaatgttttaaaggctgatttcaaatatatggatgagtcaggcaaaggaagacagctgattacattctagtggtctacaacaaactatagtagaaaaacattcgtattacaggaagtgaattcaagttatgacgtaacatgacagtggcaagttactaaacttctctgaagctcaatttcctcatctgcaaaatggtgctaatgacacctacttcttttttatcagcatgaaggctgcatgtaatcaaaggcagaattaagccatgttcatatttgtgtccacctcaacacgtagtacatactaggtgctcaatatttgttgtatcaaactggataaaatgtgaaagtgattttaaattgctacttctttgcagaatgcaggatctatggatttctttgattaagatgcagctataaatatacagcccacatttctgcaatatctctgggttctagcatctaacctacccatcttctcttctaggacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccctttctgggatttctttgtcactatctggataatagatatttgcttttaaagaaactgaataaactctacccttt

SEQ ID NO: 2039 - DNA, 73391 bp, Homo sapiens; identical to SEQ ID NO: 2038

SEQ ID NO: 2040 - DNA, 60969 bp, Homo sapiens
ccgagttcagtcatactgcaccagctgagcaatgcatggagtggacctgtaggcgacttgcatcgtcttcaacatgaagatagccacagtgtcagtgcttctgcccttggctctttgcctcatacaaggtgagcaatttgtgtgtaatctaagcctcttgccacacatctcaaagccctggggaagggacttttctccccctactcctgccaaaaaatgtttacgtatgcatgtataatcctgaaatgtcttgccagacacagagttctgaagatttatatatgtggctttataattatgttgttatctttagaaatggcaagtagtttgagataatctgaattttctaaccatgagaaattcttccattaattctttattaattcagaaaactgaatagattcttcttcatcttcctcttgctaaatgtatcaattcataatgcatattcttatatatgtaatagacatttaaaacttaattgtaaataatatatgtattttaatgttataggtataaatgaaatattttttaaaattcaatcatctgttcttattttaaagcagtggtatcttctagcttattttagtcttgtgttttcaaatgctaaatgggttgaaagcatttctcccaaagagtgagggacttttgtgggagctggaaggtagatttttatatttgctatttaaccctaagagaacacaaattgcctagacttacgttgctctgaaacattaaaatttttaaaaagagaaactcatagatagtctgaaatcatatacaaataatgcccattttcctaaaataggtgtgtaggtacaaaagagcctatgttaatgagagagtataatagcctgtgaccttaatcttaccttctgtcagatctctaacttttgcagctgtaataaggaggtagagctgccagaattcagaaaattaaattttatgtatatatcctataaatgtaatgctatattatagtttcaactataatatagtttcaaaattataattggtatagtattttgtgtgtatgttatattgtaattttaaaagggaggctggcatttattactccgaaaggaccttttgaagataagctattttgatggggttagaattcacatgagtattattttccaaagtaattgtaactttctgagtgattagacctttgtgagtatatatactaatctcctggtccagtgcccttcttttatttgccatgataaatcttaatgtgttcaaaaaccatttgcggttttacaacatattgtcattaaagcaatcaagatgctgcattaaatggattatttgttttgtttattaaatattttacatttccttaactttggtttctatattttcatcccagatgctgccagtaagaatgaagatcaggttagtcctgctttttctgttcattgaattcattccaagattcccaaagaaaagtggtttgtggccaacaccttcatgttaataatacaaacatattatactggtaggtactaatagcttttgttaaaaacacagaaacagatttttatgaatcaggacatgagcctctctctcacacacacacacacacacacacacactcaacatattaatgatgatggatgtctgcaagaggcaatttatcatgttaaaggagcattttaaaatttcataaacaaaaaataaatcaactggaaaactactattgttccatttaacatctcaacaagccatgatacaccacataggaagctgaaataaattttctagtaatcattatgcaaaagagggtggtctgtatcttgtatatagtcggtgtatatagttcatgtaatgaatatttattgagcatctcttagatgtcagaccctgtttgagatgctggggttatttttaagtaaacaaaatagatgaaattcctgccctgaaaattacgttttagtgtaggaaaacagacaaattaataagtagcttagcaaaacatatggtacgttaaataatgataaatgctaggagaaaaataaatcaggaggcataataggatccctgagaatggaggtggtatccattctcataaggataatcagggaagttctctctggacagacagtattagaataggaatctgaaggtcataagggaatgaaccacgaaggtatttgcagtttacagcaggccagacagaagcacctgtgagcgcagaggccctgacgcaagaaggtgctttaccaactcttaaacctcttttgtttgataaattaaaaaatcattttctactagaagttaaattttttaatctatttgaaagataggatgaccaattactcacacacacacattttatatatttatatacacacacactgctatgcatgctattaattcagcacttaaagcacaatcttaaatgttttgctgaatatgtggcaaaatttgttttatctctggccacgaacattaaaggaataaaaatgtgaaacagctattctttacgttgaaactctgagaaccatggttaaaatactctcttgccgtattttgttgcaatgattttttttaaagaaacttcttacatgagtgttctagagaattttatcatgttctctactatttcatctaagtttactgatagggagaggtccagaaagttcagtagagtagaaaataagctagacatttgggaatcagagagcatgctcacttggaagttttatactgggaaaaaagaaggatattatataaatatcattgtgtataaaaccatcattttctttttcagagtccgtgatgatggttggtgatttatggcagatactgtgaattttacactgctatttttcatagcattaacctctatttcactgaaaaatattttaaaaacaaatttagtgacttcttatatttggtattaaaggcaagaacacaaagaagtaattatttatttggaagcctttctaatcagagtttttggatactgtgtcagaaatgaaaactattgatgtagtcttttttacgatgctgtgattttggttattttccaagtttagtagcttgggttcctttcagcatgataaaagcatgttaaatgtcataaacatgaacctaaacagcagggaaaagcactgcagcaatctgcaaggatcttaagcatgcttaaatttgtcatcacctaagagtcattcttcaggcaaaagcaagctggtcagtgctctaacactgagatagggcaatggcagctcctggagggttttattataatatctggagatggacaatagaagacaacaaattaggcctcagccagtgagggaaacaggaagaacttggccctagagggctccagttttcctgggacatgctgagaaaaagagaataacagcaacagtaacaaaacaaaacaaaaacaggccagggactggaagttaccctgcaagtaaacaggtgctgaaaagtcatctactcaactcaggatgacttttggtctaaatatgcttctgtttcaaccctctctattatggtcattgaaagggtattccattttgctcagagaaaaactcaactgctgctttccatttttatggtcttttcctgtttcccaagagaatacattggataatttcataactcagaaaaatagcattgaatctcatcttaactaattaatcactgtgaacaaatttcttaacctattatttgggcctctgatgctcagtttgtaagaaagggagtctttctaggaattaagttctcatctaacagtgatattggagaagtccaatttagggattattcttattgatgcaactctttaatttttcttataagtagagacaaggtctcattatatttcccaggaggatcttgaacttctggcttcaagcaatcctcctccctttgcatccaaaattgctgagttacagccatgagccactgcacctggcctgatgctactcttttatgataagctttcaaaattatttagagctttattccaggattatcatgagtcgtctatatactttctataagacttacttaataagggatatattttcattacaaagaccccaggctcttctctgattctactatatggattttaggatcaattatattcatcaaggtaagcataacttgcaaagttggcatttgatactgtagaatcagagatcagacaggtctcaagatgcccagttattaatctgtgtccagaaattactactctgctactctgatggagtcactgtgtagctataataatcttagagatatttaagcatgccatccttagctaaatttcccagggctggtctgtgatatcgtttagttattctccttcaccattaatcattttgcaagtgctaccaactgcctaccatttttaagaggctagattaagtacatcattattcatccaggcaagtatacttctgttctacctaatgctgtatctatgtcacctagcaaagtatagtaatccaataataagtgattgctggctcattcaatgatgatcataaagatataggagactactggagttcaagaccagcctgggcgatgtagtgagaccctgcctctccaaaaaaaaaaaaaaaaaaaaaaaaaaagaaagaaagaaagaaagaaaaaacaagcacaaaacaccagatatagatataggagcctaaatagaaacctttaataaattttttggaacaggttgtgtttgtcagagttgaagcaaaagctttgtttatttgtttcctgatacaagcaacttgaagcagattaaaaaaaatcaaaacaaaaaacaacaaaaatccccttagattccaaaggcctattctaaagacctagtgaattttcactgggtacagtggctcatgcttgtaattccagcactttgggaggctgaggcaggtgtatcatttgaggtcaggagttcgagatcagcctgcccaacatggtgaaatcccatctctgctaaaaatacaaaaattacctagatgtggtagcatgcacctgtaatcccagctactcagggggctcaggcaggacaacctcttgaacctgggaggtagaggttgcagtgagccaagatcatgccactgcactccagcctgggcgatagagcaagactccatctaaagataaataaatacctagtgaattttctaaattaaaagggaatataacattttaaaatcatactttactaggtagcagaaatgcaccatattttaagctcctaaaaaagaatgagtgatgtatagcaggactttaataataatatttaatattatttattaatatttaatattgaatgaatcaaagaattaccacttttgaagatcattctactttccttttccccaccaattctattatttaaaatgtttcccctgtcctccttaaactttgtataacggagttattggtatttacaaaaccaaaagcccaaaacaaacatagtaggattttagttccaagggatgtgccaaaaaaaaaattaccagagagagagagaaagagagagaaagagagagaaagccttatgcaattattgagaaatttcctcagtacttccatagattcacaaggtttgattctgatggtagtgatagtagtgctgatgacatttgtggggatggtggtgggggtggaagtatgggtactttctaaaaaatataatacaaatttgaaaatgcaaaatggttaggcctctcccagaacctcggaagggggatgtgacagtgaagggccctgaatcttaagctttattagctttaaggtaagtctgcctgtgctcataagtcaaatgatttatcaagggacatgaagttcttttcagaaaataaaccagtctagaaacttgttttccagataaatataaccaagaaatccttttttcatttaacactgttaaaatttctaggaactgatatgttgcagtacagccatggggaaatgtaggcagacattttataatgttcaatgctcaaacaccttgcctcagtccttcagcaacattttcatattcctttcacagcaattactattggcctactgtgtactaggtattttatatgtgtcatcttagcatattccagtaataatactgacaatcaccagcaacatcaaaacaataataataaaaaaggaggaagaaggaaggaggataatttattaattgaatatctactatgtatcaggcattctttgagggctttacatacttaatcttcaaaaaaccttggaattgtgtgtgtatatatatgcagacatatacatatatctacatatatatatcaaaataaagcttgttttgatgtacttttagctaacacaacttttttggcattatcttaggaaatgtgccatgaatttcaggcatttatgaaaaatggaaaactgttctgtccccaggataagaaattttttcaaagtcttgatggaataatgttcatcaataaatgtgccacgtgcaaaatgatactgtgagtaaaggtttctttctttctttccaatgtttgagttaacagctagtctctgaactggtaaatgtattctttttctttcaagtgcatttttctaaaccgaaatggttaaataaaagtgctgagcagatcactctgacatttcccatcagataaagttggataattaccacccacctggaaagattttaataatcactcaaacaagattctgaaagcattccagagggcccagtgtcaataccttctgtagcactctatagtcttttgaggatgtagttccactttgaacttcctggttttggaaaaaaatgaatttgacaaagaaagtcagattccttgggcctgttaagacctgattctgttgcagcctagggactgagaagattggcttaagcataatgccagactctcccgtgacagccaaccagcagaaggacttaagcaaggtataccctgattctgtgagctgccagtgtctttagacacctagcattattctaggatgagatgaactaaagggtagattatagtttccaactccttgcagctcagaaagaattagtatcctggaagtttaccaatctctattcaatgcttcttaacttggtttccttctctccattgtcaccccaaaggtaaaagaaggcttgggttatcaattgcaaatcctcaaaccagaatgtcctaatttgtttttgaaaaggaaggttagcctcaatttctgaccactgtcaaaacttcaacagtggtagcaagccaatactgagcttacccacttaggataattatattacaattggctttttaaatgtcaggttggtgtgtgtcacaggatttaatttggggattgacgtagtcaatcatattgggataatgaagctcagatcgtttgatcatgcactgcttctagtgaagagactgtgagactataaagaagccaggacaagatttaatagaggatgggaggcctagggcaggttgaataattctttctttttttgaaagctgaatgtaaaccagcaggtatattatttattataaaattttcttcttgtttcataagatgttttaatatgagactgaaagtatgaatataataaatttactgaaaaataatgtaaaacaaaaatgaaatgccttaagagtctaaagacagtttatcattttgaagttattcaattattatttttatgacttacgtaaattatgttagaataaaatttttttttttacctggaaagaaggaggctgtgcaaagcataaaagctgtcatcagattcctaaagaactggcttatggaaaagaaaattgatttgctctgtgggtccctagatgttggaattagaaccaatataagcaggttcaatgtgaatattctctttcaaaaactgcattcaaaaaatggtgcagatagctttgagagttggtgaccacctggctgttggaagtattccaggaaggtagtctgttatgcagttaaagttagagattcttcctataataccatgttcgagatatttttcaatgttgaagggagatctggggttctgtgtccacttctgaacatgctaccaattttgacatgccaggctaggctgaggagagcagttaaaattaagtttaccatgttagctgttattgttaaaagttgagcaaacaatgtttaaactatgctatttcttgtccttttccagggaaaaagaagcaaaatcacagaagagggccaggcatttagcaagagctcccaaggctactgccccaacagaggtgagactatttggagccaacctgtttacttttgagaggatgtttgactctatttagagctatctgtttattccttaattactaggtcatacctgttttgaagccaacaacttaggagggagggaacatgggttagtccaggggtgggctaaatatctggtacatcttgtccataggcccaacccatgatccgactctaaaaacattttaggcactgacggaaactaagaggtggagtgagccagtgtgatgtctgccttccaaggccatcatttctcattcctcttgtcctgtcttagcccaaagaagagctttcctgggactgtagaactaagttcaaatcttagaattcttattgcttgtgtaacttagaaaatttatgtatctctggatctcaatgttttcatctgtaaaatgagttttagaccgaatagaaactaagttttaaaagccggtctcagggtttaacatgttctagcaggcatttgactcattctgtttcctttttcttttactcttttgctttttactgtatatgttccagtacctggagggtcctcctaattcaactatagttgcttgtttatatctattttgcagacagggactcaggctaatattttgtttaagaaaagtgttctctggtaaaaaaaaaaaaaggtcataaaacattaagaagtaagatagaaggaaggaaagaaactgcaaatttatcctactatataaaccatttcacttgataatttttttcacttagaaacatttttaaaatctttacaaaattataaaaataaaatttaaaaaataaaaatttggggtccagattggtggaaatatatatctagcctacaatatctcacaaatgggttactgacaaagctgggactaccaccagctattctaaccactactcacatcaccccaggtctcctatgcagtttcttcactaatttccactttcttttccttctctgctggccccaacacgtaattaaaataatcagtcaaggttagtacaccttaattacttataacatccatggtctaacaacgctgacatcttccttggcagtgttagccaagaacatctgagaacctcagcctccacagtaaacatagtctactaaattatttgcctgggctcaaccagtctcacttttaaaacaataacagacaccacaaaattgatccataattgaaaactctttatctgtagcaaaagagagctacttttatattctacaaaatctgtgggggccagaaaggtttagtggcaactttatatgtgtcttatttgtcacattcaaagagtggctcactttctaacatccattctcctcttcctcctctgtcttcatcataaaaaaatgatatatctatagtgtttaaaaatataaaatatgaggaaatgacaaaaaagcaaaatacacacaaacataccaattttaacaaacctatctaaaaaatatagctagttagatgtttccatatgtagacacaaatttattgaagtttaataaagtaggagttttaaaaaataaaattacagtcttaagaaataaaattactttttgttaatatattatgcctgagtcacacacacacacacacacacacacacacacacacacacacacacacaaaactgtaaaaaaaaaaaaaaccctctagataaaactcttaatagcgatgtggttcactacttaggaaactacttacataaccaagtagtaacttacattaagttaaggcagttaacatttggctgtgtgcctttcaaataagttctgtctaaatttttccttgtctctgtatttaaaaggattcatccaattataccatgtgttttttgttgttgttgtttttctctccactataaaacagaacaatgtgctgattttttctgcttagactccgcccatcagaaatcaaccctgctactccctctcagaataaggtgctctgcatttcaaggagtttcctcctacagacatcctctcactctctctttcatcactaattttcttttcactagtatgtcatcctttcatttcccgactctagtattccctccattaacaagtcttgttggtactgcctccaaagtctaactccttttctccatttccatccctaccatctcaatccagtcatccataatttctgatctctggtgttttggtacatgtaaagacttgtttttttaattgatgaattcattcattcaatgtttatcatgatttaggttgccaactttatagaatattaagttcacacgagtctgtgtgtttctgaggtccctcttttttcagattcatttattgctttaataactagtatggtaagtcccccttcttagttcatgttgttaaaggttgatgggacctatgcatagatatatggtttccatatacatgttagagataaaaataactgagtttataaaaacttcatcttgaatttggtaacccagtgtgtttatggatacaaagaatttgtaaattaattggggtaaaattgactttttacagtattaattttctaaactcatgagcatagaatagtttatgaataagtcatataattttgatctactttataaaatttacaaaatattcagatttttataatttttgttaatatttttaaaatgtgtaaatttattactattttgaatatattttgttttttattgtgttttatctgtttattgttgatatagacaaattctattgatttcttcaggttaatcttatgtcagacaacttttgtttttgttcttggtagttgatcatattacctacatataacaagagttttataatattcctttcaatcttagcacatctttctttcttttcttatataattggtaaaggatccagacttcaatagttaaacactagtgatggtaatgaacatcaaataatccccttgtctcttcatattaaagggaatacctctaaagtttctccattgaatgtaatatttatcatagcggtttttacctctacacttcagcaagtttggaaaattcctttctatttttagtttgctgaatatgtgttgcttattattaaaagtcttctttgcaactattaaaataatttgattttttagtctattaatataaataaatttctggatatatttcttaatattaaactattattattttcttagagtaaatcatactttataatatattttaaataaatttatgaatttggatactaatatcttaattagaaaatttgcaattatgttcttaagtaaggtgaatctccacttttatcttttaaataattcttatctggcttgggaatttacataaaattatcctaaggtgtgacactttagactctgactaaatcaggtggtcagcagatcctctcctcagaaagcaactataaagctagacaaaattgaccaaaaaccattttagcaatctgaaaattgatcagcagtctataccaatctgagaagcatttatcttgaaaaactgctgactttaggaataaaacgagaggtctgtgatgttcttgctcagggatattcccatttcatcccctggcttggttggcatggaggttctatacagggtacaaaggtcagcaaaggcattgccattgttgaagaaggctaacctaatttggagtaacgagcaaaagtcatacccagaggtgttttcagtgtaagtgataatcttcaccaagggtaaggaaaatggtctgaggttgcagtcataattgaagcaagtgtattcctggctgagccttcacacgtagttgaaagagcccaaagagggtcaagagattcgcaaactcctaactgactataaagctgcgcatatccgcttaataaacacaaaatgtcccagtgagaagcaaatgctggagtagatgcaaaagtggcctgaactttgcatgccctcccctgtacacaaaggtctatctgagagggtgaaagcattgttagcttgaagtatttgaacacaaactgtgttaaatccttagctgaccattaaactacaaaaacataggggaaaaacataggaagccaggcttaaaaaataaccatgatagaaactatcattttcttagctgcacatcagcagctgcaattatgagagaggaagatttcaaagatttaatccagccacagaagcaaaaaaagaataaaaaagcagtgaaaataatctttaaagaaaaaattgtaaacctgagtacctatattatctaaaatgttgtttttataatcaaaatgttcagtttttataatccacgttagtgaggttaaaaaaatgtcagttttcaccaaaagttataaaattttcaaagtaacaagaatatacaacccatactcaagaaaaataattaatggagtttgtctttaactgtgtacagatgttagatgtggcagacaaagacttgaagcaactattaaaaatgtattcaggatactaaaaaaaatcatgtttgagggttcacaagaaagtataataacaatgaataagccgataaaaactttcaatgaaaagacagaataatttttaaaaagacccaatgaaaattctggagttgaagggcacaataactgaaatgaaaagttcagtagagaggctcagaagcagatttgtgaatccttaaaaaagggaattaccaaacttgaggaaagcttaataaaaactaacaatggaaatacagagacagacaatagagaagaaaaatgaacaaaattatacactttttgagacagcagcaagaaagccaacatatgcataatgggaataccacaaatagaggtgagagaaaaaggaatacaaaaattatttgaagaaacaatggcctaagatgccttaaatttgatggaaaaaaattaattttaacatttaagaaactcaatacaccccaaataggataaatatgaagagatccacatatggctcatcatgattaaaatgttgaaataaaaaaaaaaaacaaagagaaaatttagaaagtggcaagagaaaaatgacacatcctatatacaggctgtatacaattaaaagctggcccctcatctaaaataatgaaggccggaaggcagtaaaatgacatgttcagaatgctgaaagaaaaaaaagattaagcaatattctatattctcaaaagctatcctacaaaaattaaaacaaaataaagatattactgtactaaagaaatctgagagactttgttgttaacacaactaccttaaaaataataatgaaggaggtcatttagctgaaaggaaataactaccagatggtagcttggacctacagacagaaatgaaaagcaccagaaatagtgaaaattgagttaatctcttagcctttttaaaagaaataatcttaatatataaggcaacaattataatgctgttttatcaggtatatatatatatatatatatatgacaacaatagcataaagggtgatagagaaaataaagctttattaaggcaaagtttctctattttaccaggattaagtattattctgaagtggtttgtaataaattaaggtgcatattgtaattactagagtagctactaagaaaatagcatatataataaatatataacatcaacaaaggaattataaaggtgtactagaaatatttaacccaaaacaagatggtagtagaacagagaagcaaaaaaagacaaaagcatattgaaaacaaatagaaaagtagaaatgtaaatacaaccataaaagtgattatattaaacataaatggtttaaacatcccaatcaaaatgcagaaattgtcaaatgataacaaaggaactataagctatctccagtaggtgctccttagattcaaagacacaaatagttgaaatgataacagatcggtaccatgctaagtttaaccgtaagagagcaggattggctatattaatatgtgataaaatagacattaagacattattagagacaaatagggatattttgtaactttaaaagtgtcaatacgttaagcaatataacaatgataaatgtatacacacctaatagaggctccaaatttatataacaaaaaatgctataattaaaagaaatgaaaagaaatgaagaattcaaaaataatcgttaggaatttcaatactccacttaaaatactgatagaacagctagactaaatatgaccaaatagaatacttgaagaatactatcaactaattcaacctaaactgaaatatagacagtgcttctccgttgattgtagaatatgtattattttaaagcaacagaggaacattttcaggatacactatatactaaggtacaaacataataaattttaatatattaaaatcatatatagtatttttttttaaccacaacagagttgaattcaaacccagcaaggaaaatgaatcgtgaaaatccccaaatctttagaaattaggcaacacacttctggataattggtgggttaaagaaacaatcttgagagaaattggaaaataatttgaattgaatgaaaacaaaaagacaacaatttaagacttactggacttgtctaaagcactttctagagatttaaatggcttaatcagaaataagagataggattcaataatttaatcctctaccttgagaatattagaaaacaaagtttagcaaactaaacccaaagcaagcagaagaagaaacatataaggattggagcagaaattagtaaaacacaaaacatacaaataatagaaaaaattaataaaaccaatgttggttctttgaaaagatcaacaaacctgacaaacccttagttttattttcccttcaagaaaagaacagaagacaaacattaccaaaatcaagagtgaaataggagacatcagtatgtgccctggagaaactacaaggcttatgatgaatattatgaaaaatattatgccaccacattaaataacttagatgaaatagaaaaattcctagaaataaccaaattattgaaaattgacccaagaagaaatggaaaatcataatagacttacagcataagtaaagacattgaatcagtaattaaatttaaaaaaatgcccaagagcagatgactttattggcaatttccattatatactgaaaggagaaataatatgaattctttacagattcattcaggaagaagagacactttacagctcattatatcagtccagcattattctgatacaaaatgtagaagacatcacaaaagcagaaaactactgacaaatattcctcataaacatagacagaaaaatccttaacaagacactggctggcaaatgaatctgcaatatgaaaaaaataaatcattaccaaataagaattatcccaagaaagcaatgttggtttgggaacagaaaatctattagtctaatacacaatattaacagaataaagggcaaaaccacatgattatcttaatagatgttgaaaaatcacttattaaaatccagcactcattcaagatgaaaactcacacaaaatattatcaatagaagtaagctttttcagtctgataaagaacgtctgtgaaaaacctacagctaacattataattaatggttagagaatgaatgctttgcccttaggattgagaagaaagcaaagggtggtttactgtcaccactcctattcaacattgtactggaggttcttagccagtataaggcaaaattaattaattaattaattaaagacactttttattggaaatgaagcaactgtctttaattccaaaacatgataccatatatgaaaagttctagggatccacaaaaagaaaaattactagaactaataaatgagtttagtaagatttcggtgtgcaagattaataatacaaaattgtatttctatatactagcaatgaacaatttgaaaattaaaatatttcattcacgatagcataaaaaatgtggaaatgaatttaacaaaatgagtacaagacttatacactaaaaactataaaatggtactgagaaaaatgaaagatccaaataactagtgagataaatagtccatgttcatagatgagaaaactcaatattgttgagatggcaattttcccaatattaatcaataaattaaacatattcccaatcaaaatcttgtcagtctttctttttggtagaaatagagcagttgatcctactagttatataaaaaatattgagacatttaacagtaactgaatttaaattttgttataatgcaatagtgatcataacagcgtgccgttatttcaagataggcataaagatcaggggaatagaatagggattacttacttttatggtcagttaatgtttaaccaacatgtcaaggtaatgctgagaaaattgaatataattaattttaaaaaacagttttatcttataccatacacaaaagttaacttaaattttattttggcactaaatgtaaaagctaaatatatgaaacttctcatgtaaaatataggaggaaaaaaattcatgaacttgggtaggtagagtgactttagacataaaactaaaagcgtaatccatgaatacaaaattaataaactgaaatttataaaaattgcaaatttgtgtgcttcaaatgacaacaagaagtcaatgaaaaagcaagttatagactgggagaaaaatagtcacaacctatatagcaggtaaggacttaaatccacaaaacataaaaacctcttacaaccttattataaggagacaattcaattaagtatagatattacaccaaagatatatgaatggctaataagcacacaacaagatgcgcaacaccgttattatttaggcaaatgctaattaaaaccacaatggtgtatcactacacgtacccactagaatgattataatcacaaagacagaaaatgcaaaatgttaagggtgtggagaaactggaacacatatagtcagatcggggtaatatacaaggttacagccatattggaacacagtttgagaacttcttaaaattttaaacagattgaccatgtgatccagaaaattcagtcctaggaattcagtgaagtgaaaatacaggtccatagaaagtcaggcatgtgaatatttatagcaacaatgtttttaatagttctaaactaaaaacaatccaaatgtccaaatgtccactggtgaattgataaacaaaaggaatatatttatacagtgaaatattattcaacaattagaagggatgtgctactgacaattttgcaatatggatgaacttcaaaaacactatgcaaagtgaaagaagctagaattaaacaattacatatttataattccatttatatgaaatgtccaaaaagggcaaatttacagagtcagaaaaatgtttaatgattgcttgaagctggaggtgggggctggatatactgtacacaagcacaggggaatctcgtagggtgatgaaaatattttaagaccagattctggcgatggctgtacaactctttccatttactaaaaatcactgaatcactttcaatgggtgaattttatagtatataactaatacctcaataaagctgtttagaattttatttttcagttcatatgattgtaactgctttggaatgatttgtacattactattatttaatacaaaatttcctagaccttcagaaaaatagattataaagctattgggactgagttattttggggtgggaatatctcagaccaatatatcaattggattaatgtttattgacctgtgtaacaaatgtagttatcttatactttttcatagtcatatatgcaatttggtttttgtaatgtattagcatactgatactgatgaaatgctttcatcgtattaatgtctcaatatttatatggtagtttttaattatcattccatatatttttacttttcatattacttgtctctttggtcagtcctactagaaatcttttatatcaggttgtttgataatatactctgttgtttctgttttctatggtgttaattcctgtttctttatgtttgttcctgttcattttacaatggggttgaggaatactttattctttaaatttaatttttaaaaaatttatgacaaatatttttgaagatattaataattatacatctcaggatttatactttaagtatttctatttatcattattttccaaacacttcttaatttctctacccctaatgttatttagtaatagattatctaattttcaaatatgtggaacttttaaatattttatattagcttttaattttattaaattttggtcagagaatataaatgatgtagtattgattatttgttatttcttaagactttgtgacctcacaaatattctgcttttatgaatgttttatatattctttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctatatattcttaaaaaatgtttattttctgtttcttggttgtagttgtctataaaaatctaatggcttaatattcttttttttttacttaatatataaatttctgagaagtgtttgcttaaatctctaactccagttattgatttatttaagtctattacattctgtttgttattgtttgacatatttaaagtctatattattaggtgaatatatgctcatgattgttatactttcttgttcttgttcttgtcattttttacttcatatattgtccttctttgtcacttatgatacatttttggactcaattctaatttttaagtgttaatattgctgcatatgctctcttcctcttcatttttgtcttgtatatttttattatcttactggtttgatatttgcatgccttttcattttaatttttctcaatacatgggttcttttttaaacatcaaattaccaattgtctcttaatttgtaggtttagcacatttatatttattgttatttctgttatagtgagacttggttctttcatttttaaaatattttcggttactatatttagtagtttcttctttctagctttttttgggtggtgatttatttttgttcttattatgactatccctaaacaaatagccatacttttgattatttattctattgctaatatctgtgtctattgtcaatttctttgtcttctctccaaatgtatgttaatccactctccatatattttctgtaaatataattttgttattaacttgattttagcttaaaattcttattgcttttctcttttattctttttttgttaattatagaaattgttcctttcttcagatatttctttctatatttatttccttcttttggagacttctaattctattttaaatgttctttagcttttccttttttagaaaaattgtttcttatttccattgccttctaggagaattccttgatctgatcatctggttcacaagttcattatttatttgtacctatcccatctttattctttatattgctagatttattatcatttgaatattttccatatacaaaatttccactttgttcttcctttataacttctttcttgttattgttttacatttgtttatgcagatatcttctcttatctctccataacataattagacttgataaaatatttttctacccattccaatatttctacttcaattaatacatgttgtttagtatattctattttttacttgtcagatatacagatattcttattgtaatattccataatggctgtatttattttttctgctaaattcagttaggtagtgttcaatgtcaagcttcagtctgtagcccttctggtgagtataaggatagaaaaagagataagacccagtgctggaggttctgaatcccctcttttccactccagcttgctgccacttcaccaggtcaggaatctatctgtaaggtctcaggcattgtcaacattaggaagaggtgttttctgtaggttgtgatccaccacctaggggtttggaggggaaggagatggagtcatatatccttgcgcctgttttcatcatcccccagctggccttttgacttgctctgtcattcccctctctacacctgtgacctagttagtacgttgctgttgattttctggggaagggggatagtagtgattgttttgagttaattactttgatctgtaatttccctatgcttctgtagtatcttcaggaatgatttttgagagaaaaccaagagccatcctgctttttctttatgcttcggtcacatttcccttctttctgtccattccttaaaaaggacagtctagtttccaccacaaatcctttgcaattgccgttctctatgcccagaatgttcttccctcaaatgtttttgccactatatctaaaatagtccccattctggtcactattgtatttttctgtttatttgtgagagcacttactataatttatagttgttgtgcatatctgtctctttctatcagaatgtaagctccttagaatatgtattccatttttttctctctctctcttttttattttatattttctgtggcagcttcacagtccagaagagtgctaaaatgtagttaatatgtaataaattttgtggaataaatgaacaaatgaatgaatgaaataacttatatggccactgcttatcttattttcaatgtatttttaacttctttctaaacatatgaatagtggagtatgttctttagcttttcttttctattttcagttcttttccttctagataagagtttctcaacctgatcttctgtatcctacttttattctttatattatgtgacatactgatacatcataggtctacattctaagtgtttcatatttatcattaaaatgtctttattttgacaatgataacatgaagttgtattttgcaatgtgatattctaaagaaaaattatccagttttattatttggttttaggtaaaagttaaagtcaagttaactctatatcttttttagctaggttatgtcacaataataagttgccaaataatgtttcataagaattcacttgatccttattgcaaatctggaatgtaggtagggtgtgaatttccatttttctgatgaggaaagtgaggtgcaaagaggtgaagtgagtgggtggcaggtctgagacttgaacactagtcttcagttattactttgtacatttgtttttctttaccatcaggtttgttcctaagtgtatgtcacattattagaatagagatttgggctttctcctgccgtacctaaaagatgtttagtttacttggcttgtcagtagagaaaacattgaaaataacaacaacaacaacaataaatggttctgtgtcaggcactgttccaagtgctatacatgaattaacatatgtaaatccctatatagtcctgagagtttgacaaaattataaccattttgcacatgaggacactaaagcatagaggtgttaaataacttgtccaagtcccatagcttaagtggcagacttagaaatatgaaacaagcaatcctgctcttaattactattctaatctataataatagaaactttgctgtagtttatagtttacttagagctttcatatccgtaatctactgggcctcactactactctgtggagaaggcaggcaggattggacagacgaacaacatgccaagtttcagagtggtgacgtggcctacttcacccagacagcaagtggctgaagtaatactgaaattctttcttttgaaatctaattttatctgttcttggatcatgttttattgcccataaatttattagctcaatgtagccttcatgatatgtttttcttctccagcaatttacattattgtgggcttaaaatgttaatctatttatacatctaaggactattttgtttcttacattttgacgttccttgatcatgtcttttgcagctgaattgtgatgattttaaaaaaggagaaagagatggggattttatctgtcctgattattatgaagctgtttgtggcacagatgggaaaacatatgacaacagatgtgcactgtgtgctgagaatgcgtgagtattctctgaagtaggctttctccctaaaacgtgttctctctataattacatgacacaattttccctacagtctttaagctaacgattcattatgtgggagttagccattcctaaattattagtaccacttcttttactactcttaagacaaataaaggtgtatagcataacactttatattttacaaagcacttttatgtatgatttatcagatggttatcactttatgaagtagacagaatagggagattatagattatatgttcataatctataaaatgttatagattttatatttaaaatgtataataaaatatagctttaatataataaaacagatttaatattttaataaaatatagacttatgattttataatctataagttatagattatatgattatcatatataacagattatataatatatttacacacatacatacatatatacatatatatacatacacacatctatcttctatctatccatcatctattatctatttgtttatctatgtgtataccctttttcacagagaattatttcatcatcaaattatgtttattaagtgcttaataatttgtaatattagagtagataattgagactttcaatattaaatttcttcccatctctcaacatttaccaaatagctaaggcatcttactgtcctatatcttgtccctgttttgttctttctctaccttcaatgctagatttggttatcaattgtcttcaccaacaagatgacatacctgcttggcgggttctggcttgtgatctcaatcttgaattgtctggtcttaaggttttgcaaatatgaaaaccaaggtgtgtacaggctaatgaggggtattataattattcactttttgagatcctgcaagctttagctctccttgcaataaatattttcagcaaaataaaactgcattaaaacactctcatcttttgcaggatggtattttcagaaattcactttaaaattatgtcctcaactctcaccaagggtcaacatagagaaaccgaaaacaaacgtagatatatgaagaacacacagatttttatcagatatatattgtgtagcacaagtatgagcatgctatatatttaattcttactgtgtcttatgtggggaatcccattataaatctttaaatctctggtccaggtgaaagtttctctcccctaatttctggtatatttctttgtactatgtactttgtactatgcgatgagaatcatacttctccttgtgttgtttcccttgcagctctagctgctaggaggctctacaataaaattgaaaattttatttttatagtgcccctcagctgatatcctttgaaataacttttttcttatcacttttaaatatttagtttttttctttatattgtttttactaaatttttattgttttacagatgttatcattgtaatctgctttaactttttacaaattaggaaatatgtcttacatttgcggttctgtgttttcagatatactttaaaggtctacgagactgaacaaaattaattatcaagactttatgtactttctatgaaaaataaaatactagtcttcataacccaaataaagagtagtatagtgggatgttagataatacaaatttgactttgtttatttaaaacaacaaagttccttgggtgctgagtgttatctattatccagttacaagctttacttttccccatcttctgatgtggatccctcctctaaacaaaggttaaaaaaagatttctataaataacatttacaagtctgaatctttaccatctcttccatgttaactacatttctttgacttgaagttataaacagtgacttttattagaaaaagtaataaaataatactatgtggcagctgttttcgggagtaaaggagaatgacaatgcaatgtagagcagttaggtttgaatggtgggaagttctgtgatattaaactgctgtgtctactaacttttgattctaggaaaaccgggtcccaaattggtgtaaaaagtgaaggggaatgtaagagcagtaatccagagcaggtgaggtcaattgtcagcctgatgggaaatactgggaggctaacttcaaatagtaagtaggtgctctcctcttccttcttaggtgggagccttggaaggaattaattcttgctttatgtgaaatggaatacccagtactgcccactaatatgaaaaagctaattatagtctctgaaactggatcagattactttggtggttagatctttcaatctattgctgctttgtataaaaaaaaaaagaagaagaagaaataaaaaggaaactacatgtgtagtagaaagggcacaacacttcagtcacttagcctgcgttaaaaccccagcagtgtcacttgctgtttggagaccttggacaaattacttaacctaaaatgagatttgaactaaatagattttttttctatgatacagttttgtgagcctgtgatggtaggggaaggggaaggaagaaaggatctcatacatgtcacacttgtctttttccaggtgaatgattttcctaattttcaaggtctgatgccctttttataagcttccagagcacctgaggtgacttgcaccaagtcatttagcatcatgcaattttaaatgtctctttttatcacctaggagattgggagcaagttgatggcaaggactgtgctctgtctgagttctggcacatagtaggttatctgtttactaaataaatgaataaacaagtaaaaaagttttatatttaaccacatgaattatagagtacttactgagctacatctacacagctggtactgctctaagtggcccatagcaatgtcagagggactgagttcaataaaatttctgaaaacagtgttgtcagcattacaatcttggtaagtttcaagttcttttccctgttcttcaggatgtatgcagtgcttttcggccctttgttagagatggaagacttggatgcacaagggaaaatgatcctgttcttggtcctgatgggaagacgcatggcaataagtgtgcaatgtgtgctgagctgttgtaagtagcatcatccccaggtggacttgatgatgatgcacttggttgctgtcccgagaatcactcagcagagagataaaatccttttcatgaagcatgcaattctttgtctttacactgtgaaatagcctttctcacagaaaggcttcttttctttttcttcttatcattgattgaagtttcttaaaagaagagaataaggtggtcatgttagttattaaattcaagactctcatttcttttaaattacagtaatttgaaaatgtatagtgttttataaggcacaatattttaaaatttagaaagcactttcatatggaatgatctaggtcagtcgtctgacatccattgcttcatttgggcatatgtagagacccttcctgagtaatgtgaggctaattaaaataataatagtaataatgccatgtgtctgaatctatttattagcttaaaaagtggaacgcggatcattacaaaaggaagggctattgggttaatctttatctgagtgcctggcagtgcttgggcattaaagacgcagatgtggataagatctaattagtctttcatattctggctgttaaacaaggtttagactctctaattcacgtgccagcaaaccttaaattgctatatttacatcactggaactttaaaatcaggacagagatttaactgattagcaaacaaacgtcacacctgcctttgaaaattacagttagtccttgtagaattcaaggacatgtccaatcaggtttacaaaacagtgatgataactggtttccagacaggaaatcagcctgatttccactttcttatctaggagacatgttctctcaatgttcaaatctgccctaattctgtagggtttttttttctttttatgcattatgtgaaaaggggaatttgacctctctaactcctggtttcttactctgtggaactgagatagccacacctatctccggaatgagacgctaatcaaatgatagatgtgaaagggcttaaagctcaattcaaatgtagctttcattaacaacttagtacttttacatgaaagcaaacaaatactttacaaggtatacaaagttatacttaagggtgtggatggcaatgtctcaaatgctcagtttggtttcacccttgtcacagcattattttaaagctcttggttctgcctgttaaagggaattttcctgacaatcttctgtttgtcaatcaaggtgtcacacccattcagttttacagaacaaagcttctaattgactgtcagtgagtcagtttcacaccctttcttactataggcaagaaagctaatttacagaaagcaagtttcccagataagctattgccgtctttctttctttccttatctttggcaatttctctggctcaggcattgaagacggaaatgcttgtctcttgtaagaggatcattttcagcaattcgtagcagaggatatgaaagtgtttagcacaggactgaggatactgaaaatatgattgagtcataaactgaccaactgtttacttttcttaacagtttaaaagaagctgaaaatgccaagcgagagggtgaaactagaattcgacgaaatgctgaaaaggtaaaatgactcaccaacgcaattttgttcttgtggccatatttattaacaaatgtatgcctaaacctttgagtaatgaaataaagtcattgtcttttattattatatagatatttttcttaatatcaaaattccccaaattgactattcctagaatattaatcattagattcagatttaaaacagcatttcctacctaaggcccaaaatgtgcagtttccacctgtgtttctccagtcctctagcccccaaaagaagatataagatagaaagtttgtataaaccaaattctgcttaatttctagcagccttctttttggtttagtgtaaacccattttactctgtataaattgtttaaaattggcaatgaaatataaattaaacaggaataattttaaaatagtgagagtgttttaaacactatatccactagtgcattttatgtgcaattaaattgacacaagttgaagttattcactttgccattgtgattattctgttcagaaaaacctgcatttataaaggtcttgattctgctttaaaaaaaaaaaaagacaaatttttagaatgtgttttaaaaaaatccttaaaattatttttttgaaattacttgataatttaattattcaatctagtataaaaagttttgaataagcactttaggtaatgcagcctggatttcttaaatcacctactttcaatgagagggatagcagtttctttgctaaatggctaaccttttgttgagaagtcagaacgcctgagttttagccttggttttgccatgctctgggtgtgggagactaagtaaataatcatcctgggccttaattttcttgtcagcaaagtaaagaggttggataatgacctgaattttaccttcctgttggactgtgattctacatcctgcacacttttgtactaatacaagtgcactcctttttgcagatcgtagggcttatgttttcctaaaggaagaaacaagcccaccttttggtagtcaagagctagcccttcagttcgtaatgcttatttaatgaagcaaagctctcaacctaaatagggtattgaaggtttacatttaggaaaactaagtattcagaaccatctacagtttatgcaacacttgccaaggattgaaaaggaattcttttgtggtggttgttaaatttcagtctaaaactttgggtcatcctgtgatagttaacattttattacttcataaacacagagagttattttcctttgtttttcattaggtctctgtacttccctcttcctctctgtggctagggtcattgttttggtggggtcaccgggcatgatggtgtgaataggactgctttattgtgatggctcaatatgttccctataattaacttgtcactaggttgcaaacacagtgtttcttcagaatctccttggctgaatcacaacttataaactgaaattatcattgtttcttttacgagaatcattgagcattaattttttataccatgctatgattatcaggtgactgtcttctgcttctctatttctaggttgttacaaccatgaggtttggagcacatccattgctcctccaaaaataaatatcttcttaataggaagcagttaggattctctgttaaagcatcccaatggaatttgaattattttttaaaaaaccaaagaatgctagatctagaaaaggtcctacagagcatctgttccaaaaacctcattgtagaagtagtaactgtggttccaaaggagaagggactttgctgtggtctcccatttgggtgagagggacaatctagtggcccaggtcatttgactcctagccatgctctttatgcccatgttttcttgcctgaaattgaatgacgaaggtcacacagttgaaaagaaagttatagaccaggattttttgtaggtcatattatagtactatatctcaccacaaaatgtttaatgacatagagatccccaagcctagagtagcttagagtatcatttttttggtaaagtttagccctcctcacatagtagagttttcaaaacacagaaagtagcctgaaagtattgaaccaaagcatcaggaaatctgaaaacaaatctttcttggattttttttggtggggggaagtcactcctttttagcttttctaaatgagtatcagtcttgatgatctatctgtctaaggtgagggtgaaaggaaattagatctactctctctctacaatgtcagaaattattatggataaagaaggcagaatacacaaaaattatccacagatccatagagaaaatcaactaaagtaagcataacactgttggataacatcttgtttctttatacttacaaacttagctggattattcttgacttgatccatattaagtcacttttagacatctcatcttctcacaacttttttttctttttttttttgtgatttggctgctgcattttgttgtgtttgtgctggaacctcatgaaagatatcccctgacccctattgatctgaaagttaaaaagaaatacctagttttaatccaagaaaactcttggtcagccttattttttccgaggctgttttttatcttttaataaacctaccacataacagatacaagtgccaagtagttgacaatataattactgtttcttagtaatcctcattaatatgttgtatgtatttgccaacttctagacctgatgttttgtggtaataaatctattataaagtttccagattaaaacgtagaaaaatggtaaataaaattacttgttggctggatgtgttggttcatgcctataatttcaacactttgggaggccaaggcaggaagattacttgagccaaggaattcaagaccagcccgggcaacatgatgagatccagtctctaccaaaaaggaaaaaatttagccgggtgtggtggtgcatgtctgtagtcccatttagttaggaagctgaggtggaaggatctctgagcctagaggttagaggcttcactgagctatgatcattcccctgcaatccaccctgcgcaatgcagcaaaatcctgtctcaaaaaataaaatatcctgaaatgaaatgaagtaaaataaatataattgtcttttcaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttgtgagtatagaagtggttttttcagagtgattcaaagggtgggagtggagattgattggattgatgagtaaaaataactttgaaaggaagctttgttgttgagaaccatctgagcagttttatgccctccacaaatcataatgccacctagtgagcaggcactactgatgtttgtctatttctgaagagaaatggattccattttccagttgaaatattgacttacagcatagcacacttcttaacattcccctgtgactgtgacctatgtgaaactgtttgtgaactaattctagtatagaatgggggtaaaagcaggtaccacgacttcgattgtttttcttcagtaattatcccatggtaacagtgttgatgcaacactctcagatacttcaggtttatacattaattggattactcttatctttttatctgggacatatgaccttgggagaagggcaaatctcacaacatacaaattatcacatttatgaaaatgtcttagatgacatctcatgacactttcggcttctctagctctacaagccctttcctgtgtcctgtcctatgccagttcctcccggtcttggccagatgatgtcccctcctcttgtagattacatttcagattatctttccttggacaagaactcctaaagtccttccctaattgaaattaaattctcataatccttagtaattgtcttttctaaccaccatcacagttggcaattatacaattatttctccaagtttttgttgactttcagtcttttctaccagcctcaagaactacaagagggcagggtatgtgtttgtattatatactcctgcatgcccagggcccagccaacacttgcccaaaaaaccataattactcactaaatgaatgaatgaagatatgaatgaagatctcccactctcaagaagcttaagttcagtagcagaaataagccatggacatgtgcacatatttatatattgcaaaatagaataaaaactgctgtataagagaagactattcgatacaaaaacacagcaatagacatagcgctcatttgtatttgggaactggaatgtcttcttcaaaaaggtagaatttaagctgcagagttttaaatttcttttaagaaagggagatgagaaaaaagatcattttagtggaagtaaatggtataaaggtgaaattaaagggtctttttggggatttgaggtgtttttaaagtgtttgtactaaaactcaggacaacttagatatttttccatctatacctaatgactgttttgtaacatgaagatcggaagcatctctactcatttattttactttttccagcaagcagcgtttttcagaggaaaacagtaaaacagatcaaaatttgggaaaagctgaagaaaaaactaaagttaaaagagaaattgtggtgagaatcagtttgatcaatctagttacaacttgtgtgtgtgtgggggggtgcgtgtgtgagagagtgcatattacatagtatgcactttcaatattgtttaatattttccacactactagtaggtttgctggaaactaatttctagttattattttgtgaaacttagattaaaaaattatggcattacaatttctagctgtatatggaggcaattaatcaagtcacattaataatgtagttttgcactcctaaatgaaggtgaaatatcaaaacattgtctgaattcaaagtgtgatatgtagtcttcgatgtgtggtagctattgtgaaggtatttacttcaaaaacaatatcaatgttgaattttaatgtgcttccttttaaattatactgttctctgctttctaagtatcttttaactagtcacctgtctgtttttctactgctaccctcttagctcagacacttaatagttttcttttgcattgacgtattggcattgtacctggtttgtacactgttggtctccatctttctcaatcttcaagatttaattcatcctccatgttgttttcatatgtcatagaatatgagaacaaaaactatggttccacgagtcagcgatgctataaaattccaatgtttgaagatattctagagtatattcagaccatttcacttcttatagaaaccctaacttatttcttacagacagttttccagacttctatgatgtgcagtcaacagttctcctaagtaagccactccatcaggccaccctctgccagtataactccattttctttctttctttctttttttctttttctttttcttttcttttctttttttttttaagacaatttctttctttcttttttttctctgtcacccaggctggagtgtagtggtgggatcatggctcactgcagccttgacttcccactctcaagctatcctcacacctcagctttccaaagtgctaagattacaggcatgagccactacacatagcttaagcctcattttgaactgctttcttcccctcagtcctaggttaccaagtccttttaattttgatattcaaatatctgtcaactactattttatcatttatttccaatttttctccttccttccctttcttcctttcctttctcctttttctttttcttctctctattcttttttctcttttcctccctctctttctctcttttttaataatataattactgttctaacttcagtccctagttaatcaaatcctccacacatctggttgataacctttgtaaaacaaagatttgattttgccattttctgctataaacatttataattttcccattgcctaaaagtaatatccaaattcctttcaaagtttagtggtctttgattttcaaggtctccttttgaccatttcccaaatattattctctttatccaactaattatttagccactatattcataaatatgttagattacctcaaaatagcatgttctttcacacccctgtgtgtttgtccatttaattcctcttggatggcctttttccacattatgttcctgaatatattctcaagatagaacttagacataagttccctgaacttccatgaattattcttttcattgtacttgtacacacttaattcagactagtgttatatttcttagctttttatattgcaattacttatcttttccatttgactgataaagaacataaatataaataaatcatatttctatttatatattcctaacttaagcattcgttgaaaatgtaaatggatattacaaggagagaaatatcacaatttttggatggtcctaaatcttaaaagttttatttttcatccttaatttctcttttttctttgtaaaataacatttaacattcatacatagaaaacagaactatatctcaactttttcttattcattattcagaaactctgcagtcaatatcaaaatcaggcaaagaatggaatacttttctgtaccagagaaaatgaccctattcgtggtccagatgggaaaatgcatggcaacttgtgttccatgtgtcaagcctacttgtgagtatagagttttagaatgtcaaagaaagaagggatcttgcaggtaatttaatagaaacagcttctttcatagatggggagactgtggctcaagacagggaagtgagttgaaaacattacatggaaaatatcagtgatagagctgggagtaagtacctagagttatttgttttaagacgccttgttcctctgacactccctcttttagcactggaatgtcctgacaaacatgaacttgtacaaatagtagatgcccccttactcctgaaacttcacacgttagcctgttttagcaatttataggtatctcatcttccatgggagttaagagtccaaaggtgatgcttaatgtagaaatggaataaagtcaaaattcccatgaaacaacactaaactcctataaaattacaatgggtattattttatgtaatgcaatatttctcaataagttagaatggacagttttctttcaagatttacgatagctctttatttggctgagctcaaattaagtatttaacttatatttagaatctatggctttctttgttttgattgacaactacatatggttgaaatatcatcagttaactgtacatactgtgcaattccattgtacaaagcaaatttaggcttatttgttttatcagtatatggaaattattgtggttttttttttcacatcttgtcctttagatgaaacagctatgagtaagcaaaatatttaagtttaaagcaaagctagggtacacatggtgtgatagatagaccatggtcttgagggaggagaccttggttgtagtcatatcctgagatgtagcaaagaccccctctacctctcatcttctctgattaacaaggggatgagtagatgtgctttgttaaggccactttcagccttcaggttatgccaccatgattttagttttggtgcctctgttatgaacattgatcatgctccttttcttactatgggcaagaaaactaatttacagaaagcaagtatcccagatccactattgccgtctttctttcaacattaaacagacattatgaagaaatcatagcaccatactatcctggaggatattttgttgcttctcattgatatgcagtgataaagggacaaaattgttccactctaaggagggagaacagttaacagtgcaaggatgtggagaaatcatggcatgtgtttgttcctaatggatctgcttctttttccctcttattcagccaagcagaaaatgaagaaaagaaaaaggctgaagcacgagctagaaacaaaagagaatctggaaaagcaacctcatatgcagtgagtggaatccatccaataaatcctatttggtgctataatttgaacaaattttaagagcctaaagggtgagattttgccctgcagaaatccccagaatatcttaactcttcaatctggggatggtattgagatgaattatatgggaagattgatccattcttgctgattaaaaactaactctgcaaaaaaaaaaaaaaaaaattgtttaaaagctgaaaaactgagttctacttctagttttatcacttatagactgttagcttttgctaactactttccagagaaattctacatgtatgctttctacatatgagtttctgatatttcacatctaatttgagataaaaaataccttgattcccccaccaacgcatgatttttatccctgaaatattacaatattagtttccaaagccttagctcagttatcatcaccaatggttttgatgataaaagtctcctaattttcactctggattttatcctttcccttgcccaaccagtctccctaacatagttggagtaatgtttcaaaatgtaaataagatcataatattgctcttaaaacccacaagcagctcatcatcatatacaggatatgctttaatcctgttatctctcctcttatttgtatccttatctccattcagaaaatcatgctctgctatgtgccatgtcttttcctacctgtgtttttcagctagttttattttcataaacctgtgtgcgtatttcccaattcacttttttttgcccagtcaaatcctatttacacttccacagtctcacctaaattgttcttgctccctgacaccttccctggtttcctttgagttctcagattttattgtaccctgtatgttcgtacctattttattctgtttagattatagtggaatttgcttatatattgcttgtattatatggggacattgtgctatgttttattttttcctatctcttggcatatgatgtttttcttgttgtcaaattgaattttacatttgagaaaaacacaattaaaatcctcagctcaaagagatgtaacattagtttctgccaatgtagatgtttgaaccttctgctttaagtagaaatgaaatatatggccaacttacttcttctatctcggcaggagctttgcagtgaatatcgaaagcttgtgaggaacggaaaacttgcttgcaccagagagaacgatcctatccagggcccagatgggaaagtgcatggcaacacctgctccatgtgtgaggtcttcttgtgagtagccctgcagctgggaacatggaggaatgattttgttctttctatttcatttccatgttcaattatgggagggccacttcaacataaaaatgaaagaattaaggcatatttagagaaactgtctgattggagacatgtatttgaaaatccatgtcctttgaagattgtcaagacttcacacttaagcaaggagaaagtcataatcttgaaatattcaagtagttttgtcttttaagtgtggaaacaggacaagttctagcttatctccgtgaataaaagtgaggccagtgggccaaagaatgaaaggtctggaagacaggttccaagtggatgccaggaagaacttcctaacagtttgcggatttcaaagatggatgatttaccatggaattccaaggatgatatcagtacagactttacaggcagattaaagcaaaggcttgggagtcattagagatacagtaatgagcattggaaatttagaaaaccacctctggactagggtttaaatcccaagtctgtacttattatttctatatcttcaggtgagttatgcattccgtctgtcagtttatttgtatgttggggttataataatagttttgtaatgcaattgtgaggatttcacagtgtaagcacagggttaggcacatcacattcaaagaatttaatcgttgttaagtgtaaaattaaattatatttgagatcacttctaatgtggcgattctatgatttttacttatctcttcttaaccatccttttttagccaagcagaagaagaagaaaagaaaaagaaggaaggtaaatcaagaaacaaaagacaatctaagagtacagcttcctttgaggtgagtttatatcctccagcaactcagagggatatggccctgaggatccacagatcatgttcagggaacacgtgcattccttaaaactgtatgaaacaattgtacagtttgtgttttcatatgtgttttcatgtgtgcagttatacatgtgcatatgtgactatttcttggttgttgggttcattgtttttatcacttaaaaaatccatgccttcaaagttaatcattctaaaataagccaattgctaatcctcgtttaagaaaaaaagtacaagctttagctatttttgcaatctgattcagcctatgttcaacactttcaacttcctgcctcaatttcacaggagttgtgtagtgaataccgcaaatccaggaaaaacggacggcttttttgcaccagagagaatgaccccatccagggcccagatggaaaaatgcatggcaacacctgctccatgtgtgaggccttcttgtgagtagagcagtagccccatagcgtctgaggattgagcagtgggaatttccatgggaagttttcaaaccattgtgaataatgcattttcttcttcagtgtagcattcagtcttgggtgtcatatttaaatggactaaaaacaaacaacagcaacaataaaacaagtggagggctttctattatgatataaagagatgcagaataagccagacacagaaaaacatataatgtgtgatgtctcttatatgtgggatctaaaaaaagctaactcatagtagagagtaggatggtgcttacaagagaatgggagtagggaagggtgagggttgggaatgaggaaatgttaatcaaagggtgcaaagttttagttaagcaggaggaataagtttatgggatgtattggacagcatggtgactacagttaataataatgtatcatatatttcaaaaacattaaaaaagtaaatcgtaaatgtccttacaccttcccaaaaaagataagtatcatgagacaactatgtaaattgcttgatttaatcatcacaatgtatacatataccaaacatcacactgaattcaattaatatgtacaattattatatgtcaagtaagaacacaatttaaaaaagtgaggtgcagaataatttcttctatgacatttaaaaagtaacctagaatcattcacccagagaagagaatacttcatgataattatactaattgcttttagttttatgaaaacattatcagatgaaataggaaatacatatgattacacataaaatattacaatgcatggaaaatttatgggatttttttgttcactatctttcttcctacttattctatgtgattttaaggaatataattaaaatggaaaagagctataggaagaaagatttgggctcatgatgaagattaactttgtaataaagcagaaaaagacaagaatggagattttattatgtaggagttgggagcctattgatagggtgcctaaaataggtctttaggatgaatgtcatggtatggccggcccttcaaaaacgtgactaggcttttcttaaactcttgatttttgactaaaaaaacccccattttatttcccatgtgccaagaatcttagaaaggacttaatttatttagtcttcccatatagaaagcaatataatccagcatattttcccatagcatttgaggcttggagcactaaaaatctattagaaggaaagttgagatcatgaccatataattatcacaacaaacgtttgttgaacgcatataattatgtgacacttgctcagagatttgttgcctaatctcatttcatcttcacaacaaccatatgaaatagatgaaaccagataaaaagcaagaacaaaaaacaaaactaaggcccagaacagttgagaatgacggaaaagtcaggacaggatatgggacttacagatgaaggaaaagttaatgtatttcttgttgtggggtataatcacttagtgaagtctttcagcctgttttttgttctcccttacattaatttttcagtagcaagaaactaattctgccacttagtggtcatctttgctgcctcctctgacaattttccattggggaaagaaaatgctgcttaaatgttttagtcaacttagactcgtgataaaggttagatcggttttcatataaagatgtatgaacaatcccataattttagatctattttagtcagtttatttcataagtatataaattctttattgaaaagaaataacctttatcacctcatgttttatagatatgttaacaaaggtgattgattttttttgagaattattctaccctccatagttagtttttgcacactttcataccatgtgaaaacagtcttttcaatttttaaaaaagttttagtttgatctatgtgcaagtattttgttgattgggacacattaaaacattttcacaaattatgtaatttttttctacattttgaactatttgtgttatatatccaattatgctgtagatccaatccaccaagctcaatttgcaacactgttagttatccaaaatgtaacagctatcactttcacttcatttccatcatatgcctagttttggaaggaaagtttcctttcaataatgacaataatgattatgtcaatctcttataacaattatatcaattattttattttgtaccaggtactgttctaattgctttacatgtagcaactcatttaatgctcttaacattccaataagaaaggtacttttattacctcttctattcctcctaaacacacacttaaagatgaggaaggcacagagaggttaaggtacttcttgtcttccttgcagaatttggctccagagtctttcctcttaaccaccatgctatactgcctctcagaagataaatattacctctccataaagagtaatcacacatgcaaaagaatcagcaaataagaaagtactattgcagtacatatactgggaagttaaacaggtttactccctaattcaggggctttctcttgcacaccattctcttgaggtagagtgaatcataattgtttattgtctaataaaagtataaactactatgggtggatatttggcagtgtttgagaatagtcaaaacaataaatgatcaagctatgaaagttaaggatctagtctactatattaagatccatttctggccaggcacggtggctcacacctgtaatcccagcacttttggaggctgaagcgggtggatcatgaggtcaggagttcgagaccagcctggccagcatggtgaaaccccgtctctactaaaaatacagaaaacttagccgagtgtggtggcatgtgcctgtaatcctagctacttgggaggctgaggcaggagaattgcttgaacccgggaggtggaggttgcagtgagccgagatcgcgccactgcactccagcctgggtgacagagagagactccgtctcaaaaaagaaaaaaaaaaatccatttcttctctctttttcttttcggtttcttaaagtcaacaagaagaaagagcaagagcaaaggctaaaagagaagctgcaaaggtaatattctcaggaatgctgatgctgtgccctgacatttttcatttctttataattctttacttatcctattagaataaatgttttctgtttaattttcatgcctgaaataaatgaagaacatttttaacctgaacaaaaagggtcctgataagaagtgtccagagtaccaattttatttcacaattattcaaattttgaggtttatttcataaaaagtggaatgttaactttttgtaaggaattttccccatatttggcttttattagatttctgttgttagagtattaacttatgccatttactaatttcaatttacattattcatatctctgttatttcaaatagagagtataagatctcaatcattccaatttacaaaacgaaagcacatatattatcatatttgagctttgtcaccacccagctatggagcaagtggtggttttcttgcacccaattaagattattaagttgggcctctgactttccagttatttttattccactctccatgcttttataattttatacatagcagagtcaaatttatctgtgtggagatgttgaattattctcatataatagctacatacaagatttatctttctttctttttttctgttttttttgagatggagtctcgctctgttgcccaggctagagtgcagtggcgcagatctgggctcactgtaacctctgccgcccgggttcaagtgattctcctgcctcagcctctctaatagctgggattacaggcacgtgccacaatgcccagctaattttttttttttttttttttagtagaaatggggtttcaccatgttgaccaggctggtctcaaactcctgacctcaagtgattcactcaccttggcctcccaaagtcctgggattacaggtgtgagccactgcacccggcctgtttattctatttcttaacaatagccacaacagtacaaacctcatcattacttggggaaaagttgacacagtttaaaatttgccttcttactgactcttttttttttaaataagtgtttctactaggtgaaactatcttttcattgatcatttagaattgaaaatgtgttttcatccattatgtttgatcagctgccaaatcctcttagatatttccagtggtattaacatattcctccttctctccactcctattcttaccctcttgcttcaaatccacatctcccattcctggtttttaatttttttaaatcaatttactcccagaaatatgttagtttctccagggatcagacttattctcttctctatgtataaagatatgtctttttaaatttatttatttatttatttttgagtcaggtcttactttgttgcccaggctgtagtgtagtggtgcgatcaaagctcactacaacttcgaactcctgggctcaagtgatcctcccacctaagcctcccaagtagctgggactacaggcacacaccaccatgcctggcaatttattttatttttttattttgaatttttctgtagacacagagttttgctattgtgtccaggcttgtcttgaactcctgggctcaagcactcttgcagtggcctcctaaagtgttggaattacaggtgtgagccaccatacttggacaaaatatatatttatttcttaggttaagcatgttttttctcttctttctcagacccctaaagacaaatcacaggtaagcaatattctcatttcctccaggaaggcttctcatctaagcctgcctatggaatcttcccacctctgatctttcctagcttttacagaccatgctatgcaacacaacacacacgtatgtttttgatgataaatattttcagatctgctataatgatgggacaattctgattgatgacggaagctttgtaaatacttactgatttactactatgtgttatcacttttgtttttactttttactctacgttacatattcctcataataggaaaagatgcaggaaggatagaaaactactctgagaaaatattttcttcatttcccaggaaatctgcagtgaatttcgggaccaagtgaggaatggaacacttatatgcaccagggagcataatcctgtccgtggcccagatggcaaaatgcatggaaacaagtgtgccatgtgtgccagtgtgttgtgagtgtccaccccatctctcccactgaatttcttcatccatgatcgcccctgagtctcagatccttcatgcatgtgtagagtatagaccgtgagttatatattagaaaggtttacaagcagatggataagacattaagtaatattgaatcatatagtgacaatactattatttattcaattatccttctattttccaattaagtcaagggaaaaagctcaatttaatggtttttttttaacacttgataatcttcatttgtgaaaaagagagagcagaaatttcatgatttggattggatgatctttttgatgtctttcccactcctgacattttatgatttgttagtctattcagataggagctaaggagaagccagctggatggaggtctgtggggtcagtacataaagactattaaaatagcctgaacaataaatggaataggaaggattgttatttatcctttcaaggacattactatataatgcaaacattcataagtggtttagtgtggagtaaaacctttaggaaacaggctcataccctaaatgtttactaaaatgtctccttgttaagccaggttcatggccttctaaggtctttgttttgctgagtggtgtaggtaagcctgtgactacagctccatcgtgtgggacaatatagaggttaattattatcacttctaattctcctttttaggctcttaatctgctcctgaacttaaccctaaaataaatgccgagaaaaacgcttatttaaataatacctgctgaggtgcaaagttaatgtctcctaactttcacatgtcttgatccaaccttaagtggatgcatacaattccctaaaaggagaggttgacagagtagagcactagaagaaaagtggcctgaaattcaagaagccagggtttttctctcacccgttcaatttgctggtgttgtggtaatgactaaatgtagtaaatgctaaggattttccagcattaacatgctatatgtcagtagaaaatggcaagaataccagaatattaggcttgtgttcaacccccaaagattagcagttgaatctaactggacttaaatcactactgcaatctaaaccttgaatttcaacttcaatattagctccattgaaataatatttaaaatttttagtttaaagtaaaacatggtttattatgattttgagcccatcatctgacttagcatcaccctttgcctttatcacggatatggtagttacttggagaggaaaggtttaagcagtgaaataaaatcaagacaattgtagctttattcggaatgttaattaaaattagcgacgtacaaaaaataagatcacctgagggccacagactgataaagatgcatgcttgttttgtaattattcttctttagagggggaatgtaaacagctaagtttatctgtactattggttaaagcaaaagcacctctcagactagataaatttgtattgaagactgaatctgactgttggtttggaagatcctcattccttttaaaaatgtactaccaaaaagagtagggaatcatattcagcctatatcttctttttctattacagcaaacttgaagaagaagagaagaaaaatgataaagaagaaaaagggaaagtcgaggctgaaaaagttaagagagaagcagttcaggtagttgtttgagatcatcagagccacataaatattcaacgatcactctccctagggagggctcctattccctcctcctcattccagtattcttagtttctttgcaaactgggaaaatgtgtttggatccccatatacaagagtactcccctttccttattcaatttattcacattaaatctattaattgctcgtgcaggagagagatcaatcaccattttctcccctgattgtgtcaattatattacctaagaaagaagtatatatagattgttatcttactgtctgaatgcagactaatagagacagatgttcagatttttctcaagtacatttttgaatatgaatatttaccttaaaaacagcaacaactagggatcccacttaattatctgtgagattttgaggagataaaagcatctctgagtcttgagtttgcattctttaacatctcacatgatggtgataacaatgataattgtacattcgttgctactgtatgcatcatggcataaagttttatgactgatatttgtagtagccattgaagggacatattattatctgtgttttatagaagaggacttggaagctgacataagaagttaagaaatatatttaattagttacatataatacaattatatactgatatattatttactatatattaacataaatattatatgatacaaataatatcatatataattataattatatgtagttagtaacttgagaaccaagaattgaaccaaaagttctggctttaaggcccatgatgcactttagattttacacgcttctgccatttgtattattcctgcagactatgccttaggtcctcattattcttttcttttgtccttctgtgatttagaagagctcatttctactgctcttacctttgctctctacaatctactctcaactcttaagccaaagtaattatttaaaaccataaggcaggtcgtgctacccagtggcttctcacctcactcaaagtaaaaatcaaggtccttgtagtgtctggaagtgccatacatggtctgatccctgccacttttcataggtcacatttcctattattctacattgttctccatgcaccaattatactggccaccttttggtttctgggacatcccaagcattgattcatggctttctatcacgtggtcacaaaaacaatgtggttaaaaaactggactctaggctcagactgtcagggttcaaatccttgcttcatttccctaccagtaaggtcctacagttaacatcttcatatattagctttctcacttataagataaggacattattattacgtatattatttttatgaagtcccaagaaacttattaatgtataacagcacagtgtcacacatatcttaagtagtcactctttaatattatatttattgctgttaatgtcattattggtctaatctcattgtccagtggggtgttccatactggagagttcaccaattcttcaacatacaatgaactttaccttctatatgccattactcacagtcagaatatccctcttgtctaccaaaattctggccacttttcatggctcagactgtgtgttaactgctccctaaatattttcccatgtgtgcaatatacttaataactctatcacttgttatgccaacaatttaaaaagtattttagttatattattcattgtattataacttatagttgcctctatgtgttttcttcaaagaaattaaaaactctgtgctagttttctatggttgcgataacaaattagcacactttagtggcttaaaacaacataaacttctcattgttcaactcccacttatgagaacacatggacacagggaggggaacatcacacaccggggcctgtttggggactgggggaaaggggagggagagcatgcaaatatctaatattagccccctcatgcaaatatctaatgcatgcaaatatctaatattattagccccctcatgcaaatatctaatgcatgagggggctaaaaacctaggtgacgggttgataggtgcagcaaaccaccatggcacatgtatacctatgtaacaaacctgcatgctctgaacatgtatcccagaacttaaagtaaaataaaacaaaataaaataaaataaaaaacaatgaaaacaacaacaataacataaacttcttatcttatttcataggttagaaggctaaaaaggatctcactgggctaaaatcaaagggttggcagagctgtattccttttctggagtttgcaggcgacaatccatctctttttctccaaatctagaggccgtccatgttccttggttcttggaccccccttctctgtctacaaagccagcaatgttatatctctctgactgttcttctgtggttacatctccctctcactctgtcttccatctcgctcttgcagttttaaggactgatccttgtgattgagccttacactgagcccattatggcaatacaggataatctcttcatttcaaggttattaacttaattatatctgaaaagccctttttgccatgtaaggcagcatattctcaggtctcaagtattaagacttagacgtatttggtggaacggtattattctgtataccacagattcctttaccaatttaagaggccatacatttttcttctctgtatctttcacagtgcctagtgcagaataatatttgacctgaaggttttctaatgagataaataacagcaatccatgttccaaatgtgtgacctagttctctgaaaagcattttggttactatcaaccttcagcatcaccttttccatgcaatcattatgttttagtttttaaagcagtattgtggaggaagatttctagtgtttagttattggactcttaaaacctgcttctgcttcatttggcaggagctgtgcagtgaatatcgtcattatgtgaggaatggacgactcccctgtaccagagagaatgatcctattgagggtctagatgggaaaatccacggcaacacctgctccatgtgtgaagccttcttgtgagtgggcggcagccactgctgctactgagtgtgggagaagatcagcatcgggtgggcaagaggggtgacattggaagttttctccaggagatagataataaaggctgtctttgcactgagtttggaaatttactattataaagccatatattcagcccatttatttctggtgttcttcaatagtctgagaggtacttgaatcaccatcaagaaaggaccatgtgctaagagcaaaattacactggagttaatggcataaaaggattaggacttctgttctctgcaagcataggtcactgtcaaataatccaaaggtgtaatcattaggtgctaataaattgaaaatgagttaacatctaattgatatcttagtttatttctggggagaagaacaatatctttatttttcaaaagagatatagtcataaaagtttcttcactggtttgctatggcatgtgcgtcttattctttaaacaaccttaagaacaagaacggctgggtgtggtggctcatgcctgtaattctagcactttgggaggccgaggcgggcagatgacgaggtcaagagatcaagaccaccctggccaacatggtgaaaccccacctttactaaaaatataaaaattaactgggcatggtggtgcacgcatgtagtcccagctacttgggaggctgaggcaggagaattgcttgaacccaggagaaggaggtttcagtgagccaagatcgcgccactgcactccagcctggcaacagagtgagactccatctcaaaaaaaaaccaaaaaacaaacaaacaaaaggacaagaacaatgatgtagagagatgtgtgtttacctttccactccaaagctaagttggtggaggtatagaagtaatggaccatttttatgtagagacatttctcctttagggtagtatgtattgggtgctaggaatgattgttttgtcctcccttttcttatagccagcaagaagcaaaagaaaaagaaagagctgaacccagagcaaaagtcaaaagagaagctgaaaaggtagtaatcctgaatgtttatactgcaatgaaaggatgagattttgcagtatctctgtaaaaataactatggaattactgaaaccccagttgtgagggaactaggggttcatttagtccaggggttgagaaactttttcttaacagaacagatagcagatatttctgtttttgtggccatagaatctctgtcacaactactccacttggctgttgtgactgtaaaacagccctagactgtatacaaacatatgggcatggctgactccaatacaattttatttataaaaacaaacggctggccagatgttgctcacaggtcacagtttgcaaacccctgatttattctgttcccatatattaatattaagatttaaaattcagagaaaaagaagaacttgcatgtaaagttaatgggagtatgagtatcagtaccaatagcttcatatttcaaagttctggaacaatagaattcaatcctagacttcctgataccacagccagccttctttctagtacactatttgtttttggattaccacatttggtcaacacatgtgttccttgctttacctgtggttatattttggtgccagcatttaggaaaaagattaaaaagtagcatccccaaataatattttcttggattcaaaaaggctggctccaagtagtttattccaagttgtggtcatttccctgcccccatcaaagactattgagattaaaaataacctctaaagaagtatcgccctggaactctgtatgtttggcttgtttacagttgtattgcacagttgtaataattctaaatttaaaaataatagcagttcatatgaaaaatagattcactcttcaacatctacaagagaaaattcttcagtatgagctaatttctgatttcacattactactacagacaaactctcctctcattattttttcttttgctaaatataactagttaggggatctggcaatgaacctttaagcagagctaggagaaaaattccctctttcatcctcattgaatttcaacttgaactaaagaattcagaataaaatacaaaatcaattgtaattgccatttgtaattaactctttgaacttcagtgattgcttattctgtctcaatttctcacgtaaccctaaacaaggagtgtgcccagtcatcagagaactaagtttattgagagtcttgtgtatggttgcaggtttagtctggattttggggctatcaaggaaaaagaaatacagccaccttcttaagtcctttgtgtttaatataaattgaacactataactgccagaaaaaaaattctcaggtcattttctctctcttttttttttttctataaagcacttagtaggaacccagtaaactaatttcccagaagatactcaagctttctccttttcttttccttttaggagacatgcgatgaatttcggagacttttgcaaaatggaaaacttttctgcacaagagaaaatgatcctgtgcgtggcccagatggcaagacccatggcaacaagtgtgccatgtgtaaggcagtcttgtgagtgcacaaagaaaaccactactgtgggatggtggaattggggaagcaatgagccaggcaaataatatgtattgtgtttgtcctttccttacatgtaatagaaacagaaggttatctgtaaagcatttgaaataaatcttttctttataatggccaagattcacagttctagaaataaaataaatacaactaagctattacattctctgttagttctggggtagaccctgccagtagatcacacttccttgataaaattcttaagttatttgctatcaagtggatcctttctctggattatctcgcaactcatgttggaaagaaaacacacagattttaatgtcaaagtccttacctacattgttgaaaataacacattttcagaaaatgaaaagtaggtctttacacaaagtttggaagtacacctagaatatttaagtccttcaatagcatttaccaaacatctacaatgtacaatgtgtataatgtgtataatgattatacaaaggtgaatgaaatagataatcttctcagaaatcatatagtccactgatattagtcacagacgtaaggtaatataatacaaaggagggactgttgaatgaaaaatttgtctgtggtatgttacagtacttcaagaaagggataattaatagaaagttttatggtgggataaaactagaccttataatttggataaaatgtggacatgacagaaagtaatgagaggagaagaagggaacagcaagagtaaggatctaaaattaggaaaaaaacaagtcatttagtttagtcagaacttaccaactttatcaaccttgaatgcacaccagagatttcgaggtcaattctacatgtaatgggaagctgcaaaagttgttcagataggacagtaagtggcataaatattgttcctttaggaagattcatttgttagcagtaaacaggagaaaaagagaaagaaagtactaaacttaagaattgctactcatgtagagggaggagctgcaataaataacccaggaagaggcagctacgcagagcaaggaggtaggctagaaggcgagtggatcaaggtgggggatgctgtgaaggtgaagtcaatgtcatgtggtgacagctatgcaagctgaaggacagtaagcaattagagatgattccactgttttgtgtttgtttttttgtgaaaggtagaaaatccaggagaaagaatacatttggtagagaagataatgattttggggcctcttgaacattaggtattggcgataaacacagctggagatccccagtgaacatttatgaagtgttagttaattgctcaccttgtcttttttttttttttttcttatggagtcccactctgtcgtccacactgaagtgcagtggtgtgatctcagctcactgtaacttctgcctcctgggttcaagtgattctcctgccccagcctccctagtagctggggttacaggcatgtaccaccacgcctggctaattcttgtatttttagtagagacagtgttttgccatgttggccagactggtctcgaactcctgacctcagggatccactcacctcagccttccaaagtgctgagattacaggtgcaaaccaacacacccagctttactcaccttgtcttgtttatggtgatatatatgtggtgttcttttattttaatgagacccttcctggcaaaggactccatataatttatatttttatttttagagaaggcctgcagcatagtagatgttaactcaatgctcgataattctgtacatatgtgatttgttcatataatgagaaactcaaagaaatgcacaccactctctgtaatctattgttccctacctcccactttctaatttccagccagaaagaaaatgaggaaagaaagaggaaagaagaggaagatcagagaaatgctgcaggacatggttccagtggtggtggaggaggaaacactcaggtgagagcaacctctaatttcagtaactggggcgggctcaactccttgacaataggactgtgaatagcgtatatagtctatggtaaaggcagtgctaagtccttgagagaacagagaagtttctccttaaggttgcagggtaagatatcagcacattttcactgctctggggttcatttggatttctttacaccttgaaataattaacaatatgtaatgaccttatcccagtctcctgagccctctttatggtaatctagacctcatatcaataatcgttctcatcagtatcacatgctcttcattttctttcattattctttcttgccttggacagagccactttttttaggtgtcttttctgttgatccaaggcagcatgataggacaaaagagcacaggctttggagtcagattgggttatgattctgctcctactacctggacttgtgagacattgagtaaattacttcctctcactgaattctactttccctgatttagcagtactcttccagggataaaagaaaataatttaggcaaaggtttagcatgtttcttgaggcatttttaagtgtcagcatggcaatgttgcacataaggtcactccttgggtctctgaacacagtttcataaaattgcagtcgccttatttatctttttacaaccttggaatatcaaaaccatgtcttcacttccagatctgacaaaggcccaatatttacctttgataaactctggctattctgtttttttcccatcttttttgctttaggaggctgagttctcccttttaaggaatagccctgttgattagaattgtctgatagacattttgtgtgtcttgttcataacttggtcaaacctaccttccttgacattttgcataactttgggttttcctccagcatttttctctctcttctatctgcactagagacctgcacatttttttctgtataaggccagctaaatattttaagcaatgtgggctttgtgggtcatatgatgtctgctgcaactattttactctgccattgttgtgggaaagaagcaaaaaaataatatctgaataaatgagtgaggatgtgtttcagtaaaactttatgtgtaagaacaggaagcaggaaagatcttccctgtgggctatacaattgaaccttgaacaacatgggtttgaatttcccaggtccacttgtacttaattttttttcaaccaaacttagataaaaaatacaggatttgtgggatgtgaaacctgcatatatggagggctaactttttgtataggtgagttgtacagggccaactgacagacttcagtatacatggattttgatcctggaaccaatcccccaagtgtaccaaggggaaactgtagtttgctgacatttaatatatgctattaaattcagtcatatttataatttccttgtgtagatccttaaaagcaacattagtagccatgacaactcatctcttataattacaacatgggtgattctggtccccttttctctgcagatgccagacctagatgttaggggtttttttgtttgtttgtttgtttgagatggagtctcaccctgtcacccaggctggagtgcaatggagcaatcttggctcaccgcaacttctgcctcctgggttcaaacgattctcctgcctcagcctcccaagtagctgggattacaggcacccgccaccatgcccagctaatttttgtatttttagtagagacagtgtttcaccatgctgtccaggctggtcttgaactcctgacctcatgatccacccatcttggcctcccaaagtgctgggattacaggcatgagccaccgtacccggcaatgttatgtttcttataaagagaggtgaaagaacttctcttactcagactgttaaaacaatttactaagaatacagtagactaagtaatccaggggctcttcgttcttctctgttttcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattgtaagtatttctctcaacaggcatgtctaaaatatagtcacattcctcttgaatgaatggctatttctcatttgctatggctccttccatgcaaattattctttttgctaatttccaaatattctatttttttctcttgcgttctctaaggaacaatgagccttagcaagggcagctaaccaagtggctgatttctattgtattttctattacaattctgtgaactctaagtgctatcatgatagacccttgttctttattgtgccagaatcctaggaagactttgtcacggccatttggaatcattgaccagcacagttgaagaaagctgacttcttgtcatttgcacgggacacacttagtgcataatccagggtcaatatttgttaacaagatgaatattcacttttttctcctccagggaaagagaagcagagagaaaaaatgagtattctcgctccagatcaaatgggactggatcagaatcagggaaggtgagttattttttgggttttggcaagaatcgtctttctgtgagtcagcagttggcgatcaaaactatagaagaaggtgtcaacatgatcaagctagagcttgcccttagaaggtcaggagttaccaagttatcagtgactctcactgataacttgttcagtgaagaaacctaatgccaagtggacatctttaagtctgacactttacaaggcatttttataaattacagtttatttaattatttcaacagcctggtcaaatttggccttttaaccttatttcgtagatagggaaaatgaggttttgcaagtatactgggatttatttttgtttttgcattattttgctgctagtgtaagttactataagcagatgcgtaaaataacacacatttattatcttatatttctggattccataagttttaaatggtctgattgtgataaaaccaagatgttggtaatgccgcattcctttgtggaggctctaggtgaggatctgtttctttgctttctctaacttctagaagctacctgtattccttggcttgtggccacccttaagccagtgatggccagtcaagtccttcttatgctttatcattctcacactgactgtcctgccgctgcctctctctttaatgagtaagaacctttgtgattacatgggccccacttggataatccagggtaacttccccattttaaattcaactgattagcaatcttaattccatattcaaccataattcctccttgccacgtaaagcaacatatttggaggttccaggaattagaacatagacgtctctctctgtgggacattattttgcctatcacagcaaggttacatggctgcctgactcttggaaagaaatcctctgattctcaaatccaatcaaatattatgtaaaaacagcacttccaatataatcttcccatcttttcaggatacatgtgatgagtttagaagccaaatgaaaaatggaaaactcatctgcactcgagaaagtgaccctgtccggggtccagatggcaagacacatggcaataagtgtactatgtgtaaggaaaaactgtgagtatgtttcaaaatgagcttttgactgtgagtcttaaagtacaataatcatttcttaccagtttgggaaaatgacaattgttttagaagcagatctggtaattaatgaggcgtttgttcactttgattgaaatgtttcattgttttccccccagggaaagggaagcagctgaaaaaaaaaagaaagaggatgaagacaggagcaatacaggagaaaggagcaatacaggagaaaggagcaatgacaaagaggtaatagatgttagacacgctaatacctgaattcagttagttcattgtatggtatatttattcaacaaatatttgtgaaatgctgactctgtcccaatcattggtgatataacggtaaacaatgaagtcatggccagatcttgaaaataaatagcatgctcttcagttccccaggagtgactctgatgcaattgtagaaccagtgacaactgtcaaattattgtagttagccagtgaatttcatttttgaattttttctttcctttgagacagggtcttgctgttgctcaggatggtctcgaactcctgagctcaagcaatttgccggagctcaagtctcagcctcccaaagtgctgggattacatgagccatcgcactctgctgtttctgaattttttaaacaaataaatatcaagcaatcagatgccaaaaattacaaagaaaatcagtatcaaaaatttggagtttgaggccaggcacggtggctcaggcctataatcccagcactttgagaagctgaggcgggcagatcacgaggtcaggaaatcgagaccatcctggctagcacggtgaaaccccgtctctactaaaagtacaaaaaaattagccgggcacgatggcgggcgcctatagtcccagctacttaggaggctgaggcaggagaatggcgtgaacctgggaggcgagcttgcagtgagctgagatagcgccactgcacaccagcctgggcgacagagcaagactctgtctcaaaaaaaaaaaaaaaaaaaaaaaaggaaaagaaaaagaagaaaagttggagtttgagataataaattcttgatctggcatttcattgccacctagtgttcagttttggtccttataaatagtattcaacactacaacaccaacacgtagaatattacacagcacaatcttttaatgcaccgacggactccaattagaaaagataaatagcgaaatttccctgggaagatttttcctattagtagggcaacttttcattaagcctgtagtggctaaagaaaatgaaaccttattagtaattatcattatttaaaaatattttgggaatatctgttgtgtgttacggtagatgaaatggctttgagaaaataaccttattgcacaacttcacatgatctctaaaggacatctatttaaaatcttggtaaatttttaattttatgatccttatttaaaaaattttgaacagaaaaatgctatatatatttatatatagaaaatactgagtaaaaaaaaaataaagaaaatatggaggcagggtgtggtaactcactcttttaatcccagtgttttgggagaccagagcaagagaattgcttgagcccaggagttcaaaaccagcctgggcaacatagtgagaccctgtctctacaaaataataataattaaaaaaaaaatagccaggcatgatggtgcacacctgtaactctagctacttgggaggttaaggtgagaggatcacttgagcccatgaattcaaggcagcagtgagctatgatagcattattgcactccagcctgggcaacagagtaagaacttgtcttaaaaaaaaaataaaaatattgagattgtgtgtgagtgtgtgtgtgtgtgtgtgtgtgtcaaatagagaactaccgttttatctacacatgcaacgttaaataaggtttaccaataattatatttaaacctccccaaaatctattcagtggtgatattgttccaattttttagaattcaggaaaacttaagagaagtgaactacacataattaatgaatagaagagccaaagactgaattggagggttgcaatacagtcagaggagtgctattataaaaatatgtggtattgtgagcacctggaaaagaaaatacttccagtaatttgtgaaaatggtggttgtgagacatttaatatgttgataggtatttaattccagagaattttttaaaatgctgcaattaaaagtaaggcctggaattgtttgtttacggacatcacaatttaaagaaagaagggtaagtacaatctaggttactgtgttattttttaaggtaatgtttccatatcaccactttggctctttgggcttacaggaagttccagagacttctgtagctctctgaagattttagtacattctagatcctatctgtagactcggttctattggcttctttttatgatcattatgtttcaatgaacacaaaaggcagctccatatacttatccacacataggagttttattctctgacttgtaaaagcaaataagtaaaaaggtataacctggtggttagcaggtttctgatcacaaattcaacactgactttatttaatagctctgagatttatttttctcatctgtagaatggggatgatgcgtatttatcttataagatttttacaaccactaaaggaaatctattaaaccacacgataaagcacctcgcacaataatttttttttttttttttttggtaaattgtggttgagaaatgaagctgaaagtttacgtgtttttatgttttgccagaagagtgtcgtttagttcattccagggcttttgaagtagacttatgtgtggaatactgagtgcactcatagggagacaggtttggggctctgcctcatagaaaatggtattaaaatgagatgggacagggcactgggggctcatgcctgtaatctcagtgctttgggaggccaatgcgagaggatcacttgaggccaagagtttaagatcagcccaggcaacacagagagactcccgtctctacaaaaaattttaaaatattagccaggcatggtggcacatgcctgtagttctagctacttagcagactgaggtgggagtgttgcttgagcccaggagttggaggctgcaatgagctatgattgcaccactgcactccaggctggacaacagaacaagattatatatatataacaagattatattatatacataacaagattatatatatatatagatagatataatatattatatatatagatatatattatctatctatctatatatataatcttgttatatatatgtaatcttgttctgttgtccagcctggagtgcagtggtgcaatatatgtgtatatatatatatatatatatatatatataatcttgcttgcaatatatatatatatagtttttaaaggaatgggctgctttagtgaaattccattagggcaagacaatcatttgatagagatgcaatggagaagattcaaacttcttaggtagagattgaataaagtgcctttaaaacatatttcttctctgaaatttcacttctctgtttttttcctgtgttatgagtttatatctaatcggtcaatcatgttatcaggtttgaaagattataccatgacagtaacaactttttctgctactgttggtaggatctgtgtcgtgaatttcgaagcatgcagagaaatggaaagcttatctgcaccagagaaaataaccctgttcgaggcccatatggcaagatgcacatcaataaatgtgctatgtgtcagagcatcttgtacgtaaaaaggtttatcaataaatttgatagttgtgcctgtttgctagaaattagtttttgttacttttaaaacctaagatacttggcatcacacattaatgatatgatacctcctctcttttgaagagacaatttccaaagcactttcacaataatttttttattttgatgttgaaaagcataatcatacccagaacctctggggtaggaagaggtagcttatcagctaggtaacctgggacaggccagttcattgtgcagagcctcagttcctcctgagggaaaaatgactgaacaatatagttttgtggagattcaaggacattttaaaaatgtttatgaacttcaaagcattatacctacgtaaataacattcaaggacattttaaaaatgtttatgaacttcaaagcattatacctatgtaaataacaatcaatattgtgagtttggttataatttaattggaaaagtaaaaatgagaattatagcaactttctagatgagagtcttaagtctattatattaaggaaaaataaagaccttttaggatcatatttttctggataagagtatagtaacagcatctatgaaagttgatagcattgccacaaatatattatcatgaaaattccaacaatcagaactgattagcttataaaaatattcttagatttttttttaggtataagaaaacagtgttagatttgctaatgtttagaatcgcagaaatacttggttaaagacaattcagtaacaacccttgaaaaattaccctatctttttttttaattattctgcagtgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaact

SEQ ID NO: 2041 - DNA, 17236 bp, Homo sapiens
cctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaaaatgcaagatagtttcttggcaatgaggccattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcgtggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttcttttttttttttgagatggagtcttgctctgtcaccaggctggagtgcagtggcgccaacttggctcactgcaacctccgcctcccaggttcaagcgattcttctgcctcggcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggcgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaa

SEQ ID NO: 2042 - DNA, 31690 bp, Homo sapiens
gcgtcggcttccggccgccttccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcgggtgcgcggcgggcgcccgcggggccgaggctgcatggcccgggggaccggggccggggcgcaggggtcggaaggcggcggcggcggcggcaggggccccggccccgggtcggggaggggcggggggcccggggccgggcggggaccgggccagggagcgcgccggccgcccctcagggcgcaagctttgtgccctgtactcagggaagaggaacaggctcagaagggcagaggcaggtatcaggctcactgcagatatcaggggcgcgggacactggcggcctcgcctccgcggcagggccgggccgggccgggctgggctgggctgggcggcgagagccgcggcccggcctggatctggggcctggatctggggccgccgcggagtcgacggcgcagggcggggcggcccggatttaaaggggccgcagcaccgccgtcgccggcgccgcgagggggtggggtgggggccggcggccgggatcccgatcggctcccgcagccccgcgtgggctcgtgcgagtcggcctcaggtaaggctggagtgggagtgcaggtcgaccgcagccggggcggggggcgggcggcgggggcggcgctccgggaccccggtacccttctcagcaacatctcctccgcgcgcggaccccgaccccattcgcacgttctcggggctctttcccgggcgtgaggggctctgggtggcgcgggggactgggcggttgaagccgggagcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagagcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttagtagacacgaggtttcaccgtattggccaggctggtctcgaactcctgaccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacaggtgtcttctatttgtggcaaaggataatggcttttcacttaggttgtgacataaagggccttagaaattgttaatgagttacttaatgttaaaacttagtcacccagaggccgggcgcggtggctcatgcctgtaatcccagcactttgtgaggccgaggcaggcgaatcacgaggtcaggagatcgagaccatcctggctaacacggtgaaaccccgtctctactaaaaaatacaaaaaattagccgggtgtggtggctcatgcctgtaatcccagcactctgagaggctaaggcaggaggatcatttgagctcatcagttcaagaccagcctgggcaacatagtgacacctcatctcattaaaaattttaaaacaaatttttttggatttttttgtaattttatttatttatttatttatttttagtttatcttatttttttttttgagacggagtcttgctctgtcgcccaggctggagtgcagtggcactatctgggctcactgcaagctccgcctcccaccttcaccccattctcctgcctcagcctcccgagtagctgggactacaggcacccaccaccacgctcggctgattttttgtatttttattagagacggggtttcaccgtgttagccaggatggtctcgatctcctgacctcgtgatctacctgcctcggcctcccaaaatgctgggattacaggcgtgagtcaccaccccggcctttttttttttttttttttttaagacggagtctcggtctgtcgcccaggttggagtgcagtggcaccatctcggctcactgcaacctcagcctcccaggttcaagcgattctcctgcctcagcctcccgagtagctgggattataggcgcccgccaccacgcctggctaatttttttttttttttttttttttttttttgagacagagtctcgctatgtcgcccaggctggagtgcgatggcagaatctcggcttactgcaacttccacctcctggatacaagcaattctgctgcctcatcctcctgagtagctgggattacaggtgcacggcaccaagcccggctaatttttttgtatttttagtagagatagggtgtcaccatgttggtcaggctggtctcaaactcctgacctcgtgatccacctgcttcagcctcccaaagtgctgggattacaggcatgagccactgcgcctggcccttttttttttttttttttttttttgaaacggagtcttgctccctggcccaggctggagtgcagttgagtgatctgggctcactgcaacctccgcttcccgggttcaagcgattctcctgcctcagccacctgagtagctgagattacaggcgtgtgctaccacacccggctaatttttatatttttagtagagatggggtttcaccatgttggtcaggctggtttcgaactcctgacctcaggtgatccacctgcctcagcctcccaaagtgctgggattacaggtgtgagccaccggcggcgcccagcctaatttttgtatttttagtagagatggggtttcaccatgttgtccaggctggtctccaactcctgacctcaggtgatctgctcactttggcccctcagagtgctgggattacaggcgtgagccaacgcaccgggccaacaatttttttttaatttaaatttaaatttttattttttaattttttattttactttaagttctagggtacatgtgcacaatttgcaggtttgttacatatgtatacatgtgcccggttggtatgctgcacccattaactcatcatttacattagatatatctcctaatgctatccctcccctcttcccccaccccacgacaggccccagtgtgtgacgttccccaccctgtgtccaagtgttctcattgttcaattcccacctatgagtgagaacatgcggtgtttggttttctgtccttgtgatagtttgctcagaatggtttccagcttcatccgtgtccctacaaaggacatgaactcattcttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggattgctgggtcaaatggcatttctagttctagatccctgaggaatcgctacactgacttccacaatggttgaactagtttacagtcccaccaacagtgtaaaagcattcctatttctccacatcctctccagcacctgttgtttcctgggtttttaatgattggcattctaactggtgtgagatgctatctcaatgtggttttgatttgcatttctctgatggccagtgatgctgagcattttttcatgtgtctgcgggccaacaatttttttaaggaaaaaaaaaaagtgactcagttgggcactgtggcctacgcctgtaatccaagtgagacagccaagtctaaaggggtcccgctttgggaggccgagacgggcggatcacgaggtcaggagaccgagaccatcttagctaacacggtgaaaccccgtctctactaaaaattagccgggagtggtggcgggcacctgtagtcccagctactcgggaggctgaggcaggagaatagcttcaacctgtgaggcggagctttcagtgagccgagatcgcaccactgcactccagcctgggcgacagagcgagactccgtctcaaaaaaaaaaagaggtccaggagaaactcccacacctgcctaagcactggaagaactgggtagagccacagaagctctgcaggggggaggagctttgcagggggaggagctatgcagggggaggagctatgcagggggaggagcatgcagggggaggagctatgcagggggaggagctatgcaggggggaggagcttggtctcatgttcggggtggaacttgggattctatctgggaggcgagaaaccagctagcgggactctctctcgctttgctgagagtccctgtttccctttttttccttcttgcccaataaattccatttttctcactcttcaaagtgtctgcgagattaatctctcatggccgctgcacaagaacctggcttttagctgaactaaggagaaagtcctacaacagtttggcgtgcaacatggggcttgagaaagggtgagtgagatgcaaaccaagaaatttttttcctctctttctaagcctatttatcttcggacttctgagggggaggggaggggaaaccgtgaccccacccccttggtctccgtggccttttccttacttctggacggatgggcgaacggcggttctctgtcgcccaggctggagtgcagtggcgccatctcggctcactgcaagctccacctcccgggttcacaccattctcctgcctcagcctcctgagtagctgggactacaggcgcccgccaccacgcccggctgattttttgtatttttagtagagacggggtttcaccgtgttagccaggatggtctcgatctcctgacttcatgatccgcccgcctcggcctcccaaagtgctgggattacaggcgtgagccaccgcgcccacccctccatgaagaaagtttttctaaatgaaaaatgtttaggacgctcaggagagaaagaacagattaaggaatgatctccaccgcacagacctcaaggctgttatgcatgcagggcacagttccagtgcaaatgtccgcaggcacggcatgagggcccccactgggtgcctcgggctccttccagggcagcagttgaagcgggtcgtactgcaggcctgcagaaaggctggggttcctctccttttcgggttccttcctgatggaatcctaggttttcagcggttccttcctgatggaatcctaggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtagtcctagctgctcagggggtgaggcgggaggatcacttgactcctgggttacagtgagctctaattgccactgcacttcagcctgggccacagagtgagaccttttctcaaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattatctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaagatgtgctacgtgtgtattattactgttgctattgccagaaagtacaatcaacaggaactgctggtggcttgagggggagcatatggtcatagctgactcccaggtttctggcttgtattgtgactgtttctggcctgtattgtgaccatcactgccatcaggaaccctagagcaggtcgggtgtggtggctcacgcctgtaatcccagtactttgggaggctgaggtgggtggatcacttgaggccaagagttcaagaccagcctggccaacatggtgaaaccccgtctctactaaaaatacaaaaattagccagatatggtggtgggcgcctgtaatcccagctacttgggaggctgaggcacaagaattgcttgaatccgagaggtggaggttgcagtgagcagagatcaagccactgtaccccagcctgggcaacagagcaagactctgtctcgaaaaaaaaaaagaaaagaaaacctggagcaggcatggggtatacgtcatgggtcactactcttggatacaattgacgaaaaccacaatcaactggcttaagccgttttataacccagcattaggccagcctggatccaggggtcagatactgagatcaagctttgatctgctcaggattcccccctccccaaggctcctgcttccagatgaccccagtgtgcatttcgtccgccagcgtgggtcacatgtccatccctgaccagggtgctacagtgctctggttggccaagctttggccatggggtttacctcaccctacttttacgcaagagtatgtggtggcctaacacaggtgggggaccctgcttcaataccagcctttatccacagatgaccccacgccttctgctccagagcatcagggttataacacatgggacacacggggcacacatacactcccacgcaacatccacacaccccacaaaactacctgagcccacatagtcagggcagggacaggcacagaacaaagtgggtgcacagggactcgcagggaggtcgaagagctgagtctcgtcgggaggctgagggggaagagcgggcactgggctgcgagtgtgcagagctggaggtgggggactgcggtaagtacccgtcctggggtgcgggccctgctgggaagcattgggagcaagaagggttagatcctcaaaggaggataattcttccagaaggttttctttgttttgttttgttttgttgaggcaccaagattggagtgcagtggcgccatgtcagctcactgcaacctccgcctccgaggctcaagcaattctcttgcctcagcctcccgactagctgggactacaggcacctgccgccacgcccaactaatttttttaatttttagtacagatggggtttcactctgttggccaggctggtctcgaactcctgacctcgtgatccgcccacctcggcctcccagtgctgggactacaggtgtgagccaccgcgcctggcctcttccagaaggttttcgatggcagcaggtggaggggagcgagagggccatcgctcctgctgcaagggcagcccctccacgggatcccacactcctgacccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgcccccccgtcttttcaggaccttgcgcactcaggctggccctatgctttggggtaccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccgaggcaggccatgtttgaatttatttggagaaattcgcccagcccaggggacctctttctgcagctctggccttccagtaggagagggtccctggggctctcaggcctgacaacttggcatcactgaattctctaaccatgtctgtccatgacttgaactccttttcttttagaaagatctttgcaaaccccttgtgggcgtgcccctcccatggcccccgtgcctcttgcctgggctttgggcttgtctgaaagggctaaaagggggtgatgcctggccgggcgggtggctcacgcctgcagtcccagcactttgggaggccgaggtgggcggatcacctgaagtcaggagttcaagaccatcctggccaacatagtgaaacccatctctactaaaaatacaaaaattagcaaggcttggtggcaggcacctgtagtcccagctacttgggaggctgaggcaggagcaggagaattgcttgaacctgggaggcagaggttgcagtgagctgagatcgtgccactgcacttcagcctgggtgacagagagagactgtctcaaaaaaaaaaaaaaaaaaaaaaaaaaaagtgatgtccagtgcctggggatttttcctagggagtggtcaaggaaggccccgctgaggaggagacatttagggtgggaagttgccatgtagggcaggagtggaaagggttttggaccagagggagagccagggaaaagtcaccaggtagaatgagctggcatgattaggaagatggcaagggagggctgtggccctcccatgtgagtggaagggagtggctgcagcgcagaaggcctggaggcccccgcacagaccaggacctctgtagaggaactcatcccctgtgtcccctgtgattgtcaatctccctaaagatggcccagagcagtgcggcctgaatccctcagtggccttgtctctggctgccccagcacccacgcggacacttgactccacgccccaaagaaaagaagcgaacctgggaacaccactgccaaggcataggattatttgggaggggggaagggggaactgaggaggtggttacaacatgctgggcagcaacagacagaaccagaccacccctgtggctgccccggctggtctcctgggaccactgggcgcttggctcaggcctctcctgccctccccactcttccacctcagcccccctgcagtctctgtcctgccctgaccccccagcttacagccccaaaagcagctaaacaactcgcacacccacggggcatcgcctgggagggcagcccaaatccttccacttcagccccatttgaaagatgaggaaatgagaggctggtccatagtgggtctcgcggctcaggtgccgagccttccctgggcatgcacgccgggccctggagggtgggaaggggccagtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgccccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaaaatgcaagatagtttcttggcaatgaggccattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcgtggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttcttttttttttttgagatggagtcttgctctgtcaccaggctggagtgcagtggcgccaacttggctcactgcaacctccgcctcccaggttcaagcgattcttctgcctcggcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggcgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaa

SEQ ID NO: 2043 - DNA, 31075 bp, Homo sapiens
ggatttaaaggggccgcagcaccgccgtcgccggcgccgcgagggggtggggtgggggccggcggccgggatcccgatcggctcccgcagccccgcgtgggctcgtgcgagtcggcctcaggtaaggctggagtgggagtgcaggtcgaccgcagccggggcggggggcgggcggcgggggcggcgctccgggaccccggtacccttctcagcaacatctcctccgcgcgcggaccccgaccccattcgcacgttctcggggctctttcccgggcgtgaggggctctgggtggcgcgggggactgggcggttgaagccgggagcgaccgctgccttcgctgccgcccagggcgcttccccgctcaggagcttcctctgggcctctggacggaggcgcgcaggggcccgggaggcgggaacgatgggcctttctaggcggtatcagggccgatgctcgtggatgcagagcagtgaccagcccagaaccgtaccggcttcccggggcaggggcggcccgagagcgccgctaacgggagcaacgggccctgcccccggtggtgtaggggccacctcgccccgcccagcccagcccgatattgatgggggcccacgccttcattgtttttttgttgttgttgttttttgttgttttttgtttgtttgtttttgagacggagtctcgctctgttgcccaggctgcagtgcagtggcgcaatctcggctcactgcaccctccgcctcccgggttcaagcgattcccctgccccagcctcccgagtagctgggactacaggcggccgccaccacacctggctaatttttgtatttttagtagacacgaggtttcaccgtattggccaggctggtctcgaactcctgaccttgtgatccgcccgcctcggcctcacaaagtgctgggattacaggcgtgagccaccacgcacggcccatttgcgttctaatttcaggcgttcctcaatcctctgtggaaccaggaagggcgcaaattataaagggactggcccagcgccgcctctgggcaggctttgggcagcgcctggcccgctgccggcttggacctcccagacctaggggcccggttcctggtggaggctgcagggacctctgccccacccgcccgggggaggcccgaggggctggactcagactgagattgaatgcggctttgtcttcctagttcagccccggcccacacctggggctgagtggaatcgggagcttcgaggggtctggacagagagattgatgccaagaagggggtggccgagccagaggttgaagtgggctggatcctgaggccccctgttaaaggagagggctccccactcagtgctcctggaactttccgaactagagactgggacttataggagccttctagaggaaactgtcgtgttttcacaggtgtcttctatttgtggcaaaggataatggcttttcacttaggttgtgacataaagggccttagaaattgttaatgagttacttaatgttaaaacttagtcacccagaggccgggcgcggtggctcatgcctgtaatcccagcactttgtgaggccgaggcaggcgaatcacgaggtcaggagatcgagaccatcctggctaacacggtgaaaccccgtctctactaaaaaatacaaaaaattagccgggtgtggtggctcatgcctgtaatcccagcactctgagaggctaaggcaggaggatcatttgagctcatcagttcaagaccagcctgggcaacatagtgacacctcatctcattaaaaattttaaaacaaatttttttggatttttttgtaattttatttatttatttatttatttttagtttatcttatttttttttttgagacggagtcttgctctgtcgcccaggctggagtgcagtggcactatctgggctcactgcaagctccgcctcccaccttcaccccattctcctgcctcagcctcccgagtagctgggactacaggcacccaccaccacgctcggctgattttttgtatttttattagagacggggtttcaccgtgttagccaggatggtctcgatctcctgacctcgtgatctacctgcctcggcctcccaaaatgctgggattacaggcgtgagtcaccaccccggcctttttttttttttttttttttaagacggagtctcggtctgtcgcccaggttggagtgcagtggcaccatctcggctcactgcaacctcagcctcccaggttcaagcgattctcctgcctcagcctcccgagtagctgggattataggcgcccgccaccacgcctggctaatttttttttttttttttttttttttttttgagacagagtctcgctatgtcgcccaggctggagtgcgatggcagaatctcggcttactgcaacttccacctcctggatacaagcaattctgctgcctcatcctcctgagtagctgggattacaggtgcacggcaccaagcccggctaatttttttgtatttttagtagagatagggtgtcaccatgttggtcaggctggtctcaaactcctgacctcgtgatccacctgcttcagcctcccaaagtgctgggattacaggcatgagccactgcgcctggcccttttttttttttttttttttttttgaaacggagtcttgctccctggcccaggctggagtgcagttgagtgatctgggctcactgcaacctccgcttcccgggttcaagcgattctcctgcctcagccacctgagtagctgagattacaggcgtgtgctaccacacccggctaatttttatatttttagtagagatggggtttcaccatgttggtcaggctggtttcgaactcctgacctcaggtgatccacctgcctcagcctcccaaagtgctgggattacaggtgtgagccaccggcggcgcccagcctaatttttgtatttttagtagagatggggtttcaccatgttgtccaggctggtctccaactcctgacctcaggtgatctgctcactttggcccctcagagtgctgggattacaggcgtgagccaacgcaccgggccaacaatttttttttaatttaaatttaaatttttattttttaattttttattttactttaagttctagggtacatgtgcacaatttgcaggtttgttacatatgtatacatgtgcccggttggtatgctgcacccattaactcatcatttacattagatatatctcctaatgctatccctcccctcttcccccaccccacgacaggccccagtgtgtgacgttccccaccctgtgtccaagtgttctcattgttcaattcccacctatgagtgagaacatgcggtgtttggttttctgtccttgtgatagtttgctcagaatggtttccagcttcatccgtgtccctacaaaggacatgaactcattcttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatgggattgctgggtcaaatggcatttctagttctagatccctgaggaatcgctacactgacttccacaatggttgaactagtttacagtcccaccaacagtgtaaaagcattcctatttctccacatcctctccagcacctgttgtttcctgggtttttaatgattggcattctaactggtgtgagatgctatctcaatgtggttttgatttgcatttctctgatggccagtgatgctgagcattttttcatgtgtctgcgggccaacaatttttttaaggaaaaaaaaaaagtgactcagttgggcactgtggcctacgcctgtaatccaagtgagacagccaagtctaaaggggtcccgctttgggaggccgagacgggcggatcacgaggtcaggagaccgagaccatcttagctaacacggtgaaaccccgtctctactaaaaattagccgggagtggtggcgggcacctgtagtcccagctactcgggaggctgaggcaggagaatagcttcaacctgtgaggcggagctttcagtgagccgagatcgcaccactgcactccagcctgggcgacagagcgagactccgtctcaaaaaaaaaaagaggtccaggagaaactcccacacctgcctaagcactggaagaactgggtagagccacagaagctctgcaggggggaggagctttgcagggggaggagctatgcagggggaggagctatgcagggggaggagcatgcagggggaggagctatgcagggggaggagctatgcaggggggaggagcttggtctcatgttcggggtggaacttgggattctatctgggaggcgagaaaccagctagcgggactctctctcgctttgctgagagtccctgtttccctttttttccttcttgcccaataaattccatttttctcactcttcaaagtgtctgcgagattaatctctcatggccgctgcacaagaacctggcttttagctgaactaaggagaaagtcctacaacagtttggcgtgcaacatggggcttgagaaagggtgagtgagatgcaaaccaagaaatttttttcctctctttctaagcctatttatcttcggacttctgagggggaggggaggggaaaccgtgaccccacccccttggtctccgtggccttttccttacttctggacggatgggcgaacggcggttctctgtcgcccaggctggagtgcagtggcgccatctcggctcactgcaagctccacctcccgggttcacaccattctcctgcctcagcctcctgagtagctgggactacaggcgcccgccaccacgcccggctgattttttgtatttttagtagagacggggtttcaccgtgttagccaggatggtctcgatctcctgacttcatgatccgcccgcctcggcctcccaaagtgctgggattacaggcgtgagccaccgcgcccacccctccatgaagaaagtttttctaaatgaaaaatgtttaggacgctcaggagagaaagaacagattaaggaatgatctccaccgcacagacctcaaggctgttatgcatgcagggcacagttccagtgcaaatgtccgcaggcacggcatgagggcccccactgggtgcctcgggctccttccagggcagcagttgaagcgggtcgtactgcaggcctgcagaaaggctggggttcctctccttttcgggttccttcctgatggaatcctaggttttcagcggttccttcctgatggaatcctaggttttcagcagcttccggaggccgcctggactgcagaaggcgccctgggcgtgtgtacttccacctccgcaggcgctggcatctccaggctgcttcaggccgctttggacctcaccatcggtagcatctgcgtcttcttgaggtgactggagcccgtctatggtttcagccattgacttctggacatggaagtgtcgaggccatttttggcccctctcatatccgggaagggctccgtgcccagtagaggtgcagtgcagcagccagctcgcagcagtgctcccgtagagctgatggcattggcaggagtggcggctcagcacagggaagttctccagtgcccaggcccaggcttgctctcggtttaggtcccatggcacgtggggctctggacctgcctgcctccaagacagctcttccaaggttgagggttggaactccacagcctcagcctcccaaagcttgaccaggcccagccatagctagtctaggaaaagagcaaatggccgtgtttttatattttgacttttgcatttcaatattaatttttttggtaatgtaatgcattcaaaacatggtccccccccccccaaaaaaaaaagaaaagaaaaagaaaaaagcatgtttctaaccaggggtccttcatcttctgcagatgccaagggtgtccctggcacagtaaaagtttggaagccctgccctaaagcctcacctcacctggcagctgggtgtttcattcatagcaaatgttctgtatattcaccatgtaccaaacacacatgtcactaatgatacaaacacatgtgcactgacattgacctcctcactgtcttactatagtcccatccacagccaccttatcagagtccatgggactctgacaacttgtaatgggaaaattaaccgtgcctgtaggggccgcctgggtagcgggaggtggttcatgagtaccaggaaagctggccctggggcagacctgggcagggcagagcacagcttgcaggacctagtacacagtgttgggaattgaatttgggttttgacctttgaagctgtgcataaagtctaaaacaagaagaggagtggaggctgaggttgtatttgtattttaaaatgagcatttgccacacaaagccaggagcttcagaccagcgtggttaacacagcgagaccctcctctctgtgagaaattaaaaaaaaaacaataataaaagccaggcatgttggcatgtacctgtagtcctagctgctcagggggtgaggcgggaggatcacttgactcctgggttacagtgagctctaattgccactgcacttcagcctgggccacagagtgagaccttttctcaaaataaaataaaatataaccttttgggcaggcatggaaaggggctggagagaataagaggaaacagagataagccccctccctgggagcacaagggactcatccccagacatggcaccacaggcaaacagacactgtcacaaaactagcatattatctttcctagaagtcctttgttttccccaagtgccctttcccccaaccttttgttggtttacgagctctcaattctaacctcctagtacacgaataaaaatgtctatcggggtggtggcgtgagcctgtagtcccaggtacttgagaggcagaggtgggaggatcctctgaccataagagttcctgaccagcctgtgcaatactgactccatctcaaacaaaaaacagaaagctatacaactccgtttctcttgctaatttgtcttttgtcagtttaatttgcaggccccagatgctgaatctaagagggcagaggaaaagcttttcctccctgacataaccatccaggagaaagtctggaatggagggtcagaggggtagggaatggagttaggagaagtagatagattcaggacagtctttggagaatgtacatcactgaggtcaagatgtcctagggaatggcccttctgggttcacaattctgcttccgtcggttaacagcaacttagtcccttctatgcctgtggggataatcagtcaggataggctggattatgctgctctaacaaccccaaatttctctgatctaataaaagtatactcaaagctgtatacccttcaagggtcccctggggtctctgctcattgtagttcctgccctggctacaggcataaccatgtggaaatcaaaggctttcttggcaaagagaaagagagctctagaagctttagcactggcaaataaataaatgcttggcgtataggtgatatatggctcttctggctcaggtccttggccagaattaatcacatggtctcacctcaagggaacaggtgagttaaatgcagaaaaatattcaagctgggtgaggtggctcacgcctctaatcccagcactttaggaggccgaggcgggaggatcgcttgagcccaagaagatcatggttgccgtgatccatgatcataccacggcactccagactggggaccaaagtgagaccttgtctctaaaaattaaaatatttagaatgtttcctagcataaaagatgtgctacgtgtgtattattactgttgctattgccagaaagtacaatcaacaggaactgctggtggcttgagggggagcatatggtcatagctgactcccaggtttctggcttgtattgtgactgtttctggcctgtattgtgaccatcactgccatcaggaaccctagagcaggtcgggtgtggtggctcacgcctgtaatcccagtactttgggaggctgaggtgggtggatcacttgaggccaagagttcaagaccagcctggccaacatggtgaaaccccgtctctactaaaaatacaaaaattagccagatatggtggtgggcgcctgtaatcccagctacttgggaggctgaggcacaagaattgcttgaatccgagaggtggaggttgcagtgagcagagatcaagccactgtaccccagcctgggcaacagagcaagactctgtctcgaaaaaaaaaaagaaaagaaaacctggagcaggcatggggtatacgtcatgggtcactactcttggatacaattgacgaaaaccacaatcaactggcttaagccgttttataacccagcattaggccagcctggatccaggggtcagatactgagatcaagctttgatctgctcaggattcccccctccccaaggctcctgcttccagatgaccccagtgtgcatttcgtccgccagcgtgggtcacatgtccatccctgaccagggtgctacagtgctctggttggccaagctttggccatggggtttacctcaccctacttttacgcaagagtatgtggtggcctaacacaggtgggggaccctgcttcaataccagcctttatccacagatgaccccacgccttctgctccagagcatcagggttataacacatgggacacacggggcacacatacactcccacgcaacatccacacaccccacaaaactacctgagcccacatagtcagggcagggacaggcacagaacaaagtgggtgcacagggactcgcagggaggtcgaagagctgagtctcgtcgggaggctgagggggaagagcgggcactgggctgcgagtgtgcagagctggaggtgggggactgcggtaagtacccgtcctggggtgcgggccctgctgggaagcattgggagcaagaagggttagatcctcaaaggaggataattcttccagaaggttttctttgttttgttttgttttgttgaggcaccaagattggagtgcagtggcgccatgtcagctcactgcaacctccgcctccgaggctcaagcaattctcttgcctcagcctcccgactagctgggactacaggcacctgccgccacgcccaactaatttttttaatttttagtacagatggggtttcactctgttggccaggctggtctcgaactcctgacctcgtgatccgcccacctcggcctcccagtgctgggactacaggtgtgagccaccgcgcctggcctcttccagaaggttttcgatggcagcaggtggaggggagcgagagggccatcgctcctgctgcaagggcagcccctccacgggatcccacactcctgacccgttcagtatagacggggtactcccggtgcggcctgtcaccgctctgtctggcgctggcgctcctagagaaggccatgccgacctctcccccacctcgctccagattccccttcttgagctgcttttcccacagtccccccaggcgccactgagagcctcccgtcttcgatgggcttggggcgcctggacccttccggggtcactttgccgtcttcctccagcccccctccctactccttgtcgccgcccccccgtcttttcaggaccttgcgcactcaggctggccctatgctttggggtaccccagcagtgcccccgggtctccggccacccggtgacggagggagggagaggctggcgagggggcggcgccttaggtcccagcgcgacccgcctctcagcccctcccgccggctacagccgcgcgggacggggcagggacctcgagaacaccggggacttgcgggccggtggccccgggcaggccacttctgacgcgggtgcgaggccttccgcgggcgtgcacggttgggccggagccgcgccgggggccgggacacgcctggggtcagcgctggcgtcgccgctcgggtggggtgggccgggttcgggtccagtctcctccccacgggcggcccgcgccccgtcttccagtgacccccacatcccttgcgccccgagctggaacttcggcaggttctgccccgggccgcgcgcgctttctggggaccagggctgtggttcctgctccgcgtcgtgcctttagacaccgccgggcgttcgtcctccatccctccccccttttccccactccgcggttgacgagggccgcccccaagtggccatgtcccccggcatggacgacccctcagtgcccctgagggcccagggtctcgcccccgtcccgaggcaggccatgtttgaatttatttggagaaattcgcccagcccaggggacctctttctgcagctctggccttccagtaggagagggtccctggggctctcaggcctgacaacttggcatcactgaattctctaaccatgtctgtccatgacttgaactccttttcttttagaaagatctttgcaaaccccttgtgggcgtgcccctcccatggcccccgtgcctcttgcctgggctttgggcttgtctgaaagggctaaaagggggtgatgcctggccgggcgggtggctcacgcctgcagtcccagcactttgggaggccgaggtgggcggatcacctgaagtcaggagttcaagaccatcctggccaacatagtgaaacccatctctactaaaaatacaaaaattagcaaggcttggtggcaggcacctgtagtcccagctacttgggaggctgaggcaggagcaggagaattgcttgaacctgggaggcagaggttgcagtgagctgagatcgtgccactgcacttcagcctgggtgacagagagagactgtctcaaaaaaaaaaaaaaaaaaaaaaaaaaaagtgatgtccagtgcctggggatttttcctagggagtggtcaaggaaggccccgctgaggaggagacatttagggtgggaagttgccatgtagggcaggagtggaaagggttttggaccagagggagagccagggaaaagtcaccaggtagaatgagctggcatgattaggaagatggcaagggagggctgtggccctcccatgtgagtggaagggagtggctgcagcgcagaaggcctggaggcccccgcacagaccaggacctctgtagaggaactcatcccctgtgtcccctgtgattgtcaatctccctaaagatggcccagagcagtgcggcctgaatccctcagtggccttgtctctggctgccccagcacccacgcggacacttgactccacgccccaaagaaaagaagcgaacctgggaacaccactgccaaggcataggattatttgggaggggggaagggggaactgaggaggtggttacaacatgctgggcagcaacagacagaaccagaccacccctgtggctgccccggctggtctcctgggaccactgggcgcttggctcaggcctctcctgccctccccactcttccacctcagcccccctgcagtctctgtcctgccctgaccccccagcttacagccccaaaagcagctaaacaactcgcacacccacggggcatcgcctgggagggcagcccaaatccttccacttcagccccatttgaaagatgaggaaatgagaggctggtccatagtgggtctcgcggctcaggtgccgagccttccctgggcatgcacgccgggccctggagggtgggaaggggccagtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccaggtaagaggtcactgagatgggtggcagcaggggccggggatccccctattacgacagcggtcatgggacgctgactcactgccggccagaccacctgacctccgcggcgggaggagagggccctgccagggggttcccgccgcgccttgtttacctccgggaggcctcggcctcgcgtgggggcagggcggccgctggggccgcaaggcgtgcggggaagggccagagccgggtgtccaccccagcttcccaaagactccctcttctgtgcttccttctcccctccccgccccccccccagtctcttcacatgcccctagcccccgcggaaacttcccgcgatcccaaacgggccaaatggcgagaaagcaaaggagctccttcttgggggtgagtggggcgccttgagcgcttcctcaaagctatgttcccagagccacaggccttccttgtgtccctcaccctgctcagaccgggccatagccgggggctggggcaggaaagccggccctcggcgggggccacgtggctctcaggcgcctgggctgctgagtcacgcttggccagcacctgtctgtaggccacagcctctgccagcacgcccctctgtgtcccctgcccctgtctgcaaggcagtggctccagcaggccctggggcattttccactctccaccgccggatgcagggagaggcctgaaccctctccacagggctgctctgggcagggtggaagccttgcccacttcggagccctccgggaaggatcattcacacctgtggaccagcccctgctgtgcgcacacccacacatcaccttcgcacctgactggccccatccagccactcttgcctccctctgggtttcctcccctgggaggtttctccagctcctgcaagccctgggctgaaatggcatgagttggacccagcaggttctgacctcctactcacaggaccttgcctgggaggctccagagggtgaccactcgtcctgcccctctccttgccccagttctggcggacaggttactctggtggcataaagcagtgtttcttccttcctagctgaggaggctgttggctgacccccttggctgcccacaaggccaacgggcctgagcccccacagggccatgggcattacctgctgaattgaggagcccataaggagtcacttggaccacagtgaacacttggcgaccactgacactcaggagaccttagctggtcctccagcacctctcaactccactcctactaaactgggaacttctctggtgctcaggccagagtcggggtccgtcaccgagtatgctatgcgctgcccatcaccgaggatgccatgcgctgtaagagggctgccaccgcggcaggctgaccatggcagggtcggaacagcaacctgagagccagcttgttctggccagcagtgcccactgggcgacctagcagcctcctgatatgggggctgtgtccccctctccctgcactgggtacccccaactgaggatattgctgagtcatggccaggcccaagcctgggaggggcgaggggctggacccccgccagtaccctgatcccaggtgcagaggctggagcccaggcctgtatgagtgccagggccggtttcctggggtccttggtgcaccggggcaatgaagagaggggtcagcaatgagggggccgggagacctggagcgaggggtagcggggaaggggagagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtgagcgggccggggagcggcgggggcggtgacgcaggccggacacggcctcctgccgcggggtggctgccccctcccttctcggcgacgcctggcgggccgtgagggggtctgcgctggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactgaggtgcctaagtgcctgaggccacaaatttacctgcacagcccttcctacctcaggaggctgccctctcaaggtaccctgaggtgcaggcagggaggcccttccagcccaggggtctttgatgcactttgttctcttttgtgatggttgtcaggaagatcagagccaaagttgctgaagtcctttgaaacatagttataagtgaaagacttaccgttagctttgtagtctagatttttggattctgattttattaatgttactgtgtcctgtgaatcacctcaccctttgggacaaagatggggatgtttgcttgactttgagtaaataacatatttactcaaggaggtgatcaatattcacagtgtactgagcctgagcctctgtggggttgctgagcaccagggtcacagatgagggggagatggcacgggagagtggagatgctctctgtgcagggccagggggtgcagagtgggaggaaggagagggggatgctgagtgggtcactggacaagatgtccgggttaaaggtcacccgggaacacagggaccttggcaagaaggtgacaggactgtgacaggtatccaaggcattaaagatatctttatcttatctttgtaaaaatcaaagcttctggtccatcggaggatccgagtgtgaatttcctgaagaacgttggggagagtgtggcagctgcccttagccctctgggtgagtgcacctccttgcccagtgcttccctaactcagcctgcactttatgtaactttcacctggaatactgcaaaggaatgggtaattgacatgcccttgacactggtgaggatttgttgcctcaaatcaacctttagtagtgctggaccacgggcaactcaaggttgaattccctgacaaaattctcgagctttctacatggagtgaagtcgaatcagctggcatttggttgggataatcccagtgagggagggtgaccagactgtggttgcaggtcttgcctgtcacctctgactgccctcctttggatgaacaatagtctgcaatttcccctaagccaggccttgggatttggacttttgaggacctgggtagtagttagttgacatgctatttatcttttccttcttttagtttacaacccccaaacctttctggtgcttctgagtgctgggcctgcctcagagcggggagaaggtggaggcaggtgctctgggtgacacccggttctggtgcctcaggttgcacagtgggtctgtggggtgggtgaaggtgccacctgaccccaggcatgagctcaggctctgagacccctccctgctgggctttagaaagtgcctgttgcgtctggctaagggtctcgggtgggtgctgcagggttaggcatgcggcagtgagaatcagtgaatgaagccaacttctagttcaagatgacggtggatctgtgatggcagatggatcgctgggacacctgcatctctcgctagacgagtgagcttgtttttgtgactgcagtggcaggctgtgtccacccagcctgtccaaaggttgtgttcagtgtctgaaagaatgctgctaggaggggcgtccgaaccatgcctgctgcctcctgtggctacagggcgtgactgccatctgctccaactttgctcattccgatttttttttttttttgagatggagtcttgctctgtcacggaggctggagtgcagtggtgccatctctgctcactgcaacctccccctcctgggttcaagtgattctcctgcttcagcctcctgggtaagtgggattacaggtacccgccaccacgcccagctaagttttgtatttttttagtagagacggggtttcgccacgttggccaggctggtcttgaacttctgacctcaggtgatccacccgtcttggcctcccaaagtgctgggattacaggtgtgaaccactgcgcctggccttgctcattccactttgaggcggcagtgacatcttggcattgcttctgaactaaacagcccaaacacgcatggcttctgtactagagtttagaggtgaagtcagagaataggaaagaagaatcgctagtctgtttttttttttttttctttgagacagactttcacccttgtcgcctaggctggagtgcagtggtgtgatctcggctcactgcaacctctgccttccaggttcaagcgattctcctgcctcagcctcccaagtagctgggattataggtgcccaccacaacgcctagctattttttgtatttttagtagagacggggtttcactgtgttggccaggctgatctcgacacctgcctcggcctcccaaagtgctgggattacaggtgtgagccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagatgtctttttttttctgagacggagtctcgctctgttgcccaggctggagtgcagtggcacgatcttggctcctgggttcacgccattctcctgtctcagcctcccgagtagctgggaccacaggcgcccaccaccacgcccggctagttttttgtatttttagtagagacggggtttcaccttgttggccaggatggtctcgatatcctgacctcgtgatccacccgcctcagcctccccaagtgctgggattacaggcgtgagccactgcacccggccctcagatgtctttgagcactaaaagctaaaggcttaaagtggatagaattgctttctccgaactagggaggagcctgaagctctacaaacaaggaatatttcagtaaaatagactgagtggtttcagctgaggagagccagtggaggagcggcttagactgttgtggaagttagggctagtttctttctttatgaggaactataagctggatgactcacaggttaactgcctagaagggactgttcccagagcagggcccaaaggggaacgaacgagtcaacagctgcctcccggtggcagtgtgtgtagggtaagcggcagctttcatgtgaagtgccaaggccttttggttggggggctgagaacctgctgagggagccacaactgagacccaggctgctcctggctgggaggctacaggccccgaagccacagggcccctcctggtcgtgggatctttgataaaccgacacgcagaggctttgtgaggcagcagggcacggagcatcgtctagtcttttttttaagtgaaagcacatttcttaagaaagtaaaggaatacaagaatggctactccgtagacaaagtagcctgtccagtcttacgacaaggcctgaaaatctcacgctttcatcaccaagttggagagatcctaattctataatttctctgatctgcttacaggcgagtctcattacccatttacaaagcatatgggtattgattgtactattctttcaacttttcaacttttctgtttgtttcaaccttttttttttcttatctttttttttttttttttttttgagacagacttttgctcttgttgtccaggctggagtgcaatggtgtgatcttggctcactacaacctctgcctcccgggttcaagcgattctcctgcctcagcctttcccagtagctgggattacaggcatgcaccatcacgcctggctaattttgtatttttagtagagacgaggtttctctgtgttggtcaggctggtctcgaactcccgacctcaggtgatctgcccgccttggcctcccaaaatgctgggattacaggcgtgagccactgtacccggcagcttcaaccttttcataatcacaagttgggaagaataaaggagaaaaataatttaaatattacagatggaggtacttgtagttaagcctgcttttacctctgctccccccttaaactctattgaaataacaggaaagggcttacacaaaaaagaaaacaccatagacaaagaaagtaatagaggaaaagacaaagatgtgatcagattttggaagatggacatggagggagggtggcaacctgctgagggaagcttcagaaatctctgtgccagaacagggcatcctggtgagaaggaagaccatctgttcaggtaccaggaaaggcaagaggtgggagtgatcgggggacaggaacaaggggggagggttgaaaacctctagggagtgtcagctagagacttcagggcccacttggccagatgatggctcttgccaacaattgaaggagacctcatgtttaattccaggagcacctgacccagggaagcttcagcatgggatactagagacaggccagggtgaggcaccagcctgaaactgggcatcccgaatgagcaatgggcccagcagtcagttccctggccaggcaggaggtggggagtccctgctgagggaggttgaatgcccccagagaagtgtcctacagctcctgcctgccagacccccaggcaccctgcagagggaaagttagtgatggcgctggccccacagaaggcttcctgtcaaccttagtgcttcagtgggatcagacccctgggtcaccagccatctgaggaaagcccccacacatgggagaaaaggtcttaaagggaagagaatgttaatgtcctcagtgagatacaaaagagcattgtctgcatgaaaaaggaacaggatactagaaaaaggataacaaagggaacagaataagaaagttcttaaaattaaaaaatagaaaaaaaacttcaaaagaaggcttagattctactattgtctcaaggagatattccaaaagcaaaatagagatagtttttttatctttcctctcctcctaatgtaggaacaagtctagaagcccaatataggatgagtaggaattccagaaagaatagaaaactgaaaggaggaaatgaacatagaatgcaagatagtttcttggcaccaggcatggtggctcatgcctgtaatcccaacactttgggagaccaaggcaggcagatgacttgagctcacgagtttgagaccagccttggcaacatagggagacaccatcccccacttcccgtgtctacaaacactatgaaaattagccaggcatggagttgtgtacttatggccccagctacgtgggaggctgaggttggggatggcttgagcctggaaggcagagggtgcaacgagcctggattgtaccactgcactccatcctgggagacagaaacagaccttgtctcaaacaaaacaaaacaaaacaaaacaaaaaacaaaaatgcaagatagtttcttggcaatgaggccattatcttctagattgaaagcggccctgacaatgactgagaaagaccccacagcaaagcttatcattgtcaagtgtcagaaccctgaggataaagaaagaggggcttctaaaactctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgggattacaggcacccgccaccatgcctggctaatttttatatttttagtagagatggggtttcaccatcttggccaggctggtcttgaactcctgacctcatgatctacctgccttcgtctcccaaagtgctgggattacaggcatgagccactgtgcccagccccgtgcccagctattttaaaatttttttgtagagatggggtcttgccatgctgcccaggccgattttgaactcctgggctcaagagatttctcatgttgttctcccaaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgtgggagaacatagggaaagttagcaaatgcaaagagaaggcaggctgggtgcagtggctcatgcctgtaatccaagcactttgggaggccaaggcaggcagatcacctgaggtcaggagttcaagaccagcctggccaacatggtgaaaccccgtctctactaaaaatataaaaattagctgggcgtggtggcacgtgcctatagtcccagctactcgggaggctgaggcaggagaatcacttgaacctggtgggcagaggctgcagtgagccgagagattgcggcactgcgctccagcctgggcaacagagcgagactctgtctacaaaacaaaggaaaagagaagccattatcagtggtaggaaaacaaaaagcgatacaaagaaatagtctgctacttgacccagcaaagaacatttagatagaggtcctagctgaaacattgaatgttcttttttttttttgagatggagtcttgctctgtcaccaggctggagtgcagtggcgccaacttggctcactgcaacctccgcctcccaggttcaagcgattcttctgcctcggcctcccgagtaactgagactacaggcgattgccaccacgcccagctgattttttgtatttttagtagagacggggtttcaccatattagccagggtagtctcgatctcctgatctcgtgatccgcccgcctcggcctcccaaagtgctgggattacaggcgtgagccactgcgctcggcctactgaatgttcttttaacaaaaaattgcgtcttggaaagggtagtggaaggagaggcaggtactggtccagagtaggaagtgcgcagatgtgaactccagcagcaggcaagagcagcgtgagctgaaagggcacagggagagtttggggagtgggatgggggcagggagtgtgcaccacagcctttggcaactggtgactctaagctgtgggtgtggagacttttgacacatttaatttcaaaaatagtgcaggtgattctcccctctgtccctggtgagtcacgtgagcctggaggtgtgcaggttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgacagaaactcctcattgtcacatggcagccgtgtgtaaaccaaggtccgtgtgcacaacctgctgtgggccgccgctgtgtgtcttctctgccttagggcaggggatggcgagctatggcctatgggccaagagtagttcttatttttgtttatttatttatttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggtcacagatcaacaggataagaatttttcttagtacagaacaaaatgaaaagtctcccatgtctacttctttccacacagacacggcaaccatccgatttctcaatcttttccccacctttccccgctttctattccacaaagccgccattgtcatcatggcccgttctcaatgagctgttgggtacacctcccagacggggtggtggccgggcagaggggctcctcacttcccagtaggggcggccgggcagaggcgcccctcacatcccggacggggtggctgccgggcggagggtctcctcacttctcagacggggcggccgggcagagacgctcctcacctcccggatggggtcgcggccaggcagaggcgctcctcacatcccagacagggcggcggggcagaggcgctccccacatctcagacgatgggtggccgggcagagacgctcctcactttccagactgggcagccaggcagaggggctcctcacattccagacgatgggcggccaggcagagacgctcctcacttcccagacggggtggcggccgggcagaggctgcaatctcggcactttgggaggctaaggcaggcagctgggaggtggaggttgtagcgagccgagatcacgccactgcactccagcctgggcaccattgagcactgagtgaaccagactccgtctgcaatcccggcacctcgggaggccgaggctggcggatcactcgtggttaggagctggagaccagcccggccaacacagcgaaaccccgtctccaccaaaaaaacacgaaaaccagtcagtcgtggcggcgcgcacctgcaatcgcaggcactcggcaggctgaggcaagagaatcaggcagggaggttgcagtgagccgagatggcagcagtacagtccagctttggctcggcatcagagggagaccgtggagaaagagggagagggaaagctatatcattcttatgtctttgcatcatcatagcttagcatctactcataagtgagaacatatgatatttggtatccattcctgaattactttacttaggataatggcctccagctccgtccaagttgctgcaaaaggtattatttcgttcctttttgtggctgagtagtattccatggtgtatatataccacattttctttatccactcattgcttgatgggcagttaggttggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccatcatctcttgcatggaggagtgtaataattggctaactggcctgttcttacattttaaaatcaaaagatgtgacaggtgaaatgcctatttcagtgtccattgatggttctgcttacacaccacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaa

SEQ ID NO: 2044 - DNA, 6428 bp, Homo sapiens
ttctggtcagggttcacatttaattagctcaacaacagaaaatcttttgttttcgtagtttttggatttcaaaaaatggataagagactgtaatctgttttctgcgtttgcagtcttcatactgtgatggaaataatggttatgttacaacagaacttcagtctaacagtttctcatcttttaatactatttatggtaaatacatatatataacttacttgcaatttaaattacaaaattcatatacaaagtaagcaaaaaggcacacataagaaatccaccttgaccacagaaatgtgaaaacaccagccctaatgaccaagacaatgtttcaaagacaacaaacaccaagaaaagttgagattctacaataaatcatattaaacgcaagcactatgatgcacagacgtgagcactgaatatttactaaagcataaaacttaggaaaaatcattttacggggaatctattcatattccaaacagcattttaaaaaacattaaacttagcttagttttaaaaacaaaattcagacccaaacaatcaagaaccagaaaatgggtttcttaccttttgtttccagtaggatgtgggctgaacagcaaggtgggttattcaatctgatgttatgaaaagtaattgcttcttaaagagacttaagtttttccttggttagaaaataattataggctccctaaaatattctaaggggacataaatagggagaagagggggaaattccaagacagcttttgtagtttcaaaagggtgtaactttcttctaataattgccaatacggatagagacctaaaggtccattttctgagactataaataggagcagtccatacttcccatcacagcttttagctgtctggtcatcttaactacaaaacctatgcccctttacctaagtaaacattagatcctctctaatcttcaaattcagcctgtataacaaggaatactgtctcatttcaatgtgaggttagaattactataacttttagtagagcacatctttcaactttaaacactcaaacttgagtgaaggccatttacattttttggtcatttccaaaacattcaatgaacacaaatgaaccaaagtttacttaagtctagctcacattaaccttccaaaattatcattaatcatttattttccctttaataatctgatgaatttttaaaatgttctacacataaaacttcttagaatttcaagaatgtcatgtaaaattattcaaatttttaaacagtaaatctgccttttggccattacattgaattcttagataaaaagagctacatccttaaacttacactaagtacttagtgaaattctgcattcaacttaacatcccctcttcccaacattccacaacgttcattaaaatctaccgattggggtgaccttacacatttcttccactaccaagatttctggttttccttaggtttttaattgtcacccaaataatcaccttaaattcaacttccaactatgattagcacccaagggaaatgttaaagtctatttattttaggtcccctcccccaacctaaatagtaccaaggggctgtcagtagacaaatacaagaagtagcaggctaaaagtttttaactgctttggtagagaacaccaaagtttttggtacaaaataatcttatggttggagaagggcttataaggcaaaattctaaatgcccagctttttattaacaatgattcatccaaagaagcagttaatcttgtgcactcttccctttcaaaaaagaaatgagacttgggttaaaagttctacaggctgagcatggtggctcacacctgtaatcctaacactttgggaggccaaggcaggcagatcacttgaggccaggagttttgggaccagcctgggtaacacagagaaaccacatctctactaaaaatacaaaattagccgggcaagggtggcacacacttgtagtctcagctacttgggagactgaggcacgagaatcactcaaatccaggggtggaggttgcagtgagcctagatcacaccactgccctccagtctggagaacagagcgagactctgtctcaaaaacaaaaaacagttctaatacatctgtgctgatgttaacatttaatacttacctttttttgagatgagtttcattgagaatatcaaaagctatctccaagtgaacattagtagccatcaaccaattttgcacaaaagcctatgttgtctatgaccaccagaaaataagcagcatctatagttttttaaccactttataacaaagtagagaagcttatctttcagatgctagatccatcccccaccgtcatttaccaagttacatacacaaatgccttattctccccttttgctttcccctgaagacttttacaattaacaataaaagatggctaataccattagattgccttttaagaacttttaatttgctaacacattaacacaagagtcaaaatcttatcttacttaacaatttaaagattaactgatagacccagttagaatcttacatgaagaggaaaaaggacaaccatgcatagttttttaaaaaatgtttattttttcaaagaaaacggcaatagccaattggaaacctacttattcttcaactccaattttgttttctttaaatttagaagtgacttactgatttactattttaaacaaaccccccctttcccctttaaatgtttaccatctactcgtgctgaatccttccaaggagattgctccagcgtttatctccaggtcctcgctttgctccttttaccaaaaaacgcaaaacacaattccatcgtgcatcttaagggctccaatcgtcaaaaataggaaaaaaaaaatctttggaatagccaattaagttgaataaaaaaatccacacgaatgcggtttggttggggcaggaatccactcctatgttcctggtaatctgatcccgctccatgaatcctggtaattcatcctccctatcctatccacattatgatttgaatccaatgatccagctccaaggattgggatccagtgagccctctccaatccaaacctttataaccagcaaaaccaaaaaagaggaggcaaaatgttagatactgtaatcaaaaaaggtttctggggaatgatgagttatgtctgtcatcagtttaacagatgcacatcaataactatcaaattccccaaaacaagtttctgaatggtgttcagataaattttagaaacttaatcatcatagagactaattggaagaagcattttgtatttacagttcaactgataatgccaacacttgttactgtacagcgtattacaggtttcgtggttgcaagaagttacgtaatttaagtttactggcattgctacccacctaagtctaaaactaaatctaatgctcccatttgcaatttaatttgtaaattaaagtcttttaaacatatgaaccaattatgaatattagtttaaaggggaaggtgagacttaaaagtattcccaactagattatctacaccaatacattggaactctatattttgctttcattttgtcttaaaaaaatgaaatagcaacgctctatcagtcacacagaggacatgcagatttagcagtattgatattatactctatcttgttggatttaaaaacaccctgtacccacatgtacaccaacagcaggtcacacattaacagttgtaactaagcactgtgacaaattagccagttcttcccacattagtccctattaaaacaaaaatggggggaagggagcaaaataagttgctacaaaatgggcaatataattttgccacaattgccaaggtttaaaaagcaaagcaattgtagctaaagacaactgaataaaatgtttgcaagtgttttaaggaaaatgtatataatcatttttaacccctgccttttagtataaggtcaatactgccaatttcatctgtgacaatagcacttggagtcataccattgcctccattattgatctgatcctcctcaatcctccttttgacaatcctaaaatgattgaaatgtgctccacaatccttaatccaaagcattcttaatccatctcttcagatatgtctacagaaagacacatgaaaagcaagataaacataagaacttccccaggtaagataaccacaaacacccccaacatcccagttcacacaaaccagggcagatagacatttacacaatatcacagtctgaagagtatggagttaactaaatttaaacaatcctgtctatgacatcacttaaaatacaatttatcaaagacacgaagggaatgtagatgttaggagcaaggggatattacaagaatgcaattcaacactttagcccattctgaacaaaacagtttgaattaaaaaatgaaaagattgtactgaataaaggaaaactgtatacaacatgggttctacaaaaagtgtcaccaatcatcttatgtacgagagcgagatctgctatgacggggagaatagcgtggtgatcctctgcttctccttggggagtaactgcgactcctgctgttgcttctgctacggcttctgctacgactacggcttcgagatcgagatcttccataacttggacttctgggcccatcaactttaacccggatgtaggcagtttctccctattggatagacagaactttccattgaaagatctaagctttcatctatcttcagacatgctgaatgaatacaatgtaactaaaaccagaaatctggcaatttacttggacaaccttgcctgaatccttaccttgaaattccactgttaagaccactgtatccaattctggtcaaagaaaagaatacgtgtataacctacctcatgagatctaaacttagtgttatccagttttcgaactgcataggtcatatcttctttccgtacaaactccacgacaccagtgccatctcggtaaacatcagcataacatacatcacctgcttcacgcatgtgatcctttaaatcctgccaacttccacttggaggcagtcctgaaaaagtgattttttttttcttagtaccaattatcttaaatttcacgttaagctggtaaggtacattaggacaaagagtactttaaagtacttaataggtgtacttaagtgataccaggtaaagagagctggtaagattctggaatccagagtccaaaattatttgtaacgatcttcgtatctagtaccgcaacctaatttggtaaatcaccacagcagcaatcctcgtttattaaattcacccaaaaactaaagcaatttaagacctagcatgaaaaatttgcaattattaaacctgtcacgcaagagaaaaattttaggtagttttcgtcccttcacatcaatccacacaaccagtacactcaccagagacaaccactctgttttcagaccgcctggatggggggccatagcgacctcggggagctccgccacctccacccccgccgccgcctcggcctgttccacggccgcttcgaggaaactccacccgcagacggtacccatcgtaatcatagccgtcgcgaccatacaccgcgtcttccgcgtctctgcgggatcgcagaaagtaaaagggatgagaaacaccaggaggagaagctcgctcagttgggaaccagcaaaccccccgcacatgcgcacccaacgtggaagagcccacatgcgccgcataataggaatggcccctcccccacccagaaacacgccaggctcccaaccactacaccagccctcagcgcctcagtttcccgctccagcctgcgaatgggctccggggacgtccaaggcgaggcgccagagaagccacatcaactcagctccttactcgactcctgcatgggcgatacagtctcgccccaacctctctaagagcccccgcttccccgttctctatgttaaggccttggagccttccccaactactcggacctatttcctcaaggctgcaagccccatgccgcctcaccgcgggtcctcgaactcaacgaaggcgaagggcggtcccccgcggcgattcttgaggtcgatgtcgcggatagcgccgtatttgtagaacacgtcctcaatgtccttggttcggatgtctggaggtaagttacccacgtagatgcggcaatcgttgttccctgcggggccacgaatcacaccacctcccgacatggcggtgacgaaaagcgcggactcgagaacaggccttcccaccaagcctagcgcacggcagagcgagcccgcagcggcaccacgtctcccgcggcccctccaaaatggcgcctttatcagctcggcgcacggatatgggggggagacagaggaagagaagcggaaggaaacagcgattcgatcccaacacgcacgcgcgggagcgcaac

SEQ ID NO: 2045 - DNA, 6428 bp, Homo sapiens; identical to SEQ ID NO: 2044

SEQ ID NO: 2046 - DNA, 6428 bp, Homo sapiens; identical to SEQ ID NO: 2044

SEQ ID NO: 2047 - DNA, 45215 bp, Homo sapiens
gaattttagaattttaatacttcttaaaagtaaagtctcttggctagtgcagtaaaatgaaaccatgccgaattcccaaagggcaaaaagaactgacagctaaacctcagcaattagaaacaatattgttttaatgttgtcttctttgttttttagtcatttcaattgtaaaatcaactgaaacttaggttctcgccatctatataaaaactgagagaggaggcctcagattgtatgcagtgccacggaaagcactgtgtgcatattatatttaatgcaatacagatactttagctttaattttaaaacaaaactcaagaaatctttatctccaccaaagaagaatacagcatttgcatgataatatagttgtggtagcagtagtggaaaaacaagatacagccacatagacagcagtatgtaaaagggaagaaccttgtcaaacccatctcttaatctactttttgtgtcagtgataaggaaggaaaaaggtaaaaatacagtatacttcacgaaacatcatccactcaaaaaagtgtctggaaaaagtacaggagagagaatggaaccattcgcaaatgtgaaaaacacatatatcagcgaaacatatgcagttctcaatgcagttacataggaaatgagttttgaaatgatctgattctcatattatctctggtgtattattcaagttgtcagttactgctttttctactcctttcccaattttgtggctaatagactaaataccaccctaataacaaaaaggacaaagtagcccatttaagaaacatgaattaaatttctgagtttatctacatctatggttaatttcaacttttgaatgagtggttgtgaatagcctaactcccttgggagaactgtaaaaataattgtatgtgaccaagatgaaagcagaatgtattcagctttggatatcaaacacaacttgtgaatttggaaatgtacatccttctattgatattagctagtgtcattaagccataacaaacagtaaagctaatattctcttctcaagaaacagaatttgtctttgtctttaaatagccaatgtgaaagatgtaataaaatacacattttccccctaccagatccatgatggctacctttgaaagaggactgatataattgtatataaacttggctttgaactatttcacaggtaaaccaatggaaaactgccagttacacttaaagcaaagaaaacatgtaagaattctcccacagaaatttaccgttcctacgtcaagcagttccctaaataaccactgatttatccaacaacctataacagttgggcactgactttatgcataacatttgctagatgttgcttaacttctcctttcccaaaggaccctcattctcgtcctgatactttgggtgtatctggatgtttttcacttgtgaaacccactcttcagagaatgcctttcaattttaccttcagtaagatgcatgatgcccttcagagtaactgatgtttctgagttagagaaaaattcacttgctatcaacaggttgcagcgaatttgctggcctttctttcatttccctagaaacacaggatgtgaaggaacagagtagcaggagggaatcacagatgagaaggaaaactgtcgccagagaagatgaaaaaaattcatgctctatactgtgttcatctgtaaaaagacaaaatgtggttaagtttattacactgatcttgtgaaatgcagactcatacattaaacattgcttgtctattctagaatgaagtagtaggaagatacttgcaatggcaaataaataccgtggaataagagggccttcagcatgtactatgtattatcctgggctaatcaagaccttttatatcacctaagctgacggattattactctgctgcccactggcttaattttgtgaatccatccagactgcataaagctttttgctgttatgcaagtctggggacagagcaacgtgtcaaatctgctcatgtgaaacgggtgaggaaatgctgagccatatgccagagggagagaggaaggagagggaaatgatacacttcccctaaaggccactcagtgggtaaaatcaatgactgtgtttcaggtacagactaaagaagcagaattactaagaaccccttcaccttccccaccagtgccttctgcccagctgccttgaccaggacaacttatagtaagtaaactgttcatccaaaggatactagcctgccagtgacttcctgtctgacttccacactggtctttccccttagaccagatgctttcaatcgaggatgattctgtcccctggcaatggctgaagacattgctgattgtcccatctggctgtgagggtgcatgtgcttactggtatctatttggtagaagccagaggtgttgctgaacctcctacgaagcacaggaaagctccccaccccaccaatccccaacaaataattctgaagccccgaataccagtagcaccaagactgagacacatggcactagactggaaagcctctggagaacttttttttaatcccaagtgctcaatagtgtgtggtacatagtgggctcttaggaaaattattttggattgaaaagcacagtgaaagtgttgcccctatgtttcagtctagcttatgtttctcttttctttttctttctttttttttttcaaattggagacggagtcttcctctgttgcccagactggagtgcagtggcaccatcttggctcactgcaacctccaccttccaggttcaagcgatcctcctgcctcagcccccctagtagctgggattacaggcacacaccaccatggctggctaatttttgtatttttagtagagatggggtttcaccgtgttggccaggctggtctcaaactcctgatcgcaggtgatccacctgccccggcctcccaaaatgttgagattacaggcgtgagccaccgcgcccggcctggctgatgtttcaaatgtgtgcttaatagggtggaccgtgggggtaaagagagggagggagggggagatagatagatagaggaagagaggaagcccagattcagatcctgtcactgcgtgaccagggcaagtggcttaacctctctaaatctcaaagtcttcatctatcaaaaggggattaatagtacctagcagataggcttgttaaattagatggcatacgtaaaatgtttagtatagtagacagaaagtagtagacaattaatagctagtcctatcattatgagctttggctaaaggcctcttggagagtagactggttctattacagtcccagaggaaaacactgattacacaggaaatccagactaaacaaatgcccaagtcatactgcagagaacactggtgctctggctctcttggacaatttcctcaggagcctatggtcctgttgctcctgaggctgcaccaggcgttggcccctggtaccaccctctttcagagctgcaacctccagacttggcagaagacagccagcttggggagagctgcttctgtttcagagtatacactctgattctaagagtagatgctggatggaagtcatggccaaggggcaggacagcaaaccattgtgaagtcaacccaatttagagactgattcaaccgttgtctaaccagtgccgtgcctatattatgaactctttttcttttcttttctttttttttttttatattatagcctcttttagctctttaagtcttctatgggtttaatgggaggctttagtggtgtatagagggtgtgtgtgtgtgtgtgtgtgtgtgtgtgtgtgtgtgaaatggatttattttattctacaaatgaaatgaataaaatcacctgaaatggaacggaatggctacagcgagtgtccaaagaccacaaaactgtttcctgacatgtgcttagcatatttaaattgttctcacagtatcatcctgagagcagagagagcagtccaactgctccacaggactgcagagagggaaccaatccatctattttctcaataatggtgatgacagagatggaatgctgattgccaaatcccaaacacatacgggcctctcacccaaaggccatgatgcctttgtcttaataacagaataaacccaatcctgtacaaacagcttcttcagggtgcatgttttgaatggggcaaagattagctttttgtgggaggctttccaggataccggacaaaagcatgcactagagactcactaggtagattcaaatattctttctaccatttactaactgcttgatcttagtcaagttacataaaaggggctgtgtggggaggaggggctctgttcccacatctgtcaaagtaggaataacaataacacctaactcagaaggtggctgtgaggactgaatgagttactacctgtgaagtacatggtatactgtaggtgcttaatgtcacctattaatggtggtggtgatgatgatgtaatttgctcaggaacaacaaaggaggtataaaaaatccccccattttacagttcctgtgatgtaacatattttctgaatagggctttatatttattccatttttgtgccaggcctatagcagtgttgggagcgaaactctagcaggatccttcttacatgcagaaaaggttcattttacacttgccaataggaatgaaactatttcgctgccacaatagctaactgtttttctaaatggcctatttcgtcaacaacaatcaggaaagtgtaggaaggtacaatctctaatgattgtagcccgtgcttaaggtgaggaaaaaagtcaaaaaattacacatgagaaacctgaatccaggcagatcttactgaggccttatcatcgcattccccaaatgtctgaagagtgacgccctctcattctcgctcacctttcccctccctgccttcctctctttgttgagcacctactttttgccaggcaccgggtatacagtaaggaagaaaggccagtaataactcaggatattttttggaagcattaaataaatttttaaaaatgagctggaatagctccatgtggaaaagagcttaaaattaaacagcatcagcaaaaatccagccaagcaagcacaatctttaagaggaaggattttaggctgaaaggcaaacaatactagttgatatactaaaaaagcaccctccaaaaggaagatgttcccttttgtggacaatcatattcccatttctatcacgaatctcattaactatttcactccttgaaccttttactcttggcaagcccttcacagccccaggagctacttgtacaaattagctctcaaatataaggcagatgaagtaatctcattgctgctaaagtataattctctctaattactgtaactaccaagcgttagtccctccctttctaaaaataacactccctcccctagacacagtgatgaaatcgcattccgaagaaaaacatttgcttatcaaagaaatcttagttccttaatatatgaaatttctacatggacaactttaaaggggagaggaggaaacctgaatattagaaatgtcacttgttttttggaaggtgctgaatgcgaggaataaaaatcccactgatgatgtaggtggtttaaatccagcagctccaacttgtcatggctcatctgagcactgcactctccttggctccgccagggctccctcccgcagacaggcccgggatctgccatggtgcgctccctgcctctgagcacacacacttattgagagctacacacaggccagccgtggtactcaccatactgtcgaattctacagagcccactatccgagacacctcgtcaaactcctcaggagacatggggagcaggttgtctgtggtctgaagtctagaagggtgactaaaatggggaaaaagaaaagagcaatgtcaacatctgagtgatgaaagcactagtgcatacttacacactttatcttttgtctgtaattgaattatcacgttatatttttattttgggtaagtgcatacacttgtaaaatacatttgcaaaagtacagctcatgggaggctcatgtccccagcccagccccttgggaaatgtttcacactccagggatgtgataagcaatagccagactggaatctgtgccgcttctgcctgggtaagcctaggtgtgagcatgtgcggtgcactaccctgagatgacaatgcctcgtggcttaccctggacagaaaagcaccagagaaatgtctggggagtccctcatccctaccttgaggtttgaatgcagataaagctgctccacacagtgtttttacatgaaggctacatccattcaccccaagacagtgctgcaggccaaataactgacaatgacatttccaaaattttttctaccttttataaaatgaaacaacaaaatcaaagcaagtggagacagtgtatctcaatcattactttggccttttctagattgaaaagaactactttcccactctgatcaacttttgctcattttatttatactttttcaaagggtatcagttttgggaaaatttatataccttaaatacaaatttggtttttggctttttttttttttttaaagtagtaaaatgctgataggcagtaacacggggatctcaacaagttcagctgtgatggcgatagcaattacaatggaaaagtaaaatacaagcatcttcaacaggccccagccaggagcaaggctggcttgaggtttgtaaacatgtcactcttctgtgttcacttacacttcagacacagaaatcaactcagtcttgatatatccagttcctttagggccatcaagttccattggctctggtgctagaaataaacacattgtgtacgctttccatcaaccgaaattccatcagaatacaacatcaacttttcggggggattaaagttctactgtgtttctagacagcttagcctcctaaaactttaaggagctataacctccctgcctgagtcacctaaaattctagtgggaatgcagaaacaacgagaagaaggatctgaattcagtctggaaataagctagtgttcagcaggacactagctaggagctttctctttacacaacttgaaatcttacaagaagtctgagcccaaaatatgcaaagttctatccagtttattggcattagcctggctaatgaatattcacagctgtcaaggtaagctggggacatcttcattccaaagtaattgtcctaatattgagatttctgattctgaaaaacagctttgttggtgtgttccaaacaaaacaggtctaattcgaaccttctcaaatgcaattcattgacaactgagaagcaagagacctgtgttctcagatgaggcctcctcttaataattatctaataaaaataggatctagtaagtaattgggccaccctaaatgaaccacttcacttctcccaggcctcagtttcctcaactttaacgtgagcaagatgccttctgttggtttaccacagttccttatttaaacccttttcatgtggaaacagtgatagtaacaaatacacaagaccagcaatggacttttccaacattcctaaaataggaaattgtccattcatttcttactagctgtatcaggccaaataatgcattatgtttcacctgcactgagtttatgccatcttttgaaagcctactcttaccaattcgaaagcaaaacactgcatgggtggagtttcagaataatcaccccctcatcaggaaagactgtgccacgctgttaccacctgcttgccccacttaccttcctttggcctggagtaatactttccaaaggcatggtctttgtcaatatttggatacagatacttcaggggattctcaggaatattctcagcagccatgactttgtaattgcgaatgatgtcagggaaagtaacagcagaaagttctttcttcgtgtagggttcaaccgcatggaagtcaggttctaaaaaggagaaaagctaagtaaatcccatagaacatcccaaaatgaaagaggacagagaaataaaacactgcagagttgatggatttgagtgaacctcataagaactaatcacaatctaagcattataacatatacagtagactgctttatttctaaataaattataatactgtctcagggaaaataaagggaggtattattctcaataacattctatttgccattatttgcttagatttataaatctgggcaaaaaagatttattaaaaacctttaaaagcctgcatcttcaatgatgtgctgcccataggcacataaataacttactactaagtggatcatcttggcttaagccacagatttaaattactagagataaactcactttgtttttcttttcatattgaaaaatctaattttttattaaaataaattatgatatatagaaaacaacatttcaaattaaaaatgatcctatttgctacatttccctgtaacccttaacgtaataaaccatggtttaatttactcccgttcttattcccagactgaattcagatccttcttcctagctgatacagaatctccctttgggtgtcgaccttccagaggccacggttcaggtgttctggggagcctgctgtggaacatgagactatgctgccatcctaacccttcctggctggtagtgtcctgcttgacctttcctggttgccaagggttttcttcatctctgcttggtctactatatctgtctctcagctggttcaggaagggaacaggataagaggaaaagggcaggttctaatgactactgcccacgccagactctcatctcagcctccctgctttttcctcagaagaaaaatagaacaagaaaagtattccagaaaaacaaatagaacaagaagagtattcctgaaaaataaacagaacaagaaagaataccgttccagaaaaaaaaaatagaagagtattccagaaaaacaaacagaacaagaagagtatggcagaaaaacaaatagaataagagtattccagaaaaacaggagaagaggaatatttcagaaaaataaatagaacaagaagagtattccattttgtgtctacccactgaaagtataaaaattactaaaacaaatcagtttttcctcctgcccttcaaacagaccaaactctaaacaacagtgaaaagtaatcagttggtctttatgattttttcatttacgctgttgagcttcaccctcagaaacctgcttcataacaccaaggtttctggagtcttttagccatggactcatttgattaaatagaaaccccatatatgataaagataaatttgcagctgctctgtttgaaggcagggtagaggctgccactcgtcccaacaggtcctgcatcaactccctggctgatgatgtgtatgaagtcttctcccgaagcctgtctcatctgcacactctactctgggatgaccctaagagaatgtggatgcttactcctgtgggaaatgtgattccttccaagaacgggttgcagattacattgactcacatccttgatctgcagataacaaacctgatgcaaaggaaagaattggcattgtcttttcaaaaccatcatttccacaatatgttccagagagtgaaccacaaccacaaacatttgtggtggtttattaaatcctatcgggggctcatttggggtaagtataagatctgcaatttcatgtcccaaacgcactatctgtatgagctgactggcggcgatgaagagggacttcacacacatggaatggtgggactatgtgctcaaactcccactcaccgcctccgttctgggaccgctccacccatgtgaatgtgatggccccttcccgggagctctcactgaaccgcagcaggaaggtccccggctgctggtccttcaacagggcacgctctcgctccttgctgatgaagcccatgatgcacctggatatcgaagagatggacggatgggcttttagttcaatcatgatttccattttcatgctaacttacaaaccaagaaaatggctggaatgtgagaaaaaaaacctacggtaaaaaacgtagactattttaaaatctgttcagttgacacttaaggaagcatttcacttatacatgtatatactaaggttttaaaaaaagcgatatgaacatggtgtcagtaggatgctacagatgctcaataacacgtgtgggattaatgagccttttattgttcctttattattttaaaggccataacaatgtctgaatgtatacatcttttttactggagaggaagacctaggcaatatattttcatattttagcccttctgatcaagttaaagcttctgttgaaatatcagccgatcctggcaataagtcaagatagaaatgatttacccagttaaaagggtttttcttccttcctaggggccacatagtaggtgctcaaaaaatttttgttgagtgaatgaatgcatgaatggcactcaagagttgttttttttttttaatttagctttgccaatacatatacttgtactaagaaagtgtaaggttaatgttatgaggttctactcttctgaagccctgaaggggcagcctataaatgcgcactcctgtgagattcacacacgcctagtcaaatactgaagctggactcaggccttgtctcaacctcgcagcactaaaaatatgtttcaaaatacatctatcggtggcccttacccatcattccagagagggagcaggtgttttttaatgagttctaggatgctttcaatccaaagccagaagggaaaatttttatcatttatattttcctgaaagtatacaaatgcagacattatgaacaaaaatctaaaacaatgacttaccatggcccctcccaccatcatttgcaaagactccccaggtgccaaggatggaactgtcccattcagcacagcaatgggatccctcccctggcagggaatatcaagttccctccccgctcttatcagcattcagaccaggagctctccagagctctccacttccctgggccgggctctgcttccctttccaaacagtagcaagctagcctgggggtgacctccagcgtgactcacggaaacacaagctgccccacactagcaaaatccagcagtgcaagctggtccgcactgtctggtgactccagcagaatctaaatgttccccgcagtgggcccctctgctcgagcaggccgttaaactcgtctggctggtcaggctgcgccacccagcccacaacatacatttcacacagaaatggctaaaacactgctgggcaggggtccagcgtgagtgaacagaagcctcatttcagatatgaaagaatgttatcactcaggcaggtgcttcctgtcagactcctgctcggagaccaacctcctgcactgaagaaaagtaaacaacttgcccgaggggctccttggccagagaagaacacgccaaaataagcaaacagttaagtaactatcacagcaagaaacatgagaacctcaaccaagagcaaaaaggacttagagagcataaaacccagacagtcctcaccttacaaaacctcgtccacggaatgagaccatcggggctggcgttaggacctaaacaaataaaaaccagatttttcagcaaacagaaactgattctaaagctttggttggacggatggctcttgtatttgctctcaaggaaaagagccaaacacccaacaaagattgtatgtacacagttgacattttcggataccttaatgccaaattaactgagcaattataatacgtgctgtaagagggcggaatttaaatggtctaaaatatgtatatgttggtttgagtttaatggcagaaaggaatggatggcagattcctgggcaccacgatatgagagtttttagggaaagcggaaacatcacaaagccttaccatctgctctctccctccccagccccccttttccctccctcctctaaagagaggacagtccttttaatgcctcttcatgttacacttccttccaagaccatcagctgactttgccttttgcactaaatcaaaggtgttctgctgggcctcctagagaagcctccctatccagtgcctcttcccactgccttcctctgctgctcagcagagccccctctcccaaggatcctacagaatttttttcaaagttcaacctaggtgcccaagatcacccctagatcttcaatgtaactgatacttgactttacaagtttattttagacattatttatgcatttccctcagctttcctccaaataggacatgggctcaggcagtctgatgcaaatcaaaaaccaagtgagagaaacgagaggaagaagcccggggttattagctacacaaattaaagcagcctgggcgagaagaggcggtaagcccattatcggtcttcaaagagaactacaaatgagccattacagctagaaaagatatccttcttaactctcaccaaataaagaaatggaataaggggattttgtacttgtattaaacagcacaagaccaccactgtgacagctgcatatccaagagaagaaggcactgttgaaagtcactgagttaggaagagcctactgctgtttggagtaaatgcagtgctgctctacagaaagcaaatctggatacaagttgtccacggatttttaaagaaatagttcagatagcctcactcactgaaagatctgaccttgagactagtggatctttgatttgtttagtatgaaggactaataaatgcactgacattaaccactgaaagggaattatctaccactgtctagactctgtccaatcaggcaaaactgcagatcaaaagaggcatcctcttgtggggacggcatcctctgctacctgggccccacctgaggcaagggccctgggtttatgctgcagtgggcaagccccaggactttatttctcatcatgtcagggacttccttttttctccccaaggttaatggttaataggccttcatctttctcatccaggaacttatttcagccacaaataatatattttacataattcataaaactttcccttgggaattcatctcagaaatcttaatatgagacaatgaggaacggattcatttaaatgttatcaggtctatatttctttctaaggtgacatatgattctcacttagctataataaactatagcttgaaaagctgacagattttagtacttttttacctttaacaaaatagcagaggggaaaagagcaattagagagatatttttatgaatttcaatttttataaacataacaagttaatatgcatataccaagaagcttctctcccaacatgttcagctggtccacattgagacctcttttggtgacagaagaaaactgccaactcagcacttctgaaagctgagcccatcgtgcacatggtggagtcaggaagaaggacagattctagagagaaaacacccaaaatctaagggttactacagagacaccagtcacaagtgtggcactaaaacatatgtccatcccaaagttcaattctagtttatatgacacacaggtgctttcacagtaggggaagagaaatacagtcaattttcattatttacagatgcacatttgtgaacttgtttactcactaaaatttacttgtaactccaaaatctaaatacatggcatctttggggtcatttgaagacacacccgtgcacacacagcagcacacagcagcaaagaattcgagtctcttaacacgcttccaactgaagccaaacaaaatgacactcgcttcctgtttcacctctcataagaaaaacgtgtcctttttgaagcctatttagcgccatgttttttgcattttgtgactgctgttggtgatccctgtttaaaatggtgcccgagcatagtaccacagtgtggtctactgttcctaagcatgggaaggctgggatgtgccttatggagaaaatacatgtgtgaggcaagcttcactcaggcatgagttacagtgatcctagctataggtgtaatgttaatgcctcaacaagtgtattagataaggtgtctttaaacagaaacacacataaacaatgttatgcattgatgggttgacaaaaatgttgtgaccagaggcttgaaggaacctagcctcgtagttcccttaggagcaacaattcattatttgctagttaagtgttcctggtgactttaaaaaacataagtactttgaataattataaatgactgtaattaattaacagtgagtatccacactctaagaatggagcatgcttgtttagtagatgtatacattttaaaaataataacaataaagtggtatggaatcactgactgccctagcttacccacatgggagaaaaaacgtaattctcatttcaaatacatatccatgcttcatattcccagatttactcaaaagccttagaaataccacaggagctttgtcacttctcccttaacaactggccattggggctatttcagagatgcagcagtgagagcgtggggtctctgcttaaccctgggaccaaagcaaatgtgttttccataccctgggttccgccaccagcatgttgtaccaaaggatggaggcccaaccgctcgggagctggctgacgttggagatcaccacaacgggcagagaggtcgtctaaaggatgacaaagaccttgaaatcatctgaatcacagaaatgtcaccttcagataactgcttagcctcaactaaaagcaggggattatttgtaaatttgtacatatttaatacttgaaaatgagaagtgttaagttctgttcttctgtccagtttaacttgtctttgatgtatctttcagttaagaaataagtccctaaaaataataatagctacaataattaattaagggatatgcaatatgagaagatgaaaactgtcacaatgaaaacataaaatgtggggggagggcagagcaaaataaataagtcccaatgcttaatgtaaaaaaaaaaaattaacatcagcgatctcaactggaacttttaagttattgaatttgaaggttaattcaattgtctagctttctggaccataaattaaggttaagatagtattagctgaaaaagatcattttaaaacaattaggtaaatacctccagaacaaacactgagaaataaaaatacatgtaacaattaaaagtaaaaataatgaagttttccaactcgggaccataaaagtcttacctcgaggtcaattaccaaaccaggctggcacaattgggtttcaaaactaagggagtgaagctcttcagtaacgatgagaggacccttggaagagaaaaggaaagaagaaaagaatataattattcacagatcctaaaactttcaaaagcccaattaacattgcaacaggccacagagatcctgggcccaatcagtggcaagtctgaagactcaatattcaatctctcccagatttaatgattcttagtatctcagtgtgctctgaaagataagtgtctgaagttacggcaagggttatagattcagagcaatgattgtcaatggggaaagagcaactaatggctttgtgacctaaggcttctcgaccctcagctctgtctgcctgcccagtgtggctgcacatctcaatgcagatgggtggggagaaggtgagaggactgggagtaagtgcatacttgtgattgtctactgcctaccggaagggctgactcacatcaacttggcaggtcacaagttgtcttggtttcggtagaaatggatagatttcaaagtgccttcataagcattacctcatgtgagcctcacaacttagaactagagaggtgcaacagctagacccagggaggtcaaaacatagttcaggcgcacaccagggctagaaggcatctttgcactgcctgggcctgtgtttgtcccgctgctccatgtgacctccactggtcctggtgtggaaggactgcacactgtgtgtgcataaatgacgaaagtgttctcaaccaaaacaactccagatatttcatcctttgtccatagttcatttctgaatgcatcacaaacccaactccttaaggatcacgctgtaggaaggaaactgatgcaaaggcaatgcttttggtaggggatgcaatggccgaaaagccctcttggcacacagcaaggcagtcatcaaagtggcctctcgttccaactctgacagtaactctgtgcacccttagctaaatcctgcaaacttctgtgagtcaatttcttcacccgtaagatgcgaagaatacaaaagcccacaacagctactccactgagttgtccatgagtgtctaatgaatttgtgtgcaaaatcgtttgacaatagtaaagcacaaatgtggtgtttttactgttgtcacagatataccaaatacccagctcctttgctgctcttccctgatgggtctgaactcctctgtgaggtgtccccagccaccaactgacctgtccttgctagacagacctgcctgatttgggcccattcacaacataaagggactctcacctcattcgttctggtgccagcatttttctgttctttcaattgctataaaacaaataatcatcttagtaaacaccatggtaatggtcaaagttgctatcttcatttacaaatgagaacaaagttaggactagaaagaatgacagacgtgactttatctttagaatgcagaacatgggacaaattggccctcgttcagggtccatgagcagaagcacgtttcctcagtggcctcatggtgcggacaccagtctggagggatctcttggaatcacaacccgctcctctcctgtgttcaaactttccctgaatgtttccccatgcaccttcgttaactgtttcatgccctgaggctcgggacagcttctccctcccctttccctcagcagagtcctccaggctgggcccagtgactccaggtccacctgccctcaagtggacgtcaatctctgagctgtcaatccctgagctgacgagggagcaggctggggccctgagggcggctctgaataccctcaggcacctgagttgggctaagctttcgagttaggtagagcttcctagctacgaggcttgctggatcacaaagtggtctctagtgaaaaaggatgcctttaacctcctgcaggttctgggcccagggaaagcttcggactcagcacccacagagcctcacagcaactggcagcccccatgttcacagaggaggaaagatggtgcacccacacagagcatcctgctgggtctccactgcctggggaatgagccctactgccctggagaaaaggtggtagagtcaggctggcgtggaggcaggggctgtgggcagggccaccaggaaggggaacacgggggctgaggagtgaaccctggtgtacaggaccacacttggatcacagtcaggacacgggagccataacctttgagaaaactgcaagcgtaggtgagtgaccgtggggatcatgcaggcagcaagtgcaaatcatttacgtaaacacaggcttaggaaatatttttactgcaagtgatacagcccagaaaacagagtgaacagtcgtgggataaggaggagaaaccaaaatgccccaagtactggcgacaggaagacaccagccacaaagtctacaaaccccagcaggggggcgtcctccacatggcaatgtgccaaaaagggctgctctattgtcaaaagtcctaagaaaccagagacaacatagagaggaaactgatgtccctaccaggtgccgaaattcagccgccagactgccattggtggactcctccatgttcatcacttttgtgtgcgtgcccaaaatgttgaacttcctaaatctatacaatataggaaagaaatgctgaaaagtcttccaactattaaataaataaaaatatagcacagtatagcgtaaagtacgtcacgtacccttttactgtatttctctcattcacatctctgcaaaaaaaatatatataatcacatatgcgtatttaaaatttgaaataagctttaacaaaattataagagtataagagcataagagtgtaagtgaatgatgaataaaaaataaatctacacctatggatttgcagcctttcattcactccctgcttccatctacccatactaggtctggcaagtatcactgaatgacctttggcaaataaatggtctgggccttacattgttcatttgcacaacatactaacagtgccaacatataggacatcatgaggaataaactagttaattcctcaccagtacaccctcaataaatgtaagcaccagcaccagtacaccctcaataaatgtttaagctatcgttattgtttattgagcagctacttggtgcaaggccctgcactaagcactggggatccagccaacagcactgcccagtagtcacaaagctcagaggactgccaatgtgaccatttaattctcatttttattctctatgatctttaatgctctcatgaaagtaccaggaaagtcagttatctggggaaagtggcaagtttaagttttaagtctgaggttaaaattttgaaagaccttgcacttctatatccagtgattactttgtcatgttctggccaaataatgtatccgtgagcgtcctagatgtagactagaaatcatgggctcactcacagatctattagttccccttcctttccaatctcaaccagaagttcaatgcttttgtgaatgacaatcaccattagctatggaagggacctattttcccgtttggaaaaaaaaagaatttaaaataaaagggatagtatgataaaagctgacttgtcaaagctaagaagaccgtcagagctggaaccgacagaaaagacacaagggcccgaagcagctgagaggagctgagctgacgcagaagatggtaaactgcaatggcaacacaactcttgtgcttcctccgtttaggaagtaggatatacttccccatcccccgaatctcagctggccttgatttgcttttagcaacaggatggaagggagtgatgctatagatgttccaaggctagcactcacaggccttgttcacttggaacactgtcaccatgggaaaagcccaggctagcctttttgaggtgcatgaagaaggacctggttatcccagctgagtcccagtcatgtaataaggccttgctagagcacctggctccaaccacactagctcagaccaggacaacctacaactcacagaatatgagaaataatgagtttttgagtttttagccactaagtttttgtttgtttgtttttagacagagtctcactctgtcacccaggctggagtgcagtggcatgatctcagctcactgcaacctctgcctcccaggttcaagcgattctcgtgcctcggcctcccaagtagctgtgattaccggtgcacaccaccacacctggctaattttttgtatttttcgtagagacggggtttcgccatgttggccaggccggtctcaaactctggcttcatgtgatctgcctgccttggcctcccaaagtgctgggattacaggtgtgagccactgcacctggcctagccactaagttttgggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgccaaaacagtatgtgacacaagctaacaaaaacattaaatatgggaggggtggggggggagccatcttgttccttaatgagagtggccaagttagtgccagtccaggtctagggtctcagggcaaaataggatgaggctgctccacctggacccccaagagagatgcccattcctgggttcccactgcccagaagagacaagagtgaatcccacaggctccacacagtctccccaagatgctgctgacctcgctccagaaaaaaacccccaaatgaccacagaatcatggcagcctggacgttcagcctcgggttggatcaggggcctctcctttggggctgacctagaaggagggggtggcatgccaagtccagccactttgagacttgctgattacaatctcatatgcacaaagagacactcactcttttgttcatttatagtctaaaaaggcacaggaatgttgataccagctccaggggaagctcccaacatccaccaagggagctgctgatttaaatctgctggggtcatttgtgatggccctggtggatctgactagaagtctctgctcatgcgcagcattgtcaggactctgggttcagccctggggccctagggaggcaaacttccacccagtatagacccttccacagctagaaatctgcttatttagtggaggaatctgtgcttgagtaacaaaatcaacatttcaatagtacatgtatgttatataatgttaaagatatcttacttatcaaataagactttgactttcaaattataattcagctcttgcaatttcaccaacagtctggaaagaaaaataaaagccattacttaaaaaaaattatctgttacaatttatttattatgccaattccctattaacgtttagataaactactccccctccagttttagggtattaccaacaaaaaaactgacagttttgtagatctacttaaatttttgtaagtgtatttgtaagaataaattcctagctgtggaaccgcttaggaaaaattgtaacactaattctgacaggatgccgccctgattttacattgccaccaaaagttaatgagggtagctgtttacctctataaccttgccaatattcagtttcatcacaatttcgacctttggccaatttatatgggtaaaatagcaaacattactttctattaaaacttgtatctaatctttgtcctgttgggagacaataaaaactattgcccataagcagaaaaaatagcgtcccatctatagtcaccccagggtagcatggaaagatggagggcaggtgagagggtgtacctctgctccactgagctggagactttgagaaggagaccccggggctctgtctgctccgttcagtggagcaggtggatgggatcagatttctactgtcccttccagctgctgagttctaaaattccacgagggcttcagtgtgacattgtacctaccagccagggagggttaaccacagacttaaatcagcaacaccccagaaaaaggacccgggccaactatgaaggccagtccagttcttcagcgtctagctactcatcataagaagaatgcttaaagcaatgcagccattcaatggaagaaagtaaagccacatattcctggaaacacttctacaattagtatcgaggagaaagactacaaaacaatgtatgtagcctactccgagtttttaaaaaagaaatatgtcatatttgtgtgtgtgtgtgtctctatatgaaatatttgtgtagacatggaatcctaattttttaaaaaggaaacattatgtcatgtttgtgcgtgtgtgtttccgtatgaaatatatatttgtgtagacatggacaaaatcctgggaggacagacactaggccatttactgtggtggtccacagatatttatatcacggactgctttgagaaactgatgaaagctataaatccatccatcagaaaaatgtacatgttataaatccacattcatacagcttctggggttcataaggctcaggttatgagcctatgcccaagaggggtgaggcagccaggaacttttactctctattacacacatttctgcaatttggaattctgttttcctgtgaacacgcattacatttatgattggaaaaaaaccaggagtgtgtacatatatgtatatcagttacatttctactatgaatatattaataaaagactctcagatattctcagtaagagttcatattaaagtgccccctgaaaaattatttcctcaaaagcaccctatataacagtttttataaaaggaaactaggggtacaaactacgtgacaggtgatgtatgggatgccatctttcccttgttacctcaacttcacagtgaactggacccctgtcttcaagaccagcggcctctgagggtgcgttggcatgcagggctgtctttccaccacaaacgagctgcaaatacccagcaaaggatagataagttagcatttccattaaggttgaggcaatcacaatgattttcctgaaagaaaaaagggggttagagagtacgatctaaaaaatcatttgaaagattctgacaagttggatgaacaaagtgatattttctaattagtaaagaaatcccaaaacctaatagggacttaacagaaacagaataactgtaatgatctgtgaaactattacattgaaacaaacatacaatgaaggctaggcacagtggcccatgtctgtaatcccagcactttaagaggctgaggtgtgaagattgcttgagcccaggagttcaagaccagctcaggcaacatagtgagaccgtatctttacaatttgtttttttttttttaattagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttgaacattagccatagggaaccaagtacatttttttaaatattacttccaataagtacgatatttattaaacatatcttcagttgttttgttacatagtatgcaacaaattacaatattctgcagccacaaattatatgcagagtatgaagaagctattaatcagacagtgtaatctttccatttataactctacaaggaagaactagcaaatcagatcttacatataacatctcactaaactttacgcatggaaagtgacagacactgcttgtgctgtttgatataaaatggctgaacttcatcttcagaagactatacctgacatctaaacacaccaatataaacatcaaaacaaaatatattctaaccaaccacgagaaaacagtctgatatcaggaaaatacattattttataaaccagcacacaaaggtttaagacagttctgaaaatgaagttagctgtcttgagtcaagagaataaaaaaaaaaagtcagtattgaccatttacaatctctgacctctgtggatatggtaagaatctgttgtagtgcagctacatacagtacaattcaggcaattttgtttcttcacttgggttcagattgcaaatttattactgtgagaaaaggatggaggcaaattttagcaggaacctccacctgactgcttgaccagagtgctctgaattttaacactggacttctcagcaccaccagctgttgctccaggacccattagcttcttaatctcagctgccatcatcatggaacacagttctacattcattgcattctttcttttttttttttttgagacagagtcttgctccgtctcctaggctggagagcaatggcgcaatctcggctcactgcaacctccgccacctgggttcgagcaattctcctgcctcagcctcccaagtagctgggattacaggcgcccgccaccatgcctggctaatttttgtatttttagtagggatggggtttcatcatgttggccaggctgctctcgaactcctgacctcaggtgatccacccacctcggcctcccaaagtgctgggattacaggcatgagccaccgtgccgggccttgttgcattcctagcactagtttccaaaaacagaattccaagggaatcagcaaattccttggctgttgtgtagtctactactttctctgtggtcagatcacacttgttccctaccaacaatttgttgacgttttcactgggataatgatctattttctgcagtcactgtttaatattattgaaggactcctgatctgtcacatcatacaccactaggatgccattggctcctctgtaataactggagatgactgttcgaaacctttcctgttctgctgtgttccatatttgaagcttgattgttttcccgtctaactctatagttcttattttgaaatccataccaattgtgctgatgtagctttctgtatatgttatcatctgcaaacctaagaaggaggcaagactttccaaccccagagtcgccaatcagaagtaatttgaataaataatcaatttgggattcatgctggacatgtcactgtagctgccaccgctgccacggccacccttgctgctacagctgctgccctgactctctgcaccacgggtaactgaaggaaaggaatgagataggctgttctgggagagtaaatgtcttccccgactctgccccctggaacgcaatcagcagccgctgccactcagctattgcttccacccaaaatcaagtacatttttatcatgtcaagtttgcattaaaaaaaaaaaaacttgcaatatgaacccttcttttccactcagtgacatttatctatctactaagtgtgtctagagagcctactgttcacaaggcactgcgctaggtcctgctgggggaaaagggtgacaaaggcatgtctctgccttccagaactttatgatattcaagaaatataaagaaatacataacaactatataacaaaaggcagagtaggaaaggaacgaagggtgactgtaggccacgaagggagataacatctgtttgggaaatctgggaagattaaatgatgagatacaaggtgaagctttcgggatgatacaattttgaaagcaggtacatgaaaagaaggctctgaggaagaggaagtatcctcaggagagccacagaaaagcaagtatgcggcatggcccctataggaatcagcaagaggtcaagtttgcctagaaaggggcgtgtgtggacgtgaagcgtggagtgttcagctaggtccaggctgcagaaggggggccgtgaatgcccagctgggcattcacttggatcagcaggtgatgaggaaccagaatggaactctgctctgggacagcactggtcacagggaggaaggactgggaaggaggactggtggggaggctggggaagagtccagaaaggaggatttgagagcctgagacatgaggaggggagaggaggaggtgaggcatgttagggtcacggcggagactcagccaaaggggaaggaggagtggaaggttactatagcttccagcctagctggccacaagagtgaagaaccactggtataaccaaataattcaggaagagtcattgtcattaaaaaatttgaggccaggcacagtggctcacgcctgtaatcccagcactttgggaggccgaggagggcagatcacctgagttcaggagttggagaccagcctggccaacatggcgaaacccagtctctactaaaaaaaattagccaggtggggtggcatgcgcctgtagtcccagctacttgggaggctgaggcaggaggattgcttgaacttgggaggtggaggttgcagtgagccaagatcacgccactgcactctagcctgggtgataggtgagactctatctcaaaaaaaaaaaaaatatatatatatatatatatatatatatataaaaaacacctattaaacccttgtaaatcatctgaattaacggtaaaatgttcctctgtatagaccgattacagaaggtacaaataaatgtcccttgagttacctctgaatgagctgctggaaaagactgaaggtgcggtcccataacacttgtttgttttttgtgatagggtcatgttcgtaggtgtatttctgttccaattcctccaactttttaagctgctgccgaacttgctgcagactctccgcaactatagtgaacctgggaagacacaagacacagatgtctctatgagaaacagtccagaagcagcctggattaaagggaatcatggtatattagtccattctcatgctgctaataaagacatactcgagactggagaatttataaaggaaagaggtttaattgacacatagttccacatggctgaggaggccccacaatcatggcagaaggcaaatgaggagcaaagtcacatcttacatggtggcaggcaagagagtttgtggagggaaattcccacttataaaaccatcagatctcgtgagacttactcactaccatgagaacagtattgggggaaccacccccatgattcaattatctccacctggccctgcccttgacacatggggattattacaattcaaggtgagatttgggtggggacacggccaaaccatatggcatggaaaccaacaagtggttatatgcaacacaaaatgtcacctaggatgccatgctctgccctctagggaaaaacaaagggaacgaggcttgtgccagcagtagaagctttgttatttgaggagtacaactaacatgcactgaatgattacagcctacatcaaaaacttctacacaccactgaggcctatgtgaggagagatgggtggaggcagggcttctaggtgatctgtgactggtgcagggcaaagaggaggccagaggcagggaaaacagcaaagcaggtgcttccaggtgatgcaagaggcagcaaagagccactgcaggttctgtcaagagagtggcatcagcaagcagtgtctcggcaggaccagtcagagatgtggggcagaggggcaggaggagagacagagatgggagacaaggccggggacaggaagagaggaaggaatgatgattctggtttcactcaactgaaaggagaaggcagtatgctcagtctagaccctaaacataaaaagccaatgagtaaacccagtgattgctcttagtcttccttccttgcagtcaactgctaacagcaacacaggctggggaaacgctgttttattcacttgcagtaatgacagaagaaaaccttttaaaagtgtcttcttccctgggaaaagtatctacttcactttctgattttgctcgattccagttcaaagccctgggacagcagcccttcgtcaggaaaggagaaggcaggataacggctggctgagttccagcggagaagctaaaccagtgtccccaactctgcttgcacacagagaaaatgacagcacagtgggaaaactagagggcatgtgtgtccctacaagaggctcctgtggtctaggaggaccactagggggctctaaacaccccagggcctccctggccacctgaagggctttagggttgtatgtatccctcaaggcacatggggtgcactgggctcagaagctctgctctaacccacaagaaatctggggtacctacaggcaattcacagaacaaaaataaatggctgaatattaattgtgatttttttaaaaactggcaatatagaaaataacctcgtgagatctctggtccttggacccttagcaattgtcccaggccaccttccctcatgttcactctgtgattccaagttcagctcctgttgcccctcacctggaccacactaatatgctaatagtattccaactggtctttctgtctctatcctatcctccaggctgtggccagagtgccctttctaaatcaaagatcagagaaatacatctcctgcttaagaaaaaagcctgccttggctcagcagtacagctgcgtacatcccccattcccagcatggtgctgagaacctgcaccatcaggctccagcatctcccaccgggtccactttccttcccatctccctggacaccccactctccagccacccaatacagcccctgcagtctcccacatgtgtgcctttgcacacgctgtgctctgtgctggaaagcacttccccttgatctacgtggagtaatcctagtgacttttgagtcagcacaaggccacttcctctatgaaaccttccctggagatgctttcctttgtcctccacagaattctgatggccttttgctagagcacctggatacttttaccacacgaattattaccatgtctacatccccccctccacactgagaactccttgttggcaagggccaagaatcactcatccttgtgtgcccaggtcctacagtgcccggcacacagtaggcatttaataagtattactggatggatgactgaatgtttcctaaaaaactattctgtaagcctagaaaaatgcctcaagctatcttgtttttaaggaaacattaagagtcaagtcattaaatgtgttctataacgaccatgtcactgatgttttgtacagtcaaacgacaccccatggtacaggagtgctccaaaccaagcagacgtggctgaacgtggcgagagtcatgaataacactgtgctttccaagggagtgtttccagggtaagcagaagctggactatgtcaaactctatactaatgttttgacagggtccattcaactaacacagctcaaaggtacatttatgtgtttatgtggttagccagtcagctgccagttttctgctttggagaatcttaccagttctgcagctgatccaagcaagcattgggcggccccccaatacaggcgctctgctgtctccgcttccactccactagttcatcattaatcagggcattctgggtaagttcagtgacattcagcaactctattattttgtgaactacttcctaaaggcaatagaagaaacaaagtgaaataaattcatttttaatcactgaattttaaaatattttttaaaagaaaagcaaatatcatttcattctcaactggggctctaagccaggtggctataatttttcctctcttctaaactttgagtccattatttacagtgtataacaaaagtggcatgctattctggaaagtaaataactacctttctcttattgtcaagcattaaatacatcttcttgagtaacagctgttcttgtttctgatcactctttgccacaccattggtctcgtgttctataaattgagagacagccagtaaatatataaagaagacaaaaccaacaaaagccaagattcatataaatttaggataaatatgacacaaatgctgcctagtgacaggtcaaagtttggctttcttcgatctttaatgaacatgaaaaaaagtcctaagtataacaactagacacactgaaacaaaatacttgttttcaaaaattagccgggcgcagtggcagacgcctgtagtcccagctactcgggaggctgaggcaggagaacagcatgaacccgggaggcggagcttggagtgagccgagatctcgccactgcactctagcctgggcgacagagcgagactccgtctccaaaaaaaaacaaaaaaaacaaaaaaaaaacaaaaaaaacttgttttcagtgacccatgtaaatcagacatagtagtatctgccacttaagacactgtcaggtaattacctaaataaatgtaaataacattaataataatgttattattattataaaaataaatgtaaataataaaatgttttatctgaacagaattcagataaaaaatgtatacaaagcatagctgtagctttcaaagagaagtagatgagtaggaagtggtagttgaagttgctgtctcttatactttctacccaaatcatactgataatctctgcctatgaaccatggtataccccagatgatgaatagagtaacagcagtaccctacgtgtcctacacaatgtacattcttgagatcttttctgttgctactctcattaaaaacacgcaacagtaagaaaatacagtaaaactgctttaaaacatgagaaaaatactgagcttatctgctgtgtatacacgtggccctgcaacgtttgaagaaacctgagatattagggcaggggaactccacatatctatcgctctgtgtcagtcagtgggctaggcgcaataaatatggtgagtaacacataaccagtggttatcaagtaggggtcactgacccctaggggacttttggcaatctctggagacagttttggttgtcactagtgagggctcctgggtagtgctactggcatctggtgggtaaaagtcggggatgctgttaaacacgctacaatgccaggacagccccaacaacaaattagcccgaaatgtcaataatattggatgttgagaagccctggcctgggttatcaaggaagaattcagagtcataaaatactcggcaaatagaaaggagtaatcatcttcgttatctagtgtgaacagaaaaaattgcagccaacgggcaccacttcagttgtgaacccttacctctgttctgcaaggttttgcatttgaagtcatattcatcttgtaaatcttccaggctcttgatttcatgctctatacactacaaacaaagatgtaaacatgttttctactgatcagcaacttccaaagactttaggcaacagagtattgcttctatggaacccagagaaacacgaaaacaattccatctcccccaaaaagagatctgacttggacagttctaatcatatacatgaaataatttcggtttcattaataagtatgtcataacatttttaaaaaagcaaacgtacaataattctcaaactgatttgtatgtccttaacctggttccagcgcctaaattttgattcttcctcatcatttttgagactacctctgagatatgatttaagaactccactgtgaagcccacagcaggcggggaaaaagctcacagaaaatttcctcattccttccaagtaagaaaagtgaccatacatccctgctttaccgggatagacctggtttcatacttgctgtaattataaacagtgccctcttggcggctcaaatgcatctccatctggacaataaattgtatgttcattctacaaataagcctcatttgtttgggatttggtcacatttccacatattcttctctggatttccatggctatttctggactgggctcactcggtttctactttaatgaaatgtttccctaggagaccgcaagatgaagttgctccaaagaatgtggagtttggaaagatgctgtctgaagcatgtaagtcaaggccatactgctattacccagagatccacagaggaccaaacccctaagctggaaggccttttccacaaacacaggcctctgtgaaaaagaactcctcaaaccctccccacaccagccctaacagtggagaggagtaaatgcgcaccatcgaggacgccagagcagccctctgcttccataaattgacttggaagttgtatcctaaaattgctgtggatgtcttaatcagaaatgtatccaaatttctttcaataaaatgtatttttgttcctcttccaagtcttaggataaaacagatgactgggaaggatgggccatgtttatcctggggcactgtgatttgagaggtgtggacataaaggcccatttagagcagcaacatctcatttactgggtactgggcaaagtcaacatttactgcatgatctttcagggaagaaaaagctaaactcaatgtttggcagttataagaggccattcaaaaagtctatctggtcattgattttgccaatttgtttacttatagcttgagacttctgcaaaatttttcttcccaactacttaaaagactgaactcagttacgaggtttacaccccaagcaattgaaaccttttttcccctacagaaagtttcagaataaatgcatgtgtttactcaatactcaccataaccttgtccttcacatttctgactttactgtcaagctctttctgtttgtctaacatcactgtgctctgaatattccccgactgagcctgtaatgggaagggcatgattatagccatcgttttcttcagggtgtgtacttgctggttacactccaaagtcaagtccccacttgccttccagatcttctgacatgtactacaggcttcctgcttatgtgtcaatatgaaatttttcccaaggccctggaaaatgctggcaaactgttaacaaggttacaaaaaaactaggctcaattcatgtctaaaataaacagtatttctgggagtttccattaattcatacagttgcatggtaccacgctggaatttagttcacggtttctcagatactatacacaagattactctcattaactcagtccttatttatcttaaagctttctgattcaaagtgtggtcctcagaccagcagcatctcaccacctaggatcttgttggaaaatctcaagggctaatatgattaggcaatcagaaaaccctattttaacacaattccgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagtgatccctgttctcatagagattaaattctagaaagatgttatttttttagagttaaatcccccacacagcaaaaactgtgcttgtcaacctttcttacacagtgccctatacagcacagattctacgggggtgtttttatatgtgcaattgtatcatcttttcttcatgtctggaattttccttatattagaaagcctttccctattgacattacatcattcactcatttccctagcacttgcaaggtttcctttttttctttttaacttttagatcgctgatatatttgtttattctcatgatcagagtgaagtatgggtccactttttgctttcactttttttccagttagctttccatttgtcttaacagcatttactgaaaagtccattattttccccagtgctctgagctgccaactttatcacatgaatttccatatgcacacgggtttccttctagatttttctcttctttcccattggcctttttattcataagcctgaacccttgaaggatgtttgactatagaggatttatagtctgtctagtagggccagtcccatttcattgctctacttgttcagaagttgcctcgctactcttgcatgtttatttttcataaatttcagaacaaatttgtgtagctccagaaaacaacttgttggtatttttattggaataacattaaaattacaagttaactcagggagagctaacatctttatgatgttgtttttaattcttatgcttctaatggttttctcttgtctaattgcattggccaataccaccaatacgatgctaaatagcagtggaaacacagcatccttgctgtgtttctgacttactggagttttcccagttaggtaagatactgtctctagaatggagatatatatatttttttgtgttaaagaggtacccatcaattcctatcttattcaatgtttttatgaggaatgagtattgaattctgttagatcttttcagcttctgtggaaggaagtaaatgcttttttctccttgtagctattaatttagtgaattgcattaataggttgcccagtcatggactacccttgtaacctataataaatcatatttggtcatgtcctttcttaatgtagtatttaattctgatccctaatatcttattgaggacttttatattgatactcataagtaaaattggtccataattttttgttttatctttatcaggcatacgtcatcaaagttattctctcttcataggaagttttccttcatgttacatattctccaacagcagaagttcaaagcatgtgaattgtatcagctgtaaagtgtgtattagaaatacatgaatgttactggtatcctctgtaagtccaaggtgccacatatcactcagtgacaaaaggggtttctctgggcggttggaataagttgtcactttgaggagttccatacagctttctgcctgtgcagggaaatctttgctgttgtctaattctgacatggtttggatctgtgtccccacccaaatctcatgaattgtaatccccattgttggaggtggggcctggtggaaggtgactggatcacggggacagtttctcatgaatagtttagcaccatcctcttggtactatccttgtgatcacgagttctcacaagatctggttaagtgtggagcacctctcccctgcttcctcctgctctggccatgtgatatgtgtgcttccccttcacctgctgctatgactgtaagtttcctgaggcctccccagaaactgagcagatgccagcaccatgcttcctgtaacagcctgcagaaccataagtcaattaaacctcttttcttataaattacccagtctcaggtatttctttatagccatgcaagaacagactaatacaacttctaagccagcaggatgtgggcacggtgtcctgtgggctttgtaacagctgggacactacacctagagagagggaccaggccactggagaattctgacttcccaggcctcctcccaaatgaccaaggctcggtttagagaacagggatataaacaatggctgtaaaacagcagctacatccccagcttctacatcccctttctactgacttgctgggagatgcttggtggaaaaacctggtgactgtggcagggcctaagaaatctcctgcttccaacttgggcagtagtccctccaagtcactcaaacccttggtgctctcttaccccttccactcatccctccctgcttccctccaccctgcccccatctgctaagcagatgcttggctgctcctgtacactttagtactgataccactttcacagtgagtccttaactttttaactttctaagaaaccaggagtactgaaaccacgggaatttcaaacactgaagttggaagggacttcggctgtcattgactcttactttctcgtttcactactgtacctctagagaccttgtttggatgggaacttggttactccagaccccagagcaaagaaaagtcttctgctcaggaagggggtcctttccaatggagtgagcagttgtccaagtaagggaataggcactccatgggtgtgagaagttccagccagaaagccctcatatcccatcccacagattagaaaactgaaaagtgacttctccagtgaactagttttagagttggacaatactgggtttaaattccaaacctacttctcattagctctgtggctctgagtgaagtacctgacctctaaaccttagttttctcatctttaaaatggggataagaatacctaacttcagtgatagtttcgaaagtatttactcaaatgaaataatgtttataaagtgcttagcacagggcctgaaacatgataagcactcagcatatggtaaccattagtccttaagaacacaaagatggaacagcaaaggaagcttagaatccacctcatgtctttccctcccacctgaaagaaattctccccatcccttcagaccctatggacctaaatttttgtctagacatgcaactagctttttcaccacaaagaaaaaaagaaagaaaaaaacttagtgtgctgtaagacagcacacgaaacatttatagtctactacagtgtgtatagcataatattctcttaaatgtattttctaaaagctcttatattaaaaaacaatgggaacaataatttcccatctcggcatgtctatagaattttgtggtctctaaatgatctgaactaactcggaattttgcatgtttttaacttgttgaatctgttgaatccccatgtacctatcacagtttcaacaattagcattcatggatggccttgtttcatccctattctccttactcttctagtccccaaatgggattatttgaagcaaataccagacatcacaccattccatacacatatactttagcatgaatagaatatacacagtcatgtaccacataacaatggttcagtcaacgatggaccgcgtatatgacagtggccccataagattagaatggagctttatgggggtaccaccttttatcttttacacactatctgtactgtaccttttctatgtttagatacacaaataacattgtgttacaattgcccatagcgttcagtacaacttcatattgtacaggtttgtagcctaggagcaataggctttaccatatagtgtaggtgtatggtaggttataccacctgggtttgtgtaagtgcactctataatgtttgcacaaaaacgcgatcacctagtggtgcatttctcagaatgtatctgtgtcattaagtgatgcatgtctgtattaataaaataaagttacttcaacaaggggggaaatggtgaagaaatgtttctgacctacctagccaatagttggctggataactttggaaaggaggcacctattgtgccttttccctttccctgacatccccagacacccagaaacttccctcacaccccaagaaggctttgcaaaggtgttcacggactcaggtgtcctctgagaggctcaaaacaatccccagattacctacatttttaatggggagggagctcaaaagctggtaaaccttcaagatccaaagccaggggatgaggttcatgtgggagagcaggggtcacctactctgctgccaatgccatctctgggccaaggggccaaatgtgaggatgacatgcttgcagctgggggaaacaggttgtccttctgcccatctttgctcctggctgtcctttcaagtctattagaaatacagaggaggcccacgcatactacttttaggatggaagccccatataatcaaaactgccggctgaaaatctcccaggtatatgccaggttagagacaggcacacctctttcagaggagacaacctggccagcttctcctccagcgttgatatacacctttgttccctaggctgggtaccagatgagctagccagcttgagtttagaataagcaatatgtatctttacatgctcagttcagcaagatgctatcagtgtgacaagaagatgggaactatacgcctagggaagtgacaggattacaaggactgggacaaatgctcaggcagtgtgtggagaatggcatcctccaccacacctaaactccctccctctccactgtcacacagttcacttcggtagttatttgttggtgaaatgcacacaggatgcatactgtgtcctctggcatccatatagcaatgggctcctccagaacaatccataacatggtggcttcacactgcctgcctgttggcttgttgtcaccaccccagtgctcaagaaaggaatactaaatgccatagcaaattcaaaactctgctgaaccctgacaactaggaaggtttgtattaggattaataaaacaatgatcaaaaatcttgatactagtacaactctgactcatttactgtttgatgccttgaatatttaataggtatcttgatgttgctcaaaacaaagcccttgattttcccatcagcctccttttctctccacaaacctattgagtcctacaaaactcctgcccctgccccctccttgccttcccagctccgtgtacagcattaccatttttcaaggggttctagtagctgctgtagagccatccttgactttctgctctcactcctgcatctaatccttcaacataaggatccttctatattggtatcacatccaaagcataacctgaatctgtccacctcttcctacctccactgattctactgagcgcaagcttccactgcctctaccttggacagctgcaagaaccctctatctgcctgcttccattcctgtgccagcaactcagaggcctttcctgaccctgatctaaaggaacaaccccactcccagccactccatgaattcagcatgttatcttctcagcactttatgctacccagaagtatcttgtttatatgttctctctcctcgttagaacttaattccattagattaggatctttcttaaagcctggttctataaaatctctaaatctgattctcccacttcttggggctataaaattagagagatattcatcattgctttgacatgggccctaatagtatttgatgaatgaatacatttttattttattacagtttatgtgttcaatgagaaaaaagtacctgattaaatctctgggcgttttccagaattttcctttcttccttcagacagctgtaaatgatcatagacatctggattgggtcttcctgaaaattatcctagatttgagtggttagaacaaaaataaattaaaatgcagaatgtttactttattgtgtattgtaagttgatatgaatttgtttatattctccgggaaacctcatctctcatctattaaattctatataagctatgtttgttaaaatcaaaatatttctttcacgaattatgacaaaaattgctttaactttctaagtgcaggtacctaacgtactttttgatttaaaaacaagtattttcacatatggttcacataatatttttactttaatatctttccatatttcttaaggccaattatctttggttaggatcccgagacaatgcaaatgatataaaaactatacatgacattcctcaatgaatgcatctgttggtctaagctttgaactagaccaaagatattcatctagggttttctgttgccattgtcaaagctagtttgcaaaacactaccaatagcaataatggctctttatacaggtacattcatgcaaggtctgtatgagaacaaatttctgtaaagttaatttgatttccccactcgtaaataaaatcataaatacattcacaaaggaaaaaaaacaacttccaattacctaagctgaaaagttcagttgtattgtatgaaagaagaaaatgatagctttcacctccattaaaacagaaaagttctgttattacacaacataaatatgatagccaccccaagggcatgctgggagtacatctgaagaacccctaaaactctatagcatgttctctcatgtctggatctttctttgactttctcttccaggagaggccaactccaccagaagcaaggcaaggtggagtctagttcctgaagtcacctgacttccttaggtgaaagtcaaacctttcctgttttattcctcatttgcatagcaaggacctgaacctaaccactaatgttccctggagctttaatgtattactatagatcattgctcttaaaatgtagccccttttctttggtttaaatattgacaatttttagtaaaacaaaattatagcatcacatttttctcaggattactgatacctaagaggtgatacatttaaccctaaaaattccttctgtgtttataaaataaattggtatcttattttacttatgctatatttactgatgctgtagaaaacataaatggagttagtctctattacttctctaaataccaataagtgtgtgctcaattgtatttgctgaatgaagaaaactgccttccataaacatgagaacatttcaactaaaatacaaaaaccaggtcatacctgaagattacgcttgcttttccttatgttatgctgtagcaagaagttattctccaaagaaaagcgactatattgatcatccagctgtgacaggaggtcatgaaaacggatggtggcaaatgaaacatcattggcagcgtgctccctaggagatttaacatttacacatttcattctagaactaaatgtctatgtaaaacagacaaaacaaatgttggtttccttattgaaattattaaaaataatttaagtattttcttaggtttattttcttcttttgaaactgacattgcttttagcagcagtttatgtggtatttctcttatgtgcaattagcacaaaaaattctaaactctaagagattgtgcatgacagtgttcatggtgactatctctgaagggggaaaagtcaacaggggacccttcactttctatgtcaaatactttcaggacgtttttaaattagcaaataataaattttaaagtagaacacctatcagttaaaaaaaatccccttaattttactaccttcttcatatttctaatcaatgtttaaccattaatttggctttatttcttttaaattacttctttctatagtctggatcctaagttggaaaataatcggtgtcagtattccgtaacttgtccaaagcatttaggaatatctatcataaattaaatttggcaaaactgtataaaagtgcttaatgactaatatacttaactttgttgagacactttttggctcaactttgttgagtcattttttaaatcaacaaacttttctacaacaaataattccagtggccattgatggaattcatcttccagtaaacatggccccaagtcacttaatcaaccagtacttttaaggtgtaaacttcttcttctgtctagtgaattttccttaccagtcttgcttttctaaccactgtgccaggtactgtctgatttccatgggaaaactgtcatcataaagctggtgaacctgctccaggaattttgagtcaagctgctgaagttcgtaccactgagacatcctatagggaaaaagaatatacattctttctatgtatatggaaaccatagctccaaagaaagccttcctagcatcaggttgtactcttaaatatcttgcttaatccaaaacatagtttgtcccaggaatattttatttaaatggcatttatagtctaaagcctgtttttaattgagtttggggatgaactttttttctcctccacgaaacacatcttcatgtctttgcttattgtcaacatatcagggcagccttctctggcctcttttatttaaactgcaaccacctcccaccctggaaacatgctctctcttttccctggtttatttttcttcatagtacttacaccaccatctgacctaccacatattttattttcattattgtctgttttcaccacttgaagggatggatgttggtggaggattctgtgcactggtgtatccctagaacaatgtcaaccacatagtaggtatccaataaatatgcctttaaaatgagtttgtgattttatcaaataaatacatgaaaaacattattttaattagacttgctttaagacaaatcacaagactctcccaaaattgctctcctacaaatcacagtacatttgtaatttaactcaaatattttcaaacttctgttttatatttatgattcatatggtaaaattcattatttttcttatacacatttaaaaagatatattttcttctttgcctactacaaacaataaatctggcataaagaagtaatgatttttaaagattaaaacatcattaaatgtaatttaaaaggataaagtaacacttagctttttggataactgttaagtccatttttacatagtgatcctaaagattcaaaatcacaacaaaaacttgatataagcaagtcctaaaattcattaggaaaacggagagtctcccatgaccatcatgtaacttaggatttatatcagcacacaggtggcaatatgcagagcagacacaagtgaatcttgtcctgccagacctctggggaaggagtctggattttcaagtagggcatggaagagtgtgtatgcatacttgtagccgagcacatgtatgcaggcatgaggtcacgcctactccacaaatgtccttccaaaggagtgtgaggaaatgtctggcctataaagctagttatcctcatatataccagtagaaacggacccaagcccagccccttggcactcctgctgaagcaatttgatttttcagttcagttttattttacctgagtggaaaaatctgtggctgtctccctccctgcttggtaactaataaggatctacctaaagcagatatgctggaccgtcaggcaatgggagctgcaacgcctcttattagccaagcgaacccaggtaacttactcccctatcaacaaggtgtgtgtgtgtgtgtttagtagacaggaacttgctctgtcatccaggttggagcgcagtggcagtggagcgcagttcactgcagcctccaacccctggactagagcaatcctcccacctcagcctcccaaggagctcagactgcaagtgatatggtttggctctatgcccccacccaaatcttacctcgaattgtaatataattcccatgtgttaagggcgggaccagtggaggtaactgaatcatgggggcagtctcccccatgctgttctcgtgataatgagtgagcctcatgacatctgatggttttataagccactggcatttcccctgcttgcatctattctctctcctgctgccccgtgaagagatgccttctgccatgcagaactgtgagtcaattaaacctcttcactttataaattacctagtctcgggcagttctttatagcagcatgagaacagactaatacaataaacacgagccaagaagcctggctaatttttaaattttctgtagagacagcctctcgttatgtttctgaggctggtctcaaacacctgacctcaggcaatccttccacctcagcctcccaaagtgctgggattacaggcgtgagcttccgcaccctgccacagttggttcttaaggctggttgagctagtacatatgtagcacctggcacagaagaggtgaattaataagctcatgtttgggctggccaggtggctcacgcctgtaatcccagcactttcggaggccaaggtgggcggattgcctgagctccggagttcaagaccagcctgggcaacatggtgaaaccttgtctctactaaaatacaaaaaaaaattagcagggcatggtggtgtgcacctgtagtcccaactactcgtgaggctgaggcaggggaattgcttgaacccaggaggcggaggttgcagtgagctgagatcgcgccactgtactccagcctgggagacagagagagactctgtctctaaaaaaaaaaaacaatgaataaataagctcatgttcacaaatctggagtcagtctcatctactcacaaaacctgttaccaactcagggagtggcatggccatctcccagtcactgagctcaaatctcagatttagggttgattccttccactccatcccaagacctgctccttcctgtctccaacattctaccttcccagtccagcctctgctgcccacagattggaccacatcaatctcctgtgcaaaaatcctatgatctgtccattcctaggcagatttccaccccaccccatcttcatccatcaacaaagcaacccagtcaccaaatcatttactgtttttcaactgtgcccaacatttctgctttgctccagctactcgcccttggaaacagcctctccacaaatttttgcgtctctaaatcctatagcattcaaagctatgtacaaaagccccttctttcataaagttgtctgagacttactcacaattaagctttctttgacttgcgtctcactgaattctgtacctctattagagcatcggttccagttttccttgtaaagctctgtgatgcctccagagtccccggcgggggaaggtgggtggggagggggtagagtagtggggtattttgctttttaacatcttatggaccttggacagtgccctgcatatactatgtgctcgaaacagtttgttgaattgaaattatgtatatttcagacggaattagaaagtaaaaagcaaaccatattatgatctcacaagtgtgagtccagcatcctcattaagcaatggttgcacaatggactgtgctggaggctcaagtcctgtttctgttctatgaaaataactccttatctatacaaacaacattcaaagcacaatcaaccacacctctgcatacctaccacagaactcttcagtaccggccagaaatttttttaagactatattattttggggtggggggtctgcaaaaactaaacatcacttttaaactctaggaagacattaagcccttccatctttgaacatagaaacataattaagattccgaagtcatgtactcattcatctgattccatgaacatttactgacctgccaccttgtgccccaacaagggcctggggattcaaccaaaggagcagctacgcacagcacgttaggtgccaagactgtcgaggttatatacacagagtgcgaacgttaacctagacagctctcgaggatggcatacagcaaatgaaactttctgcgaaaagaagaaaacgtgactgatggaaaggggtggaaacgggagaaagtgacggtaaatgggaaggtgcagtgccttctagaggaaaattatatttcacaagtcctcttcactgccagagcacgactggcaaggacaatcgtgctgagcagtgccatctccgagaacaggtggcactgctcgcacttggaatactcaggacgcgttcttcctctgggatcactattcgcgggtcagcacagacggcccgtcctcgcccggcgtccaactgcacggcccgaggactctgtccctgcgcgtcccacccccggcacccggaacctcacggccactcactctgcgcgcaggatccggaagggctaggcgggggcgcggcggtgcagcctctcccgagcgcgctgggtcgcctctgctcggtctggggtctgccaggcgcgatccccccggtgcagccgagcccctccgcagactctgcgcaggaaagcgaaactacccggcaggagaaaaggcagcgctggcgcccggcccccttccgcccccaccaatcaccgggcggctccgcgctcagc

SEQ ID NO: 2048 - DNA, 38714 bp, Homo sapiens
atcaacttttgctcattttatttatactttttcaaagggtatcagttttgggaaaatttatataccttaaatacaaatttggtttttggctttttttttttttttaaagtagtaaaatgctgataggcagtaacacggggatctcaacaagttcagctgtgatggcgatagcaattacaatggaaaagtaaaatacaagcatcttcaacaggccccagccaggagcaaggctggcttgaggtttgtaaacatgtcactcttctgtgttcacttacacttcagacacagaaatcaactcagtcttgatatatccagttcctttagggccatcaagttccattggctctggtgctagaaataaacacattgtgtacgctttccatcaaccgaaattccatcagaatacaacatcaacttttcggggggattaaagttctactgtgtttctagacagcttagcctcctaaaactttaaggagctataacctccctgcctgagtcacctaaaattctagtgggaatgcagaaacaacgagaagaaggatctgaattcagtctggaaataagctagtgttcagcaggacactagctaggagctttctctttacacaacttgaaatcttacaagaagtctgagcccaaaatatgcaaagttctatccagtttattggcattagcctggctaatgaatattcacagctgtcaaggtaagctggggacatcttcattccaaagtaattgtcctaatattgagatttctgattctgaaaaacagctttgttggtgtgttccaaacaaaacaggtctaattcgaaccttctcaaatgcaattcattgacaactgagaagcaagagacctgtgttctcagatgaggcctcctcttaataattatctaataaaaataggatctagtaagtaattgggccaccctaaatgaaccacttcacttctcccaggcctcagtttcctcaactttaacgtgagcaagatgccttctgttggtttaccacagttccttatttaaacccttttcatgtggaaacagtgatagtaacaaatacacaagaccagcaatggacttttccaacattcctaaaataggaaattgtccattcatttcttactagctgtatcaggccaaataatgcattatgtttcacctgcactgagtttatgccatcttttgaaagcctactcttaccaattcgaaagcaaaacactgcatgggtggagtttcagaataatcaccccctcatcaggaaagactgtgccacgctgttaccacctgcttgccccacttaccttcctttggcctggagtaatactttccaaaggcatggtctttgtcaatatttggatacagatacttcaggggattctcaggaatattctcagcagccatgactttgtaattgcgaatgatgtcagggaaagtaacagcagaaagttctttcttcgtgtagggttcaaccgcatggaagtcaggttctaaaaaggagaaaagctaagtaaatcccatagaacatcccaaaatgaaagaggacagagaaataaaacactgcagagttgatggatttgagtgaacctcataagaactaatcacaatctaagcattataacatatacagtagactgctttatttctaaataaattataatactgtctcagggaaaataaagggaggtattattctcaataacattctatttgccattatttgcttagatttataaatctgggcaaaaaagatttattaaaaacctttaaaagcctgcatcttcaatgatgtgctgcccataggcacataaataacttactactaagtggatcatcttggcttaagccacagatttaaattactagagataaactcactttgtttttcttttcatattgaaaaatctaattttttattaaaataaattatgatatatagaaaacaacatttcaaattaaaaatgatcctatttgctacatttccctgtaacccttaacgtaataaaccatggtttaatttactcccgttcttattcccagactgaattcagatccttcttcctagctgatacagaatctccctttgggtgtcgaccttccagaggccacggttcaggtgttctggggagcctgctgtggaacatgagactatgctgccatcctaacccttcctggctggtagtgtcctgcttgacctttcctggttgccaagggttttcttcatctctgcttggtctactatatctgtctctcagctggttcaggaagggaacaggataagaggaaaagggcaggttctaatgactactgcccacgccagactctcatctcagcctccctgctttttcctcagaagaaaaatagaacaagaaaagtattccagaaaaacaaatagaacaagaagagtattcctgaaaaataaacagaacaagaaagaataccgttccagaaaaaaaaaatagaagagtattccagaaaaacaaacagaacaagaagagtatggcagaaaaacaaatagaataagagtattccagaaaaacaggagaagaggaatatttcagaaaaataaatagaacaagaagagtattccattttgtgtctacccactgaaagtataaaaattactaaaacaaatcagtttttcctcctgcccttcaaacagaccaaactctaaacaacagtgaaaagtaatcagttggtctttatgattttttcatttacgctgttgagcttcaccctcagaaacctgcttcataacaccaaggtttctggagtcttttagccatggactcatttgattaaatagaaaccccatatatgataaagataaatttgcagctgctctgtttgaaggcagggtagaggctgccactcgtcccaacaggtcctgcatcaactccctggctgatgatgtgtatgaagtcttctcccgaagcctgtctcatctgcacactctactctgggatgaccctaagagaatgtggatgcttactcctgtgggaaatgtgattccttccaagaacgggttgcagattacattgactcacatccttgatctgcagataacaaacctgatgcaaaggaaagaattggcattgtcttttcaaaaccatcatttccacaatatgttccagagagtgaaccacaaccacaaacatttgtggtggtttattaaatcctatcgggggctcatttggggtaagtataagatctgcaatttcatgtcccaaacgcactatctgtatgagctgactggcggcgatgaagagggacttcacacacatggaatggtgggactatgtgctcaaactcccactcaccgcctccgttctgggaccgctccacccatgtgaatgtgatggccccttcccgggagctctcactgaaccgcagcaggaaggtccccggctgctggtccttcaacagggcacgctctcgctccttgctgatgaagcccatgatgcacctggatatcgaagagatggacggatgggcttttagttcaatcatgatttccattttcatgctaacttacaaaccaagaaaatggctggaatgtgagaaaaaaaacctacggtaaaaaacgtagactattttaaaatctgttcagttgacacttaaggaagcatttcacttatacatgtatatactaaggttttaaaaaaagcgatatgaacatggtgtcagtaggatgctacagatgctcaataacacgtgtgggattaatgagccttttattgttcctttattattttaaaggccataacaatgtctgaatgtatacatcttttttactggagaggaagacctaggcaatatattttcatattttagcccttctgatcaagttaaagcttctgttgaaatatcagccgatcctggcaataagtcaagatagaaatgatttacccagttaaaagggtttttcttccttcctaggggccacatagtaggtgctcaaaaaatttttgttgagtgaatgaatgcatgaatggcactcaagagttgttttttttttttaatttagctttgccaatacatatacttgtactaagaaagtgtaaggttaatgttatgaggttctactcttctgaagccctgaaggggcagcctataaatgcgcactcctgtgagattcacacacgcctagtcaaatactgaagctggactcaggccttgtctcaacctcgcagcactaaaaatatgtttcaaaatacatctatcggtggcccttacccatcattccagagagggagcaggtgttttttaatgagttctaggatgctttcaatccaaagccagaagggaaaatttttatcatttatattttcctgaaagtatacaaatgcagacattatgaacaaaaatctaaaacaatgacttaccatggcccctcccaccatcatttgcaaagactccccaggtgccaaggatggaactgtcccattcagcacagcaatgggatccctcccctggcagggaatatcaagttccctccccgctcttatcagcattcagaccaggagctctccagagctctccacttccctgggccgggctctgcttccctttccaaacagtagcaagctagcctgggggtgacctccagcgtgactcacggaaacacaagctgccccacactagcaaaatccagcagtgcaagctggtccgcactgtctggtgactccagcagaatctaaatgttccccgcagtgggcccctctgctcgagcaggccgttaaactcgtctggctggtcaggctgcgccacccagcccacaacatacatttcacacagaaatggctaaaacactgctgggcaggggtccagcgtgagtgaacagaagcctcatttcagatatgaaagaatgttatcactcaggcaggtgcttcctgtcagactcctgctcggagaccaacctcctgcactgaagaaaagtaaacaacttgcccgaggggctccttggccagagaagaacacgccaaaataagcaaacagttaagtaactatcacagcaagaaacatgagaacctcaaccaagagcaaaaaggacttagagagcataaaacccagacagtcctcaccttacaaaacctcgtccacggaatgagaccatcggggctggcgttaggacctaaacaaataaaaaccagatttttcagcaaacagaaactgattctaaagctttggttggacggatggctcttgtatttgctctcaaggaaaagagccaaacacccaacaaagattgtatgtacacagttgacattttcggataccttaatgccaaattaactgagcaattataatacgtgctgtaagagggcggaatttaaatggtctaaaatatgtatatgttggtttgagtttaatggcagaaaggaatggatggcagattcctgggcaccacgatatgagagtttttagggaaagcggaaacatcacaaagccttaccatctgctctctccctccccagccccccttttccctccctcctctaaagagaggacagtccttttaatgcctcttcatgttacacttccttccaagaccatcagctgactttgccttttgcactaaatcaaaggtgttctgctgggcctcctagagaagcctccctatccagtgcctcttcccactgccttcctctgctgctcagcagagccccctctcccaaggatcctacagaatttttttcaaagttcaacctaggtgcccaagatcacccctagatcttcaatgtaactgatacttgactttacaagtttattttagacattatttatgcatttccctcagctttcctccaaataggacatgggctcaggcagtctgatgcaaatcaaaaaccaagtgagagaaacgagaggaagaagcccggggttattagctacacaaattaaagcagcctgggcgagaagaggcggtaagcccattatcggtcttcaaagagaactacaaatgagccattacagctagaaaagatatccttcttaactctcaccaaataaagaaatggaataaggggattttgtacttgtattaaacagcacaagaccaccactgtgacagctgcatatccaagagaagaaggcactgttgaaagtcactgagttaggaagagcctactgctgtttggagtaaatgcagtgctgctctacagaaagcaaatctggatacaagttgtccacggatttttaaagaaatagttcagatagcctcactcactgaaagatctgaccttgagactagtggatctttgatttgtttagtatgaaggactaataaatgcactgacattaaccactgaaagggaattatctaccactgtctagactctgtccaatcaggcaaaactgcagatcaaaagaggcatcctcttgtggggacggcatcctctgctacctgggccccacctgaggcaagggccctgggtttatgctgcagtgggcaagccccaggactttatttctcatcatgtcagggacttccttttttctccccaaggttaatggttaataggccttcatctttctcatccaggaacttatttcagccacaaataatatattttacataattcataaaactttcccttgggaattcatctcagaaatcttaatatgagacaatgaggaacggattcatttaaatgttatcaggtctatatttctttctaaggtgacatatgattctcacttagctataataaactatagcttgaaaagctgacagattttagtacttttttacctttaacaaaatagcagaggggaaaagagcaattagagagatatttttatgaatttcaatttttataaacataacaagttaatatgcatataccaagaagcttctctcccaacatgttcagctggtccacattgagacctcttttggtgacagaagaaaactgccaactcagcacttctgaaagctgagcccatcgtgcacatggtggagtcaggaagaaggacagattctagagagaaaacacccaaaatctaagggttactacagagacaccagtcacaagtgtggcactaaaacatatgtccatcccaaagttcaattctagtttatatgacacacaggtgctttcacagtaggggaagagaaatacagtcaattttcattatttacagatgcacatttgtgaacttgtttactcactaaaatttacttgtaactccaaaatctaaatacatggcatctttggggtcatttgaagacacacccgtgcacacacagcagcacacagcagcaaagaattcgagtctcttaacacgcttccaactgaagccaaacaaaatgacactcgcttcctgtttcacctctcataagaaaaacgtgtcctttttgaagcctatttagcgccatgttttttgcattttgtgactgctgttggtgatccctgtttaaaatggtgcccgagcatagtaccacagtgtggtctactgttcctaagcatgggaaggctgggatgtgccttatggagaaaatacatgtgtgaggcaagcttcactcaggcatgagttacagtgatcctagctataggtgtaatgttaatgcctcaacaagtgtattagataaggtgtctttaaacagaaacacacataaacaatgttatgcattgatgggttgacaaaaatgttgtgaccagaggcttgaaggaacctagcctcgtagttcccttaggagcaacaattcattatttgctagttaagtgttcctggtgactttaaaaaacataagtactttgaataattataaatgactgtaattaattaacagtgagtatccacactctaagaatggagcatgcttgtttagtagatgtatacattttaaaaataataacaataaagtggtatggaatcactgactgccctagcttacccacatgggagaaaaaacgtaattctcatttcaaatacatatccatgcttcatattcccagatttactcaaaagccttagaaataccacaggagctttgtcacttctcccttaacaactggccattggggctatttcagagatgcagcagtgagagcgtggggtctctgcttaaccctgggaccaaagcaaatgtgttttccataccctgggttccgccaccagcatgttgtaccaaaggatggaggcccaaccgctcgggagctggctgacgttggagatcaccacaacgggcagagaggtcgtctaaaggatgacaaagaccttgaaatcatctgaatcacagaaatgtcaccttcagataactgcttagcctcaactaaaagcaggggattatttgtaaatttgtacatatttaatacttgaaaatgagaagtgttaagttctgttcttctgtccagtttaacttgtctttgatgtatctttcagttaagaaataagtccctaaaaataataatagctacaataattaattaagggatatgcaatatgagaagatgaaaactgtcacaatgaaaacataaaatgtggggggagggcagagcaaaataaataagtcccaatgcttaatgtaaaaaaaaaaaattaacatcagcgatctcaactggaacttttaagttattgaatttgaaggttaattcaattgtctagctttctggaccataaattaaggttaagatagtattagctgaaaaagatcattttaaaacaattaggtaaatacctccagaacaaacactgagaaataaaaatacatgtaacaattaaaagtaaaaataatgaagttttccaactcgggaccataaaagtcttacctcgaggtcaattaccaaaccaggctggcacaattgggtttcaaaactaagggagtgaagctcttcagtaacgatgagaggacccttggaagagaaaaggaaagaagaaaagaatataattattcacagatcctaaaactttcaaaagcccaattaacattgcaacaggccacagagatcctgggcccaatcagtggcaagtctgaagactcaatattcaatctctcccagatttaatgattcttagtatctcagtgtgctctgaaagataagtgtctgaagttacggcaagggttatagattcagagcaatgattgtcaatggggaaagagcaactaatggctttgtgacctaaggcttctcgaccctcagctctgtctgcctgcccagtgtggctgcacatctcaatgcagatgggtggggagaaggtgagaggactgggagtaagtgcatacttgtgattgtctactgcctaccggaagggctgactcacatcaacttggcaggtcacaagttgtcttggtttcggtagaaatggatagatttcaaagtgccttcataagcattacctcatgtgagcctcacaacttagaactagagaggtgcaacagctagacccagggaggtcaaaacatagttcaggcgcacaccagggctagaaggcatctttgcactgcctgggcctgtgtttgtcccgctgctccatgtgacctccactggtcctggtgtggaaggactgcacactgtgtgtgcataaatgacgaaagtgttctcaaccaaaacaactccagatatttcatcctttgtccatagttcatttctgaatgcatcacaaacccaactccttaaggatcacgctgtaggaaggaaactgatgcaaaggcaatgcttttggtaggggatgcaatggccgaaaagccctcttggcacacagcaaggcagtcatcaaagtggcctctcgttccaactctgacagtaactctgtgcacccttagctaaatcctgcaaacttctgtgagtcaatttcttcacccgtaagatgcgaagaatacaaaagcccacaacagctactccactgagttgtccatgagtgtctaatgaatttgtgtgcaaaatcgtttgacaatagtaaagcacaaatgtggtgtttttactgttgtcacagatataccaaatacccagctcctttgctgctcttccctgatgggtctgaactcctctgtgaggtgtccccagccaccaactgacctgtccttgctagacagacctgcctgatttgggcccattcacaacataaagggactctcacctcattcgttctggtgccagcatttttctgttctttcaattgctataaaacaaataatcatcttagtaaacaccatggtaatggtcaaagttgctatcttcatttacaaatgagaacaaagttaggactagaaagaatgacagacgtgactttatctttagaatgcagaacatgggacaaattggccctcgttcagggtccatgagcagaagcacgtttcctcagtggcctcatggtgcggacaccagtctggagggatctcttggaatcacaacccgctcctctcctgtgttcaaactttccctgaatgtttccccatgcaccttcgttaactgtttcatgccctgaggctcgggacagcttctccctcccctttccctcagcagagtcctccaggctgggcccagtgactccaggtccacctgccctcaagtggacgtcaatctctgagctgtcaatccctgagctgacgagggagcaggctggggccctgagggcggctctgaataccctcaggcacctgagttgggctaagctttcgagttaggtagagcttcctagctacgaggcttgctggatcacaaagtggtctctagtgaaaaaggatgcctttaacctcctgcaggttctgggcccagggaaagcttcggactcagcacccacagagcctcacagcaactggcagcccccatgttcacagaggaggaaagatggtgcacccacacagagcatcctgctgggtctccactgcctggggaatgagccctactgccctggagaaaaggtggtagagtcaggctggcgtggaggcaggggctgtgggcagggccaccaggaaggggaacacgggggctgaggagtgaaccctggtgtacaggaccacacttggatcacagtcaggacacgggagccataacctttgagaaaactgcaagcgtaggtgagtgaccgtggggatcatgcaggcagcaagtgcaaatcatttacgtaaacacaggcttaggaaatatttttactgcaagtgatacagcccagaaaacagagtgaacagtcgtgggataaggaggagaaaccaaaatgccccaagtactggcgacaggaagacaccagccacaaagtctacaaaccccagcaggggggcgtcctccacatggcaatgtgccaaaaagggctgctctattgtcaaaagtcctaagaaaccagagacaacatagagaggaaactgatgtccctaccaggtgccgaaattcagccgccagactgccattggtggactcctccatgttcatcacttttgtgtgcgtgcccaaaatgttgaacttcctaaatctatacaatataggaaagaaatgctgaaaagtcttccaactattaaataaataaaaatatagcacagtatagcgtaaagtacgtcacgtacccttttactgtatttctctcattcacatctctgcaaaaaaaatatatataatcacatatgcgtatttaaaatttgaaataagctttaacaaaattataagagtataagagcataagagtgtaagtgaatgatgaataaaaaataaatctacacctatggatttgcagcctttcattcactccctgcttccatctacccatactaggtctggcaagtatcactgaatgacctttggcaaataaatggtctgggccttacattgttcatttgcacaacatactaacagtgccaacatataggacatcatgaggaataaactagttaattcctcaccagtacaccctcaataaatgtaagcaccagcaccagtacaccctcaataaatgtttaagctatcgttattgtttattgagcagctacttggtgcaaggccctgcactaagcactggggatccagccaacagcactgcccagtagtcacaaagctcagaggactgccaatgtgaccatttaattctcatttttattctctatgatctttaatgctctcatgaaagtaccaggaaagtcagttatctggggaaagtggcaagtttaagttttaagtctgaggttaaaattttgaaagaccttgcacttctatatccagtgattactttgtcatgttctggccaaataatgtatccgtgagcgtcctagatgtagactagaaatcatgggctcactcacagatctattagttccccttcctttccaatctcaaccagaagttcaatgcttttgtgaatgacaatcaccattagctatggaagggacctattttcccgtttggaaaaaaaaagaatttaaaataaaagggatagtatgataaaagctgacttgtcaaagctaagaagaccgtcagagctggaaccgacagaaaagacacaagggcccgaagcagctgagaggagctgagctgacgcagaagatggtaaactgcaatggcaacacaactcttgtgcttcctccgtttaggaagtaggatatacttccccatcccccgaatctcagctggccttgatttgcttttagcaacaggatggaagggagtgatgctatagatgttccaaggctagcactcacaggccttgttcacttggaacactgtcaccatgggaaaagcccaggctagcctttttgaggtgcatgaagaaggacctggttatcccagctgagtcccagtcatgtaataaggccttgctagagcacctggctccaaccacactagctcagaccaggacaacctacaactcacagaatatgagaaataatgagtttttgagtttttagccactaagtttttgtttgtttgtttttagacagagtctcactctgtcacccaggctggagtgcagtggcatgatctcagctcactgcaacctctgcctcccaggttcaagcgattctcgtgcctcggcctcccaagtagctgtgattaccggtgcacaccaccacacctggctaattttttgtatttttcgtagagacggggtttcgccatgttggccaggccggtctcaaactctggcttcatgtgatctgcctgccttggcctcccaaagtgctgggattacaggtgtgagccactgcacctggcctagccactaagttttgggagtggtttgttaggaagcaaaagctaaccgatataccaaagatgatggcagggaagacaaggcacagaccatgctatgaggaagaatattcttataggagtgggaaaaagcaaaaagccagaggaaaatgatctgaatgatcataaatcatttttgaaacttgccaaaacagtatgtgacacaagctaacaaaaacattaaatatgggaggggtggggggggagccatcttgttccttaatgagagtggccaagttagtgccagtccaggtctagggtctcagggcaaaataggatgaggctgctccacctggacccccaagagagatgcccattcctgggttcccactgcccagaagagacaagagtgaatcccacaggctccacacagtctccccaagatgctgctgacctcgctccagaaaaaaacccccaaatgaccacagaatcatggcagcctggacgttcagcctcgggttggatcaggggcctctcctttggggctgacctagaaggagggggtggcatgccaagtccagccactttgagacttgctgattacaatctcatatgcacaaagagacactcactcttttgttcatttatagtctaaaaaggcacaggaatgttgataccagctccaggggaagctcccaacatccaccaagggagctgctgatttaaatctgctggggtcatttgtgatggccctggtggatctgactagaagtctctgctcatgcgcagcattgtcaggactctgggttcagccctggggccctagggaggcaaacttccacccagtatagacccttccacagctagaaatctgcttatttagtggaggaatctgtgcttgagtaacaaaatcaacatttcaatagtacatgtatgttatataatgttaaagatatcttacttatcaaataagactttgactttcaaattataattcagctcttgcaatttcaccaacagtctggaaagaaaaataaaagccattacttaaaaaaaattatctgttacaatttatttattatgccaattccctattaacgtttagataaactactccccctccagttttagggtattaccaacaaaaaaactgacagttttgtagatctacttaaatttttgtaagtgtatttgtaagaataaattcctagctgtggaaccgcttaggaaaaattgtaacactaattctgacaggatgccgccctgattttacattgccaccaaaagttaatgagggtagctgtttacctctataaccttgccaatattcagtttcatcacaatttcgacctttggccaatttatatgggtaaaatagcaaacattactttctattaaaacttgtatctaatctttgtcctgttgggagacaataaaaactattgcccataagcagaaaaaatagcgtcccatctatagtcaccccagggtagcatggaaagatggagggcaggtgagagggtgtacctctgctccactgagctggagactttgagaaggagaccccggggctctgtctgctccgttcagtggagcaggtggatgggatcagatttctactgtcccttccagctgctgagttctaaaattccacgagggcttcagtgtgacattgtacctaccagccagggagggttaaccacagacttaaatcagcaacaccccagaaaaaggacccgggccaactatgaaggccagtccagttcttcagcgtctagctactcatcataagaagaatgcttaaagcaatgcagccattcaatggaagaaagtaaagccacatattcctggaaacacttctacaattagtatcgaggagaaagactacaaaacaatgtatgtagcctactccgagtttttaaaaaagaaatatgtcatatttgtgtgtgtgtgtgtctctatatgaaatatttgtgtagacatggaatcctaattttttaaaaaggaaacattatgtcatgtttgtgcgtgtgtgtttccgtatgaaatatatatttgtgtagacatggacaaaatcctgggaggacagacactaggccatttactgtggtggtccacagatatttatatcacggactgctttgagaaactgatgaaagctataaatccatccatcagaaaaatgtacatgttataaatccacattcatacagcttctggggttcataaggctcaggttatgagcctatgcccaagaggggtgaggcagccaggaacttttactctctattacacacatttctgcaatttggaattctgttttcctgtgaacacgcattacatttatgattggaaaaaaaccaggagtgtgtacatatatgtatatcagttacatttctactatgaatatattaataaaagactctcagatattctcagtaagagttcatattaaagtgccccctgaaaaattatttcctcaaaagcaccctatataacagtttttataaaaggaaactaggggtacaaactacgtgacaggtgatgtatgggatgccatctttcccttgttacctcaacttcacagtgaactggacccctgtcttcaagaccagcggcctctgagggtgcgttggcatgcagggctgtctttccaccacaaacgagctgcaaatacccagcaaaggatagataagttagcatttccattaaggttgaggcaatcacaatgattttcctgaaagaaaaaagggggttagagagtacgatctaaaaaatcatttgaaagattctgacaagttggatgaacaaagtgatattttctaattagtaaagaaatcccaaaacctaatagggacttaacagaaacagaataactgtaatgatctgtgaaactattacattgaaacaaacatacaatgaaggctaggcacagtggcccatgtctgtaatcccagcactttaagaggctgaggtgtgaagattgcttgagcccaggagttcaagaccagctcaggcaacatagtgagaccgtatctttacaatttgtttttttttttttaattagccaggcgtggctaattagtcccaactactggagggttgaagtgggaagatcacttgagcccaggaggttgaggctgaagtgagccatgatcacaccactgcactccagtctggatgacagagtgaggccctgtctcaaaaatccaaaataaaaaataaaaaccccgtatttaattatgttcatttacatgtcagaattaagaataaaatgtgcactcaaagtacaagtaatgtttttaaattttaaaaaacccaacatacaggacttcttgtttgaacattagccatagggaaccaagtacatttttttaaatattacttccaataagtacgatatttattaaacatatcttcagttgttttgttacatagtatgcaacaaattacaatattctgcagccacaaattatatgcagagtatgaagaagctattaatcagacagtgtaatctttccatttataactctacaaggaagaactagcaaatcagatcttacatataacatctcactaaactttacgcatggaaagtgacagacactgcttgtgctgtttgatataaaatggctgaacttcatcttcagaagactatacctgacatctaaacacaccaatataaacatcaaaacaaaatatattctaaccaaccacgagaaaacagtctgatatcaggaaaatacattattttataaaccagcacacaaaggtttaagacagttctgaaaatgaagttagctgtcttgagtcaagagaataaaaaaaaaaagtcagtattgaccatttacaatctctgacctctgtggatatggtaagaatctgttgtagtgcagctacatacagtacaattcaggcaattttgtttcttcacttgggttcagattgcaaatttattactgtgagaaaaggatggaggcaaattttagcaggaacctccacctgactgcttgaccagagtgctctgaattttaacactggacttctcagcaccaccagctgttgctccaggacccattagcttcttaatctcagctgccatcatcatggaacacagttctacattcattgcattctttcttttttttttttttgagacagagtcttgctccgtctcctaggctggagagcaatggcgcaatctcggctcactgcaacctccgccacctgggttcgagcaattctcctgcctcagcctcccaagtagctgggattacaggcgcccgccaccatgcctggctaatttttgtatttttagtagggatggggtttcatcatgttggccaggctgctctcgaactcctgacctcaggtgatccacccacctcggcctcccaaagtgctgggattacaggcatgagccaccgtgccgggccttgttgcattcctagcactagtttccaaaaacagaattccaagggaatcagcaaattccttggctgttgtgtagtctactactttctctgtggtcagatcacacttgttccctaccaacaatttgttgacgttttcactgggataatgatctattttctgcagtcactgtttaatattattgaaggactcctgatctgtcacatcatacaccactaggatgccattggctcctctgtaataactggagatgactgttcgaaacctttcctgttctgctgtgttccatatttgaagcttgattgttttcccgtctaactctatagttcttattttgaaatccataccaattgtgctgatgtagctttctgtatatgttatcatctgcaaacctaagaaggaggcaagactttccaaccccagagtcgccaatcagaagtaatttgaataaataatcaatttgggattcatgctggacatgtcactgtagctgccaccgctgccacggccacccttgctgctacagctgctgccctgactctctgcaccacgggtaactgaaggaaaggaatgagataggctgttctgggagagtaaatgtcttccccgactctgccccctggaacgcaatcagcagccgctgccactcagctattgcttccacccaaaatcaagtacatttttatcatgtcaagtttgcattaaaaaaaaaaaaacttgcaatatgaacccttcttttccactcagtgacatttatctatctactaagtgtgtctagagagcctactgttcacaaggcactgcgctaggtcctgctgggggaaaagggtgacaaaggcatgtctctgccttccagaactttatgatattcaagaaatataaagaaatacataacaactatataacaaaaggcagagtaggaaaggaacgaagggtgactgtaggccacgaagggagataacatctgtttgggaaatctgggaagattaaatgatgagatacaaggtgaagctttcgggatgatacaattttgaaagcaggtacatgaaaagaaggctctgaggaagaggaagtatcctcaggagagccacagaaaagcaagtatgcggcatggcccctataggaatcagcaagaggtcaagtttgcctagaaaggggcgtgtgtggacgtgaagcgtggagtgttcagctaggtccaggctgcagaaggggggccgtgaatgcccagctgggcattcacttggatcagcaggtgatgaggaaccagaatggaactctgctctgggacagcactggtcacagggaggaaggactgggaaggaggactggtggggaggctggggaagagtccagaaaggaggatttgagagcctgagacatgaggaggggagaggaggaggtgaggcatgttagggtcacggcggagactcagccaaaggggaaggaggagtggaaggttactatagcttccagcctagctggccacaagagtgaagaaccactggtataaccaaataattcaggaagagtcattgtcattaaaaaatttgaggccaggcacagtggctcacgcctgtaatcccagcactttgggaggccgaggagggcagatcacctgagttcaggagttggagaccagcctggccaacatggcgaaacccagtctctactaaaaaaaattagccaggtggggtggcatgcgcctgtagtcccagctacttgggaggctgaggcaggaggattgcttgaacttgggaggtggaggttgcagtgagccaagatcacgccactgcactctagcctgggtgataggtgagactctatctcaaaaaaaaaaaaaatatatatatatatatatatatatatatataaaaaacacctattaaacccttgtaaatcatctgaattaacggtaaaatgttcctctgtatagaccgattacagaaggtacaaataaatgtcccttgagttacctctgaatgagctgctggaaaagactgaaggtgcggtcccataacacttgtttgttttttgtgatagggtcatgttcgtaggtgtatttctgttccaattcctccaactttttaagctgctgccgaacttgctgcagactctccgcaactatagtgaacctgggaagacacaagacacagatgtctctatgagaaacagtccagaagcagcctggattaaagggaatcatggtatattagtccattctcatgctgctaataaagacatactcgagactggagaatttataaaggaaagaggtttaattgacacatagttccacatggctgaggaggccccacaatcatggcagaaggcaaatgaggagcaaagtcacatcttacatggtggcaggcaagagagtttgtggagggaaattcccacttataaaaccatcagatctcgtgagacttactcactaccatgagaacagtattgggggaaccacccccatgattcaattatctccacctggccctgcccttgacacatggggattattacaattcaaggtgagatttgggtggggacacggccaaaccatatggcatggaaaccaacaagtggttatatgcaacacaaaatgtcacctaggatgccatgctctgccctctagggaaaaacaaagggaacgaggcttgtgccagcagtagaagctttgttatttgaggagtacaactaacatgcactgaatgattacagcctacatcaaaaacttctacacaccactgaggcctatgtgaggagagatgggtggaggcagggcttctaggtgatctgtgactggtgcagggcaaagaggaggccagaggcagggaaaacagcaaagcaggtgcttccaggtgatgcaagaggcagcaaagagccactgcaggttctgtcaagagagtggcatcagcaagcagtgtctcggcaggaccagtcagagatgtggggcagaggggcaggaggagagacagagatgggagacaaggccggggacaggaagagaggaaggaatgatgattctggtttcactcaactgaaaggagaaggcagtatgctcagtctagaccctaaacataaaaagccaatgagtaaacccagtgattgctcttagtcttccttccttgcagtcaactgctaacagcaacacaggctggggaaacgctgttttattcacttgcagtaatgacagaagaaaaccttttaaaagtgtcttcttccctgggaaaagtatctacttcactttctgattttgctcgattccagttcaaagccctgggacagcagcccttcgtcaggaaaggagaaggcaggataacggctggctgagttccagcggagaagctaaaccagtgtccccaactctgcttgcacacagagaaaatgacagcacagtgggaaaactagagggcatgtgtgtccctacaagaggctcctgtggtctaggaggaccactagggggctctaaacaccccagggcctccctggccacctgaagggctttagggttgtatgtatccctcaaggcacatggggtgcactgggctcagaagctctgctctaacccacaagaaatctggggtacctacaggcaattcacagaacaaaaataaatggctgaatattaattgtgatttttttaaaaactggcaatatagaaaataacctcgtgagatctctggtccttggacccttagcaattgtcccaggccaccttccctcatgttcactctgtgattccaagttcagctcctgttgcccctcacctggaccacactaatatgctaatagtattccaactggtctttctgtctctatcctatcctccaggctgtggccagagtgccctttctaaatcaaagatcagagaaatacatctcctgcttaagaaaaaagcctgccttggctcagcagtacagctgcgtacatcccccattcccagcatggtgctgagaacctgcaccatcaggctccagcatctcccaccgggtccactttccttcccatctccctggacaccccactctccagccacccaatacagcccctgcagtctcccacatgtgtgcctttgcacacgctgtgctctgtgctggaaagcacttccccttgatctacgtggagtaatcctagtgacttttgagtcagcacaaggccacttcctctatgaaaccttccctggagatgctttcctttgtcctccacagaattctgatggccttttgctagagcacctggatacttttaccacacgaattattaccatgtctacatccccccctccacactgagaactccttgttggcaagggccaagaatcactcatccttgtgtgcccaggtcctacagtgcccggcacacagtaggcatttaataagtattactggatggatgactgaatgtttcctaaaaaactattctgtaagcctagaaaaatgcctcaagctatcttgtttttaaggaaacattaagagtcaagtcattaaatgtgttctataacgaccatgtcactgatgttttgtacagtcaaacgacaccccatggtacaggagtgctccaaaccaagcagacgtggctgaacgtggcgagagtcatgaataacactgtgctttccaagggagtgtttccagggtaagcagaagctggactatgtcaaactctatactaatgttttgacagggtccattcaactaacacagctcaaaggtacatttatgtgtttatgtggttagccagtcagctgccagttttctgctttggagaatcttaccagttctgcagctgatccaagcaagcattgggcggccccccaatacaggcgctctgctgtctccgcttccactccactagttcatcattaatcagggcattctgggtaagttcagtgacattcagcaactctattattttgtgaactacttcctaaaggcaatagaagaaacaaagtgaaataaattcatttttaatcactgaattttaaaatattttttaaaagaaaagcaaatatcatttcattctcaactggggctctaagccaggtggctataatttttcctctcttctaaactttgagtccattatttacagtgtataacaaaagtggcatgctattctggaaagtaaataactacctttctcttattgtcaagcattaaatacatcttcttgagtaacagctgttcttgtttctgatcactctttgccacaccattggtctcgtgttctataaattgagagacagccagtaaatatataaagaagacaaaaccaacaaaagccaagattcatataaatttaggataaatatgacacaaatgctgcctagtgacaggtcaaagtttggctttcttcgatctttaatgaacatgaaaaaaagtcctaagtataacaactagacacactgaaacaaaatacttgttttcaaaaattagccgggcgcagtggcagacgcctgtagtcccagctactcgggaggctgaggcaggagaacagcatgaacccgggaggcggagcttggagtgagccgagatctcgccactgcactctagcctgggcgacagagcgagactccgtctccaaaaaaaaacaaaaaaaacaaaaaaaaaacaaaaaaaacttgttttcagtgacccatgtaaatcagacatagtagtatctgccacttaagacactgtcaggtaattacctaaataaatgtaaataacattaataataatgttattattattataaaaataaatgtaaataataaaatgttttatctgaacagaattcagataaaaaatgtatacaaagcatagctgtagctttcaaagagaagtagatgagtaggaagtggtagttgaagttgctgtctcttatactttctacccaaatcatactgataatctctgcctatgaaccatggtataccccagatgatgaatagagtaacagcagtaccctacgtgtcctacacaatgtacattcttgagatcttttctgttgctactctcattaaaaacacgcaacagtaagaaaatacagtaaaactgctttaaaacatgagaaaaatactgagcttatctgctgtgtatacacgtggccctgcaacgtttgaagaaacctgagatattagggcaggggaactccacatatctatcgctctgtgtcagtcagtgggctaggcgcaataaatatggtgagtaacacataaccagtggttatcaagtaggggtcactgacccctaggggacttttggcaatctctggagacagttttggttgtcactagtgagggctcctgggtagtgctactggcatctggtgggtaaaagtcggggatgctgttaaacacgctacaatgccaggacagccccaacaacaaattagcccgaaatgtcaataatattggatgttgagaagccctggcctgggttatcaaggaagaattcagagtcataaaatactcggcaaatagaaaggagtaatcatcttcgttatctagtgtgaacagaaaaaattgcagccaacgggcaccacttcagttgtgaacccttacctctgttctgcaaggttttgcatttgaagtcatattcatcttgtaaatcttccaggctcttgatttcatgctctatacactacaaacaaagatgtaaacatgttttctactgatcagcaacttccaaagactttaggcaacagagtattgcttctatggaacccagagaaacacgaaaacaattccatctcccccaaaaagagatctgacttggacagttctaatcatatacatgaaataatttcggtttcattaataagtatgtcataacatttttaaaaaagcaaacgtacaataattctcaaactgatttgtatgtccttaacctggttccagcgcctaaattttgattcttcctcatcatttttgagactacctctgagatatgatttaagaactccactgtgaagcccacagcaggcggggaaaaagctcacagaaaatttcctcattccttccaagtaagaaaagtgaccatacatccctgctttaccgggatagacctggtttcatacttgctgtaattataaacagtgccctcttggcggctcaaatgcatctccatctggacaataaattgtatgttcattctacaaataagcctcatttgtttgggatttggtcacatttccacatattcttctctggatttccatggctatttctggactgggctcactcggtttctactttaatgaaatgtttccctaggagaccgcaagatgaagttgctccaaagaatgtggagtttggaaagatgctgtctgaagcatgtaagtcaaggccatactgctattacccagagatccacagaggaccaaacccctaagctggaaggccttttccacaaacacaggcctctgtgaaaaagaactcctcaaaccctccccacaccagccctaacagtggagaggagtaaatgcgcaccatcgaggacgccagagcagccctctgcttccataaattgacttggaagttgtatcctaaaattgctgtggatgtcttaatcagaaatgtatccaaatttctttcaataaaatgtatttttgttcctcttccaagtcttaggataaaacagatgactgggaaggatgggccatgtttatcctggggcactgtgatttgagaggtgtggacataaaggcccatttagagcagcaacatctcatttactgggtactgggcaaagtcaacatttactgcatgatctttcagggaagaaaaagctaaactcaatgtttggcagttataagaggccattcaaaaagtctatctggtcattgattttgccaatttgtttacttatagcttgagacttctgcaaaatttttcttcccaactacttaaaagactgaactcagttacgaggtttacaccccaagcaattgaaaccttttttcccctacagaaagtttcagaataaatgcatgtgtttactcaatactcaccataaccttgtccttcacatttctgactttactgtcaagctctttctgtttgtctaacatcactgtgctctgaatattccccgactgagcctgtaatgggaagggcatgattatagccatcgttttcttcagggtgtgtacttgctggttacactccaaagtcaagtccccacttgccttccagatcttctgacatgtactacaggcttcctgcttatgtgtcaatatgaaatttttcccaaggccctggaaaatgctggcaaactgttaacaaggttacaaaaaaactaggctcaattcatgtctaaaataaacagtatttctgggagtttccattaattcatacagttgcatggtaccacgctggaatttagttcacggtttctcagatactatacacaagattactctcattaactcagtccttatttatcttaaagctttctgattcaaagtgtggtcctcagaccagcagcatctcaccacctaggatcttgttggaaaatctcaagggctaatatgattaggcaatcagaaaaccctattttaacacaattccgggtgatccagaggtatactgaaatatgaaatcactccattaaggccatcaatgaaaatctgctactataaagtcaataatgaatataaacccagacttgcctgggagtattcagtcctatttttgataatcagaacactcagaagtgacagggtctctacttgcttcatacaccagatgtaccctgcacatactaggtactaagtaaatgtcaggcaatgctctaggctcgggtgttagagtggtaaccagtgatccctgttctcatagagattaaattctagaaagatgttatttttttagagttaaatcccccacacagcaaaaactgtgcttgtcaacctttcttacacagtgccctatacagcacagattctacgggggtgtttttatatgtgcaattgtatcatcttttcttcatgtctggaattttccttatattagaaagcctttccctattgacattacatcattcactcatttccctagcacttgcaaggtttcctttttttctttttaacttttagatcgctgatatatttgtttattctcatgatcagagtgaagtatgggtccactttttgctttcactttttttccagttagctttccatttgtcttaacagcatttactgaaaagtccattattttccccagtgctctgagctgccaactttatcacatgaatttccatatgcacacgggtttccttctagatttttctcttctttcccattggcctttttattcataagcctgaacccttgaaggatgtttgactatagaggatttatagtctgtctagtagggccagtcccatttcattgctctacttgttcagaagttgcctcgctactcttgcatgtttatttttcataaatttcagaacaaatttgtgtagctccagaaaacaacttgttggtatttttattggaataacattaaaattacaagttaactcagggagagctaacatctttatgatgttgtttttaattcttatgcttctaatggttttctcttgtctaattgcattggccaataccaccaatacgatgctaaatagcagtggaaacacagcatccttgctgtgtttctgacttactggagttttcccagttaggtaagatactgtctctagaatggagatatatatatttttttgtgttaaagaggtacccatcaattcctatcttattcaatgtttttatgaggaatgagtattgaattctgttagatcttttcagcttctgtggaaggaagtaaatgcttttttctccttgtagctattaatttagtgaattgcattaataggttgcccagtcatggactacccttgtaacctataataaatcatatttggtcatgtcctttcttaatgtagtatttaattctgatccctaatatcttattgaggacttttatattgatactcataagtaaaattggtccataattttttgttttatctttatcaggcatacgtcatcaaagttattctctcttcataggaagttttccttcatgttacatattctccaacagcagaagttcaaagcatgtgaattgtatcagctgtaaagtgtgtattagaaatacatgaatgttactggtatcctctgtaagtccaaggtgccacatatcactcagtgacaaaaggggtttctctgggcggttggaataagttgtcactttgaggagttccatacagctttctgcctgtgcagggaaatctttgctgttgtctaattctgacatggtttggatctgtgtccccacccaaatctcatgaattgtaatccccattgttggaggtggggcctggtggaaggtgactggatcacggggacagtttctcatgaatagtttagcaccatcctcttggtactatccttgtgatcacgagttctcacaagatctggttaagtgtggagcacctctcccctgcttcctcctgctctggccatgtgatatgtgtgcttccccttcacctgctgctatgactgtaagtttcctgaggcctccccagaaactgagcagatgccagcaccatgcttcctgtaacagcctgcagaaccataagtcaattaaacctcttttcttataaattacccagtctcaggtatttctttatagccatgcaagaacagactaatacaacttctaagccagcaggatgtgggcacggtgtcctgtgggctttgtaacagctgggacactacacctagagagagggaccaggccactggagaattctgacttcccaggcctcctcccaaatgaccaaggctcggtttagagaacagggatataaacaatggctgtaaaacagcagctacatccccagcttctacatcccctttctactgacttgctgggagatgcttggtggaaaaacctggtgactgtggcagggcctaagaaatctcctgcttccaacttgggcagtagtccctccaagtcactcaaacccttggtgctctcttaccccttccactcatccctccctgcttccctccaccctgcccccatctgctaagcagatgcttggctgctcctgtacactttagtactgataccactttcacagtgagtccttaactttttaactttctaagaaaccaggagtactgaaaccacgggaatttcaaacactgaagttggaagggacttcggctgtcattgactcttactttctcgtttcactactgtacctctagagaccttgtttggatgggaacttggttactccagaccccagagcaaagaaaagtcttctgctcaggaagggggtcctttccaatggagtgagcagttgtccaagtaagggaataggcactccatgggtgtgagaagttccagccagaaagccctcatatcccatcccacagattagaaaactgaaaagtgacttctccagtgaactagttttagagttggacaatactgggtttaaattccaaacctacttctcattagctctgtggctctgagtgaagtacctgacctctaaaccttagttttctcatctttaaaatggggataagaatacctaacttcagtgatagtttcgaaagtatttactcaaatgaaataatgtttataaagtgcttagcacagggcctgaaacatgataagcactcagcatatggtaaccattagtccttaagaacacaaagatggaacagcaaaggaagcttagaatccacctcatgtctttccctcccacctgaaagaaattctccccatcccttcagaccctatggacctaaatttttgtctagacatgcaactagctttttcaccacaaagaaaaaaagaaagaaaaaaacttagtgtgctgtaagacagcacacgaaacatttatagtctactacagtgtgtatagcataatattctcttaaatgtattttctaaaagctcttatattaaaaaacaatgggaacaataatttcccatctcggcatgtctatagaattttgtggtctctaaatgatctgaactaactcggaattttgcatgtttttaacttgttgaatctgttgaatccccatgtacctatcacagtttcaacaattagcattcatggatggccttgtttcatccctattctccttactcttctagtccccaaatgggattatttgaagcaaataccagacatcacaccattccatacacatatactttagcatgaatagaatatacacagtcatgtaccacataacaatggttcagtcaacgatggaccgcgtatatgacagtggccccataagattagaatggagctttatgggggtaccaccttttatcttttacacactatctgtactgtaccttttctatgtttagatacacaaataacattgtgttacaattgcccatagcgttcagtacaacttcatattgtacaggtttgtagcctaggagcaataggctttaccatatagtgtaggtgtatggtaggttataccacctgggtttgtgtaagtgcactctataatgtttgcacaaaaacgcgatcacctagtggtgcatttctcagaatgtatctgtgtcattaagtgatgcatgtctgtattaataaaataaagttacttcaacaaggggggaaatggtgaagaaatgtttctgacctacctagccaatagttggctggataactttggaaaggaggcacctattgtgccttttccctttccctgacatccccagacacccagaaacttccctcacaccccaagaaggctttgcaaaggtgttcacggactcaggtgtcctctgagaggctcaaaacaatccccagattacctacatttttaatggggagggagctcaaaagctggtaaaccttcaagatccaaagccaggggatgaggttcatgtgggagagcaggggtcacctactctgctgccaatgccatctctgggccaaggggccaaatgtgaggatgacatgcttgcagctgggggaaacaggttgtccttctgcccatctttgctcctggctgtcctttcaagtctattagaaatacagaggaggcccacgcatactacttttaggatggaagccccatataatcaaaactgccggctgaaaatctcccaggtatatgccaggttagagacaggcacacctctttcagaggagacaacctggccagcttctcctccagcgttgatatacacctttgttccctaggctgggtaccagatgagctagccagcttgagtttagaataagcaatatgtatctttacatgctcagttcagcaagatgctatcagtgtgacaagaagatgggaactatacgcctagggaagtgacaggattacaaggactgggacaaatgctcaggcagtgtgtggagaatggcatcctccaccacacctaaactccctccctctccactgtcacacagttcacttcggtagttatttgttggtgaaatgcacacaggatgcatactgtgtcctctggcatccatatagcaatgggctcctccagaacaatccataacatggtggcttcacactgcctgcctgttggcttgttgtcaccaccccagtgctcaagaaaggaatactaaatgccatagcaaattcaaaactctgctgaaccctgacaactaggaaggtttgtattaggattaataaaacaatgatcaaaaatcttgatactagtacaactctgactcatttactgtttgatgccttgaatatttaataggtatcttgatgttgctcaaaacaaagcccttgattttcccatcagcctccttttctctccacaaacctattgagtcctacaaaactcctgcccctgccccctccttgccttcccagctccgtgtacagcattaccatttttcaaggggttctagtagctgctgtagagccatccttgactttctgctctcactcctgcatctaatccttcaacataaggatccttctatattggtatcacatccaaagcataacctgaatctgtccacctcttcctacctccactgattctactgagcgcaagcttccactgcctctaccttggacagctgcaagaaccctctatctgcctgcttccattcctgtgccagcaactcagaggcctttcctgaccctgatctaaaggaacaaccccactcccagccactccatgaattcagcatgttatcttctcagcactttatgctacccagaagtatcttgtttatatgttctctctcctcgttagaacttaattccattagattaggatctttcttaaagcctggttctataaaatctctaaatctgattctcccacttcttggggctataaaattagagagatattcatcattgctttgacatgggccctaatagtatttgatgaatgaatacatttttattttattacagtttatgtgttcaatgagaaaaaagtacctgattaaatctctgggcgttttccagaattttcctttcttccttcagacagctgtaaatgatcatagacatctggattgggtcttcctgaaaattatcctagatttgagtggttagaacaaaaataaattaaaatgcagaatgtttactttattgtgtattgtaagttgatatgaatttgtttatattctccgggaaacctcatctctcatctattaaattctatataagctatgtttgttaaaatcaaaatatttctttcacgaattatgacaaaaattgctttaactttctaagtgcaggtacctaacgtactttttgatttaaaaacaagtattttcacatatggttcacataatatttttactttaatatctttccatatttcttaaggccaattatctttggttaggatcccgagacaatgcaaatgatataaaaactatacatgacattcctcaatgaatgcatctgttggtctaagctttgaactagaccaaagatattcatctagggttttctgttgccattgtcaaagctagtttgcaaaacactaccaatagcaataatggctctttatacaggtacattcatgcaaggtctgtatgagaacaaatttctgtaaagttaatttgatttccccactcgtaaataaaatcataaatacattcacaaaggaaaaaaaacaacttccaattacctaagctgaaaagttcagttgtattgtatgaaagaagaaaatgatagctttcacctccattaaaacagaaaagttctgttattacacaacataaatatgatagccaccccaagggcatgctgggagtacatctgaagaacccctaaaactctatagcatgttctctcatgtctggatctttctttgactttctcttccaggagaggccaactccaccagaagcaaggcaaggtggagtctagttcctgaagtcacctgacttccttaggtgaaagtcaaacctttcctgttttattcctcatttgcatagcaaggacctgaacctaaccactaatgttccctggagctttaatgtattactatagatcattgctcttaaaatgtagccccttttctttggtttaaatattgacaatttttagtaaaacaaaattatagcatcacatttttctcaggattactgatacctaagaggtgatacatttaaccctaaaaattccttctgtgtttataaaataaattggtatcttattttacttatgctatatttactgatgctgtagaaaacataaatggagttagtctctattacttctctaaataccaataagtgtgtgctcaattgtatttgctgaatgaagaaaactgccttccataaacatgagaacatttcaactaaaatacaaaaaccaggtcatacctgaagattacgcttgcttttccttatgttatgctgtagcaagaagttattctccaaagaaaagcgactatattgatcatccagctgtgacaggaggtcatgaaaacggatggtggcaaatgaaacatcattggcagcgtgctccctaggagatttaacatttacacatttcattctagaactaaatgtctatgtaaaacagacaaaacaaatgttggtttccttattgaaattattaaaaataatttaagtattttcttaggtttattttcttcttttgaaactgacattgcttttagcagcagtttatgtggtatttctcttatgtgcaattagcacaaaaaattctaaactctaagagattgtgcatgacagtgttcatggtgactatctctgaagggggaaaagtcaacaggggacccttcactttctatgtcaaatactttcaggacgtttttaaattagcaaataataaattttaaagtagaacacctatcagttaaaaaaaatccccttaattttactaccttcttcatatttctaatcaatgtttaaccattaatttggctttatttcttttaaattacttctttctatagtctggatcctaagttggaaaataatcggtgtcagtattccgtaacttgtccaaagcatttaggaatatctatcataaattaaatttggcaaaactgtataaaagtgcttaatgactaatatacttaactttgttgagacactttttggctcaactttgttgagtcattttttaaatcaacaaacttttctacaacaaataattccagtggccattgatggaattcatcttccagtaaacatggccccaagtcacttaatcaaccagtacttttaaggtgtaaacttcttcttctgtctagtgaattttccttaccagtcttgcttttctaaccactgtgccaggtactgtctgatttccatgggaaaactgtcatcataaagctggtgaacctgctccaggaattttgagtcaagctgctgaagttcgtaccactgagacatcctatagggaaaaagaatatacattctttctatgtatatggaaaccatagctccaaagaaagccttcctagcatcaggttgtactcttaaatatcttgcttaatccaaaacatagtttgtcccaggaatattttatttaaatggcatttatagtctaaagcctgtttttaattgagtttggggatgaactttttttctcctccacgaaacacatcttcatgtctttgcttattgtcaacatatcagggcagccttctctggcctcttttatttaaactgcaaccacctcccaccctggaaacatgctctctcttttccctggtttatttttcttcatagtacttacaccaccatctgacctaccacatattttattttcattattgtctgttttcaccacttgaagggatggatgttggtggaggattctgtgcactggtgtatccctagaacaatgtcaaccacatagtaggtatccaataaatatgcctttaaaatgagtttgtgattttatcaaataaatacatgaaaaacattattttaattagacttgctttaagacaaatcacaagactctcccaaaattgctctcctacaaatcacagtacatttgtaatttaactcaaatattttcaaacttctgttttatatttatgattcatatggtaaaattcattatttttcttatacacatttaaaaagatatattttcttctttgcctactacaaacaataaatctggcataaagaagtaatgatttttaaagattaaaacatcattaaatgtaatttaaaaggataaagtaacacttagctttttggataactgttaagtccatttttacatagtgatcctaaagattcaaaatcacaacaaaaacttgatataagcaagtcctaaaattcattaggaaaacggagagtctcccatgaccatcatgtaacttaggatttatatcagcacacaggtggcaatatgcagagcagacacaagtgaatcttgtcctgccagacctctggggaaggagtctggattttcaagtagggcatggaagagtgtgtatgcatacttgtagccgagcacatgtatgcaggcatgaggtcacgcctactccacaaatgtccttccaaaggagtgtgaggaaatgtctggcctataaagctagttatcctcatatataccagtagaaacggacccaagcccagccccttggcactcctgctgaagcaatttgatttttcagttcagttttattttacctgagtggaaaaatctgtggctgtctccctccctgcttggtaactaataaggatctacctaaagcagatatgctggaccgtcaggcaatgggagctgcaacgcctcttattagccaagcgaacccaggtaacttactcccctatcaacaaggtgtgtgtgtgtgtgtttagtagacaggaacttgctctgtcatccaggttggagcgcagtggcagtggagcgcagttcactgcagcctccaacccctggactagagcaatcctcccacctcagcctcccaaggagctcagactgcaagtgatatggtttggctctatgcccccacccaaatcttacctcgaattgtaatataattcccatgtgttaagggcgggaccagtggaggtaactgaatcatgggggcagtctcccccatgctgttctcgtgataatgagtgagcctcatgacatctgatggttttataagccactggcatttcccctgcttgcatctattctctctcctgctgccccgtgaagagatgccttctgccatgcagaactgtgagtcaattaaacctcttcactttataaattacctagtctcgggcagttctttatagcagcatgagaacagactaatacaataaacacgagccaagaagcctggctaatttttaaattttctgtagagacagcctctcgttatgtttctgaggctggtctcaaacacctgacctcaggcaatccttccacctcagcctcccaaagtgctgggattacaggcgtgagcttccgcaccctgccacagttggttcttaaggctggttgagctagtacatatgtagcacctggcacagaagaggtgaattaataagctcatgtttgggctggccaggtggctcacgcctgtaatcccagcactttcggaggccaaggtgggcggattgcctgagctccggagttcaagaccagcctgggcaacatggtgaaaccttgtctctactaaaatacaaaaaaaaattagcagggcatggtggtgtgcacctgtagtcccaactactcgtgaggctgaggcaggggaattgcttgaacccaggaggcggaggttgcagtgagctgagatcgcgccactgtactccagcctgggagacagagagagactctgtctctaaaaaaaaaaaacaatgaataaataagctcatgttcacaaatctggagtcagtctcatctactcacaaaacctgttaccaactcagggagtggcatggccatctcccagtcactgagctcaaatctcagatttagggttgattccttccactccatcccaagacctgctccttcctgtctccaacattctaccttcccagtccagcctctgctgcccacagattggaccacatcaatctcctgtgcaaaaatcctatgatctgtccattcctaggcagatttccaccccaccccatcttcatccatcaacaaagcaacccagtcaccaaatcatttactgtttttcaactgtgcccaacatttctgctttgctccagctactcgcccttggaaacagcctctccacaaatttttgcgtctctaaatcctatagcattcaaagctatgtacaaaagccccttctttcataaagttgtctgagacttactcacaattaagctttctttgacttgcgtctcactgaattctgtacctctattagagcatcggttccagttttccttgtaaagctctgtgatgcctccagagtccccggcgggggaaggtgggtggggagggggtagagtagtggggtattttgctttttaacatcttatggaccttggacagtgccctgcatatactatgtgctcgaaacagtttgttgaattgaaattatgtatatttcagacggaattagaaagtaaaaagcaaaccatattatgatctcacaagtgtgagtccagcatcctcattaagcaatggttgcacaatggactgtgctggaggctcaagtcctgtttctgttctatgaaaataactccttatctatacaaacaacattcaaagcacaatcaaccacacctctgcatacctaccacagaactcttcagtaccggccagaaatttttttaagactatattattttggggtggggggtctgcaaaaactaaacatcacttttaaactctaggaagacattaagcccttccatctttgaacatagaaacataattaagattccgaagtcatgtactcattcatctgattccatgaacatttactgacctgccaccttgtgccccaacaagggcctggggattcaaccaaaggagcagctacgcacagcacgttaggtgccaagactgtcgaggttatatacacagagtgcgaacgttaacctagacagctctcgaggatggcatacagcaaatgaaactttctgcgaaaagaagaaaacgtgactgatggaaaggggtggaaacgggagaaagtgacggtaaatgggaaggtgcagtgccttctagaggaaaattatatttcacaagtcctcttcactgccagagcacgactggcaaggacaatcgtgctgagcagtgccatctccgagaacaggtggcactgctcgcacttggaatactcaggacgcgttcttcctctgggatcactattcgcgggtcagcacagacggcccgtcctcgcccggcgtccaactgcacggcccgaggactctgtccctgcgcgtcccacccccggcacccggaacctcacggccactcactctgcgcgcaggatccggaagggctaggcgggggcgcggcggtgcagcctctcccgagcgcgctgggtcgcctctgctcggtctggggtctgccaggcgcgatccccccggtgcagccgagcccctccgcagactctgcgcaggaaagcgaaactacccggcaggagaaaaggcagcgctggcgcccggcccccttccgcccccaccaatcaccgggcggctccgcgctcagc

SEQ ID NO: 2049 - DNA, 18656 bp, Homo sapiens
ttccagatcagcacaaagtttattagccatttctgctcagaagagcccctttctgaacaggactgttcctctgacataacagacaagaaacagccacctgtgcagggcctttcctttatatctcaagctacatcaggagaacatcttggagcaatgtcagttgccccctggggttccctgggaatagctaaggtgtgagattgtccagagtcctatgacagaccttcaaggttttaagttccacagacttggactttgtccaggtccacaaccaacgaatagaaaccttcctttcaggtaaacaacatattgtacaaaaaagggaggatgataacataatagagaaagagctaagacccattgcttctcctctgtaaaaacaccaaactttatccaatactataaaaaagaaattcctgctgggaacagtggctcacgcctgtaatcccagcactctgggaggccgaggtggacagatcacttgaggtcaggagttcgagaccagcctgaccaacatggagaaaccccgtctctactaaaaatacaaaattagctgggcatggtggtgcagatctgtaatcccagctactggggaggctgaggcaggagagtcacttgaacccggaaggcggaggttgcagtgagccgagatcacaccattgcactccagcctggacaacaagagagaaactccatctcaaaaaaaaaaaaaaaaaaatcctggccaagcacagtggctcatgcctataatcccagcactttgggaggccaaggcgtgaggatcacttgagcccagttcaagaccagcctgggcaatatagcaagaccctgtctttaaaaaaaaaaaatagggcatggtggcgcatgccatggtgctagctacccaggaggctgaggtaggaggattgcttgaacccaggaggttgaggctgcagtgagctgtgattgcaccattgcactctagcctgggcaacagagtgagaccctgtttaaaaaaaaaaaaatccccagcaatcctaccatccccagcctccaggagtgatctgtctcctaagcattgagaaagtggagactaggtagcataaactagtgtgcaaagcttcacactcacattagattggcaggatcattttatgggggaggaacaggtacagccagcttaggggcagagtaggggaggagactggtaagaaaaagaggtctacttcctatccatccctttcttcagggtagagtttcacatggtaggctaaggcagaaagctctcaacccctgcaggaaaagaagaaattcagggcttgagccaggagtaaaggaaagaagaaagcaagttatcctagacatgaaggaatggaagaaagaaatggagtcctatcctgtgtctgtgctccccaccaagggccaatgccagtatgcaccagtttagcctaaccaactattaaaatgttgaaatccttccatactggaaagaagccactgccctgagccctccaagtacctgtcaactgccctggcctgcccccaggacccctatacctcccagcacagcaggcagcctccaggatcctatttagacctatggctcagcatctgttctgattcattgttgtcccctctgtacccatgttatgctttcacctctcaccccaatggagtcacacaggcctgagtttgaacagttaacacagcttggaagggacacatgcctgattcccatccttggagaacaatatcatgctatgaggagtaggaagggcaagagatatgaaaagaacagaggaaatgtggttcctagaagtcagaaggcatcaagggtccatcagtgtagaagtggctggggcgggagacgtaaacctcatccacggtgttctggccagccaacagtgggtcaccattcggcatgatttcttcaatctttacacagtttctgaagactaggtaatccagagagaaaagtgaggccccgatcttagttaggagttcccaacccagcagggaaagggagggaggatggcaggaaaggcctgggaagagcctgagtgggaacttgtgggatgaaagagcagggaggtgggggaaggcatgtgtaattcctaaaaaaaggaatcacagaatggacctctctccaatgaggagcttggagttcagctttttctgtaatgggagagggagaagaggtaggaaagggaatgtgtgccatcttccatagctccatctcatcacttactttccattggctcagtgttcaaatgtctcagatcacagggcaaatctggctctggcactggctgtgatacaggtccttggtctggctctggcactgtttgtgataccatgcatagtgtgggctctatcacaggctccagagtggactccagcacagactctagctctggccccagatccagccctgccttcagcagtggctctaagtccaggctgagctctggctctggcaccagccctagttccagctctaatgactccagctctggctctggcttaagctccagcggttgttgcagttcatccacctgtctggatacccaaagacagacaaaggggcagggctcagtggttcaaatgaaatcaggaatggtagaataagcagaagctagtctaagaaggcagtagggcggagggctaaagagcatgggtttggaatcaggcctcctggagtttgaatcctggctgggggaccttaggcaagtggcctaacttttctgagcctcagatttatcatctataaatgagaacaatacctagtaattcttgagaggcagtagggtggttaaaatcagggctacggaatctaacagacctgtatcattagccacgtaccttaggtacaaaacttgactactctaaatccagttccttagctgaaaacagtaacagtgtttacttcacaggactattttgtagattcaataaaatgagaaaataaatgcaaaccatttagcctagtgcctggcgcataataaactctcaggccaggcatggtggctcacacctgtaatccaagcactttgggaggctgaggcgggcagatcacttgaggccaggagctcatgaccagcctggccaacatggtgaaaccctgtttctactaaaaatacaaaagttaggccgggtgcagaggctcacgcctgtaatcccagcactttgggaggccaaggtgggcggatcatgaggtcaggagtttgagaccagcctggccaatatggtaaaaccctgtctctactaaaaatacaaaaattagccaggtgtggtggttgtgcgcgcttgtagtcccagctactcaggaggctgaggcaggagaattgcttgagcctgggaggcagaggttgcagtgagctgagatcgtgccactgcactccagcctgggcaacagggcgagactctgtctcaaaaaaaaaacaaaaattaaccaggcatgggtggcgctcgcctgtaatcccagctactcagtaggctgaggcaggagaattgcttgagcctgggaggcagaggttgcagtgagctgaaattgcaccactgcactccagcccgggcaatgagagtgagactgtctcaaaaaaaaaaaaaaaaaaaaaaaaaattctatccccagccaagtgccatggctcattcctacaatcccggcaatttgggaggccaaggcaggagactgcttgaggccaggagttcaagaccagcctgggcaacacagtgataccccatccctacaaaaaatttaaaaaattagctgagtgtgattgagtgtgatggcgtgtgcctgtagtctcagctacttgggaggctgaggcaggagcattgcttcaacccctaggtcaaggctgcagtgagtcatgattataccactgcactccagcctggataacagagaccctgtctcaaaaaaaaaaaaaaaaaaaaaaaaaaaaaatatatatatatgcggggtgtggtggctcacgcctgtaatccctgcattttgggaggccaaggtgggtggattgcttgagtccaggagttcaagaacagcctgggcaacatggtaagaccccatctctacaaaaaatacaaaaaaaattagctgagtttggtgatgcatgcctgtattgcttgagctcaggaggtcgaggctgcagtgagccaggatcacaccactgcactccagcctgggcgacagaacaaaaccctgtctggaaaaaaaaaaagctccatgcttgcatcaagtaggtacccattaacaccagtgattatgatcattattatccagaaacccctgtggagacaacctaaggatggcagcagaaaaatatgagataggagagactagaaccagaaaaaactagagtgggctaggagggagggaaggctggggagactggaatagggcagcttaggagaaggcagaaaggagaggctgtgggaatggcagggcagagcagctgaccatcatcctggtgctccacccaggagaaggtaatgcccccttttgacgattcactgaagcagagccaaaaaggattagggaggatgaatgaagagttcatatctcacctattagagaccacaatgagcctgtgtttcaggtatttcctccgttcctggagattaactgtgaggaacatatacaagaagcagagaagatcagtgggccagacatatagcctgaggttcccctagtgcagatggtcctggcagtctcatccccatagtaaccagcagtatcccatggacgaatcccttaattcctctagatatcagttttcccatgctttaaaggaaggagtgggatctatggatgtctggtagatctctgcaatctagcaatgaagtatgtcaacgattcccacctttctcctggtagtagcacccaaaagcttcatcccgggggattcggggatagaggaagcgcagtgggttttcaggtatattctcctcagtgagcaactggtaatggcggatgatttcagtcagcgggagtgactgcagcacctccttcgtgtacggttgcacagagtagatgagcaccttgtctggagagtgaatgcaggaacaggcgggcttgagggaagaggccgggccttggagctctctgctctggctgcccagtcccaaaccagctgagggattcagttcagagccagggaagccaagggcaggcagaggggcaagaggggagccaggcagaaaggagaggctgtgggaatggcagggcagagcagctgaccatcatcctggtgctccacccaggagcaggtaatgcccccttctgacgattcactgaagcgcagtagaaaggtgccagacatggtcttcttcagcagccggcgctcctggctccgactcacaaagcccatgatgcgtctggagcacagagagcagctgtgagacaccgcccaacaccctgccccaccaggcccctgcctccctgctccccttgtatggagaaacagcccaggtttggaatccaggctttggaccaagccctgccacttagcttttttttatcttttacaagtcacttcactttgctgacaatagccaccttccgagggtttgaagtacgaagattcagtgagatcacacagatgaacagcacttttttttttttctgggagacagggtgtcattctgtcacccaggctggagaatagtggcatgatcacagctcactgccacctcgacctcccgggctcaagcaatcttcccacctctcagcctccagagtagctgggaccacaggtgcacaccaccatgcctggctaacttttgtatttttcgtagagacggggtttcaccacgtggcccagggtagttttgaactcctgggctcaagtgatctgtactcctcagcctcccaaaatgctaggattacaggcatgagcaaccacgcctggccacaaatagcacttttttttggttttgttttgagacagagtcttgctctgtcacccaggctggagtgcaatggcacgatcttggctcactgtaaccttctctcctgggttcaagcgattctcctgcctcagcctcctgagtagctgggattacaggcgcccaccaccacacccggctaatttttgtatttttaatagagatggggtttcgccatgttggccaggctggtctcaaactcctgacctcaggtgatccacccacctcggcctcccaaaatgctgggattacaggcgtgagccatcgtgcctggtcatgaatagcacttttaaaagccaaatgctacacaagttggtaggcagtgtggtggaaagagcatgggcttggagtcacataggcctggatttgaatatcaactgtgtcccttgggtaagttctttaacttctctgaaactcagtttcctcacatgaaatgaagctggcaaaacccaccactcagcatggttgtaaggatgagatgagagaattaatgaagagcacccatcaagctctggaatgtaggagatgcttcacaaacactgtttatggctattattggttgtttttttttttttttttttgagacggagtcttgctcgtcacccaggctggagggcagtgacgcaatctcggctcactgcaagctccatctcccaggttcacgccattttcctgcctcagcctcctgagtagctgggactacaggtgtctgccaccacgcccggctaattttttgtatttttagtagagacggggtttcaccgtgttagccaggatggtctcgatctcctgacctcatgatccgcccgcctcggcctcccaaagtgctgggattacaggtgtgagccaccacacccggccttattattgttaacaaatgtgaggagacgtggcctgcacctgtctttgctctctctccctgcttgccacgtgagggtgcagagactccactctcaagcccggaaagcacaagcccatgagggaagggtgaccaaggccttacccatcattccagagatccttcaggtggtcatgtaccaactccagaattttgtccagccatgtccagaatggtaacttgccaggagggctctctcgctggaggaggaatggaaaggtagcaaaagctgaggagttgcctctggtgtagggaaggagggacgtgggaaggccagtatttggaatgtgggctagatccagcagctccacaggattcagggagttaccttagtgaagtcagcccaggacaataatggatcctcagtcctacagttctgccctgtgggacagatagccacagacagatgatgagggaagccaggggtcctgggatagataggacagagggacagaaaagactaaggctggggaaaggctgagagaaaaggaaatctgtaccgaacagcttgtttctcagcatgctcagctggtctgagttgaggcctcggccaacataggaggagaactgccaactgagagcagggcccagcaagctccagggggccttgggggggttggagaagaactgctggttctgcaggggtgggagcagtgtaggctggctcagaagcaacctatcacaccaagcttccacacccctcctctcgcgccttgacctgtcggccccactcccctacctgaaggtttgggctgagcaaattgaaccagagaactgaagcccaggcaattgagagctggttcatgttggaaataatcaccacagggagggtgtccgtctggggagaagacaggagtcacagagagggatgtgatgtttctagctgcaggtatttgttagaggaaaggagtgctaacccaccccaagaggcttctgtttatccccttcttatgccttcttccaaagctgctttctctctccttgccctccattttcactcactttcagctcctgcttcagaccctggtaggtatatttgaccgtgaagctgatgatgtgcagttcctctgtcacacctagtggcccctgggacagccaaagacatagtcatcagaaggctctttggcaagctccccctgcctcgagtcctctgtccagatctcaccttattgctgccctttcctgaaccacctgaacgttgctccaccagagtctgtgaattgaagggaaggagagaaaatgccagagtgggcaccctagtgtccctggaacccctgtttggcttcaagacctctcaagccctgggaacttcccccaacccctgttcctttggactaaaagcaggccagctatggtggctcatgcctgtgatcccagcactttgggaggctgaggcgggtggatcacctgaggtcaggagttcgagaccagcccgaccaatatggtgaaaccctatctctactaaaaatacaaaaattagccgggcatggtggtgtgtgcctatagtctcagctactcaggaggctgagacagaagaattgcttgaacccgggaggcggaggttgctgtgagccaagatggcaccactgcactccagcctgggggacagagtgagactccgtctcaaaaaaataaaaatagtaataaaagcataggtcacaaactattcttaccaggtaaccaaagtcccaaatcaaaccctgactctgccccttctcgggggtcaaagttttctggtttgaagtcagaatgttgaacttccggaagctgttccaggaggaagatacatggagacaaggaatggaattattctaaaaactcagcagaaaaaaaaaaacagaagttccacttcatttcagatctcgccatctccctttgtccatatcccaaatccccctcttccttgtttgtgccaccagggctgccgaatgtggttctgcaggtcatacactgtacagatgtttgcagtgtccttgtcaagcacctacccttgtaattgaggaggattcctgaaaagaaataaatttaaaaaaatcattgggcaaaagagtatggaagttaggagtttcgtctttgggatcagacagacctcggttcaaacccgacttgagctcactagctatgtggccttgagaagagatgtaatcagtctctctaagcctgtatctttgtttgtacagtgcactggtaatagtttattcatggggttggtgtgacaattaaatgagtagctgacatgctgcatgtcacaaagtaagtgttcaacaaaagaaatgaattataatttctgtgaggtaggattggaaggaggaaggagatagccctagggccctgttgtgaagagtgagtatctcctccaccccagcagcccgtgtcctggccacccttcacctgctccaatttacctgtcaatggagacttccacagtcagtgactcattgccttcctggagtctcaccagcagcctgggggaaggaagggggataggggaaagtggtcaacctcaaccttccggatagactagatgtttgaaaaagagaagagggattataagaggtagggagattgcagggaaagagaagaaaaagccaagagtgggaagagctgtaaagccagaaaatacacagtggcagggttggaaaaaggaagtgggaatgagttctggaatgccaaccttgttcggacggtgaacttgctgccagtcttgaggatgaggggtcgatggggagtttggggcatgcagggctgggtttctaccacaaaggctctgaggagagagaggtgtggagagaatatatagctcagtatctgtaagaatggcttcccttgttccttctttcccccagggttcctgcctggcctctagacctgtggagcagacgctgtagcaactctgtgacctgggcgttgcgtaggtccacccctttggtcagagggtcatcctgatagctaaccaggcaactcagtcccttcagctccttcagcagctgcctcaggtgaaacaacagctttgctccagctgtgaacctgggtgataaaattcaggaagaaggaatccatgagtttcctggattcccccatccaggttccaagatctctctgtaaatatgtgaagagtcagaaactgactggggggaagaaaaaaaaagaatccaggaagcatataaaggattattcaacatgattcataatccaagaaatgaaaatcaaagctattttcacatataaaactgctaatagatttaacataacagttttcatatgctatgtacaacttatattaagccctttccacatattaatgcatttaatcctcaaaacaaccctctgaggcaggtactattattttccccacattacagatgataaaactgaggcacagaaaggttaagtgacttgcttaaggtcatacaactagtaagggatgaagcttgtatgtgatcccaggcagtctcattgtacaactcacactttgttttttttttttagacagtctcactctcttgtcatccaggctggagtgcaatggtgtgatcttggctcactgcaacctccacctcctggattcaagagattctcctgccttggcctcccgagtagctgggattacaggtatgtgccaccacgcccggctaacttatatatatatatttttagtagagacggggttttgccatgttggccaagctggtcttgaactcctgacctcaggtgatccgcccaccttggcctcccaaagtgctgggattacaggtgtgagccactgcacccagccccaactcacatttttaactactgtactttactgtctctataattaaaaataataataatcagcaatgtggtgacaggaaaacaaccatacactacacatgagaaaatagattcgattgggacaactattctgggaaacatttgtaactatcttttttttttttttttttttttggtgggggtgggggtgggggtggtttctggcaaaaacctgaaagcctgctagacaaatcctaaaagagctgtaacacttggaactatcttttaaaaagcctcgccagctgacatggtggctcacacctgtaatctcagcactttgggaagcaaaggtgggcagatcacttaaggccaggcactccagcctgggagacagagagagaccctgtctcaatcaatcaatcaatcaatcaatcaatgcatgcatgcatgcatgctggtcctgtaccataagtactatatgcctgtttttcaatctacctgagcaattgtggtatttttttaatctactttttttttttttaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatcttttttttttttttttgagacggagtctcgctctgtcacccaggctggagtacagtggcatgatcacagctcactgcaacctctgcctcccgagttcaagtgattttcctgccttagcctcctgagtagctgggaatacaggcatgcgccaccacacctggcaaatttttgtatttttagtagagatggggtttcaccacattggccaggctggtcttgaactcctgacctcaagtgatccacccaccttggcctcccacagtgctggccacatgtgtgagccactgtgtccggacatgcctaattaaaaaacaaattttttttttttgtagagatggggtcttgttatgtttcccgggctggtctcaaaccccaagactgaagtgatcctcctgcctcagccttccaaagtactaggataacaggcatgagacgccatgcctggcctggtatatttctaaaagactaaattataataaatttttaaatgagaaaatattgaaaacagtaggtatttttcaagtatgttggaggacacactagtgatttttctacaacacaatataattaccataaaatatagcgtttcctggaaaaaggtaacaagaaattgaaaataacctaaatagctgaaaataggagttcattaattaaattatgttaccaccatataggggactgttgtgtggacataagaaataacatggataaatataatatactgttggccgggcatggtggctcacgcctgtaatcccagcactttgggagcccaagttgggtggatcacctgaagtcaggagtttgagaccagcctggccaacatggagaaacatcgtctctactaaaaatacaaaaaaactagccaggcatggtggtgtgtgcctgtaatcccagcaactcgggaggctgagacaggagaattgcttgaacctgggagttggaagttgcagtgagctgagatcgtgccactgcgctccagcctgggcaacagagagagactccgtctcaaaaaaaaaaaaaaaaaaaaaatatatatatatatatatatatataaaaaatactgttaagcttaaaaaaaaccccatggatttcaaaatagtatggacaatatgattccatttttgtttaataagctaggtaataggtaattttctcttcctccttccttccttcctttcttgtcattgtattcgttgcagtaaaaaaaaaaatacatatatatatatttctgggtgattaaaaaagaaggaaaaaccagattgtgggttaattcattcctttccctgaaggagactgggctctgggctccctgcgtggtgaggatgaggagcagaatagagctgcagtcagcagggagcagggctcattctggggagcagagacaaatagagaacagtatctcttgctatatgcagggcactgcaacttacaaatcacagcgcatggcgaggacgagggttggggtggtacctctcaccatgtctccagctgttccaacccgtggtcaatgggagctctgatgcaggctttttgctgctgggccttccactcctccaactttggcagcagtagctcgattagggtagttaatcggcctagcagtgctttggaggcatccagcacctcctgggaaagagataatgtgagtgttgagcatctctccctttcaccctccaccacccaactggggatgaagaaacaaagaagccagcgctagaggaccagggtccccacatccctcatttttccaggtccttgttgcccacatgttctgtcctctgtctcccacctttctccttttgtccagttcattgagagtttcctgcagaatcttctgctctttggtctgatgggggtccagagagggtgtcttccctggatggtgggaacaggagtcagtccaggggttctttcctctccttcctgactggggtctcagtcagagtcaggaaggaggaattttgtggaggaagaaagggaaaccaagcaaagcacaggcacctgtgggaccctcaggcaaattctgaatggtcatgcttggaccagacaccccctcaaataaaacactgttagttttccatgcatttcctcaacatttactgtctctcagctgcacctccagctcagcctccacaaagcacttccagctttgcacggcagcaggactgtagtcagtggggtgtgtctgacagtgactactgctcatcggagctttctcctgttcacttccagctccggcttctcagcaggcacttatctttctccagcccctcaatgtgcttcctacctttggcctggatcttatatcggaagcagaagacatcctgctggtctttcagttggctgatggattttaccagcttctgcagaggggagaggaccccgatgaggctgcttctcagggaggtgttaggctgaacgctgtcaaccctaactcctaccacatctactaacctccatcatagcccttaaatccaggatccgggattcaatctcatgttgctggctctccacaggtgtttcgagaactggctctccttgttcctgaaaaaagaggctctgagcacgttttaactctggcctttcatgccttaagttcaggcctgaaattataccacaggatgtcggggggatcctgttctgagacaactccctgagtcctttccatggttcctctctacttcaggagtttccaacattaccactgaattgtcctcaccaattgggccctctgagcctggatcaaaattcttttttcttccagaaggaggttaaagatcatctcagccaactgggtaggatcctgggaaaagggctagaataggtaaacagaaaggattgatccaattcaaccactctcaatgacctattgccctagaccctccccaccaatgtccacagtatttcctcctccttcggggttcttagccctttgtcttttcaccatagcatcctcccaacagtgtcacgtatatgcaacccttctctctgctagtgattccccaagtccagactctgtcctcctttccccacatttgttcccgtctccctttccacctccaggtactattctattctccaaaccttactcctctatgctcagctcccagtgctaccccatcactcccaaccgttccaagtacctgaatgtcccggcagaatttccgcaaattgtgctgcagcaacaaggactctgggtcctggctgcaacggccacactcatagttcagctgatccaagaagtggaagaatagcatggtagccttggaatcatcactcccaagtgcagcttcctgcctgggcaccaggaataagaagtattagtgtctctgcagtgttactgtagtcctgaggctttccaaccccttcctgccattaatgattccaggatcccgggggcccagaagtaaggaaccacctttttcattcccccaacttcctgaaggcctcaccagttctggtcttcaatccagacagccaagtactgtcgaatgtccacaggcaggaggctgtgcgagtaaagctggtgcagctgatcctgaaaggggctgtcaagattctgcagcatttcccactgcgccatttgggctctgcgtcagaaggatgagggttcccaattggatattttgctggactaaatcatccatagtttcatgattgttcattattactaatttaaaatgtttaaattatacaagtaataaaaatacagaaaacattaaaatatatgttgatcctactgctaatcttggttctttcccctcctctccagaagtaaccactgctatcagtttggtgcatattcttccagggagtgctaccagttgagtatctgctattccaagcattttggatttcagatttgtccagattttggaatatctgcattacttaccagtcgagcatccctaatccaaaactctgaaatctgaaatggtccaaaatctaactttttgagcacccacatgacactcaaaggaaatgctcactggagcattttggagccaaatttttcagattaggaatgcctaatctgtattttttttttttttttttttttttttttaagatggactctcactcttttgcctgggccggagtgaagtggcatgatcttggctcattgcaaccaccatccccctggttcaagtgattcttctgcctcagcctcctgagtagctgggattacaggcacccaccaccacgcccagctaatttttgtatattttttagtagagatggggttttgccatgttggccaggctggtctcaaactcctgacctcaggtgatccacctacttcggactcccaaagtactaggattacaggcatgagccactgtggtcccaacctgtattttttttttcttcagatggagtctcgatctgttgcccaggctggagtgcagtggtgtgattttggctcactgcaagctccgcctcccgggctcatgccattctcctgcctcagcctcccgagtagctgggactataggctcccgccaccatgcccggctgatttttttttttgtatttttagtagagatggggtttcaccgtgttagccaggatggtctcgatctcctgaactcgtgatctgcctacctcggccttccaaagtgctgggattacaggcgtgagccgctgtgcccagccggccccaacctgtattttaatagcttcaataagtgggcctttgtgctttaatgggaattttctttctttttttttttttttttttgagacagggtctcacttggtcacccaggctggagtgcagtggcatgatcttggctcactgcagctttgacctctcaggttcaagccattctctgcctcagcccctcaaggagctgggactacaggagtgtgccatcatgccagctaattttttgtagagatgggattttgccatgttgcccaggcagatctcaaactcctgagctcaagtaatccgcctgcctcagccttccaaaatgccgggattaacaggcatgagccaccataaccagcctaatggtaattttcaaatacacactagagtagagtgaatagtacaaggatcaccatccagctttaacaaacattactatttccacaatcttatttcatctatctccctaattcatttattttgcatttatgtgtgtgtttgttatttatatttgattgtgctaaagcatttaaagatcagtgttgatgttaagtatttattacagcatgatccctgctggctctgaagcttttttttttctttttttttttttctttttttgagatggagtcttgctctgtcacccaggctggagtgcagtgacacgatctcggctcactgcaaactctgcctcccgagttgaagggattctcctgcctcagcctcccgactagctgggattacaggcgcccactaccatgcccagctaatttttgtatttttagtagagatggggtttcaccatattgtccaggctggtctggaacttctgacctcaggtgatctgcccaccttggcctcccaaagtgctgggattacaggggtgaaccaccatgcccggccacctgaagcttttttaggagccaaatctttttggtggtcaggtaagtacaccatataaactgccctccatataggaaggaggagctccattctagaagacatctaaatgctgtgcaatgggtggctcaatcccaagaatatgacacgtttatgacctgtgaatcttgaatatgattataggttatcaactttgtgagatcctgaaacttcacttaaaattgttgcctgtaatcccagctactcaagaggctgaggcaggagaatggcttgtacccaggaggcaggggttgcagtaagcagagatcacatcactacactccagcctgggtgacaaagcaagactctgtctcaaaagaacaacaaattggtttttgcctgtcaccaagcaggctgtcccatgcatctttctccccactgttccctgctcactgccagctggtgtctatttaggaaactgaaacttatgcttgttgcagcctgagcctaacagaacagaattcatgcatatttgtggtctaaaaaggtcacatgattttattacaaaataaagagaaatgcttggggtgggagagtcttctactaacatgaataacatcagctgcctttctacctccagcaggaacaagggaagggagggattgggcaggggctattttcattttaactcttttagtagtgcttgatttttaaaactatgtatctgtattgcttttatgataccaaaaaaaagttaaaaaaatgatcaggtggccaggcatgatggctcatgcctgtaatcccagcactttgtgaggcccacaagacgagaggatggcttgagcccaggagtttgagaccaagcttgagcaacatagtgagattccatctccaaaaaaaaattaatgatgaggtcccaattcttgaggatttaagtgtctgatattaaaggagcaagtcagcaaagattcaaatatgaaaacaaaacaaaaaacctggtctccccaaatggattgcaaacactgaggttaagggctgaaacaattttttctcattatctctcattcttaggcacatattttgcactcaagaagcttttctgaaatgaactgaattttgtgtgtgaccttaggcaatcgtttcatctttcagtagcttatactttttaacaaaacaaggataatagatttatctatctttgtttttagatttatctatctttgaacatcgttttttggtgaagataaaaaataatgcagagcagagggaaaaacgtcagataccgaaccaacataacaatgccagattccgggtctcggaagctgcagggcagttttgggagaggggcattagggttagggagataggctggacagaagaagatcgaggaccgagcaggcgacagctcctatttcaatctggggaccgaagctaccctctccagggggtaacccctggggccagtcgcccttccctcggaggaactctcactctcacccccacccctaccccagcacaccctctcagggcccgtacctgattagggttgcagtccccgcgccctccaatggctctggtcgcgacttcccgtccctagtatgagctcgggtactagaacctcgcgccccgcctacaacttcggctaacccccctcggacccgcccccttgtagttggcagcggaagtccggagcggcccccattcccagccgccaccccgacactggctgcca

SEQ ID NO: 2050 - DNA, 18656 bp, Homo sapiens; identical to SEQ ID NO: 2049

SEQ ID NO: 2051 - DNA, 75171 bp, Homo sapiens
acggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcagagaccagctaatttgatttaacaaacagaattccacagaaactctgatcagctgaggcaaggtggttttgagttgccaaatccggccatgcctctgagtcagaggcagcccatccagcacgtgctaggtgttcccatacgcacaggagaggcgagctagccagccaaggcgggcaggcggggaggccctctagctgttctgcctcacctgtggggccccagcagggaggagtcaccagcctcagagggaggccaggtatacaccctcatacgagggcagactcaagtttatcagtaagcctttgccctgcatgaactgaatgaagacgccattacaagtgccactggatatcaccaagaaactggctaagaaccatattccctgagctcaaccagacacgtcgctggggccccatagtgtgcatcatgtccaacctgtaactctctccccctcttcttccatgaggtcctgagaccaggattcctaaaacaaacaggatgagggacctttagacacgcaaggagacatgcctctagcaggatcagggggactggggtcgggagggtggggcaggaaggaagccagaatcagaagtatcccagccctgataaggcacccacagaaacaacctagcctctgaaacagcagatcaagtccagggagaaagggagtcaaggttgtaagcaccctctgcccagccttactcactaaaaggccaatacattacaaaggaaaataagtctatttataaaaaaaagtctaaaatgcttagattctccttaaaccttcctatttcaacaccaaaggccaggttgcagcttcagatgtcttaagggtttgacctgaagcccgtttcagggattatataaattaccagcctgaaggaagctgaatgcttaaagcaccaaggaggctgttaactgaagtttcttttttttttttttttttttgagacagagtctcagactgtcgcccaggatggagtgcagtgtgcagtggtgcaattttggctcactgcaacctccgcctctcaggttcaagcgattctcctgcctcagcctcccgagtagctgggactacaggcgcccaccaccacacccagctaattttttgtacttttagtagagacggggtttcaccgtgttagccaggatggtcttgatctcctgaccttatgatccgcctcggcctcccaaagtgctgggattacaggcgtgagccaccatgcccggctgcttaagtttcttaaatacagaaaggctatgctgatacagtgttttttgccctttaattgttattatttcttaatttaaaaagaaacctagggcttagatagtcctatcttctatttggatgtcagcaaggttaaaaagtgcaatgccaggagtatgtagctataggtggcctgtggcatttgcttacagaaacaggcagaaggatgccgcaggcaccaggaggcacttgtctaagaacaacaacaacaataacaaaaagctgctgagaaaggagggcaggggaacaaaacaacacaagacatttcctttttctccctctagccaccccccgccacatcccctgatcatgggtctcagagaacacatccttatttgcatttagataaaagcagatcacccacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactctggagggacagacagggaaaactagttcagttgtccaccctctgcaactggcaggccacgcccccagcccttcagaggacagggcccaggctaccactgctatccaatctcctgccccttaaggcccagggatggtcagaaaagccagatttaccctcctccctggaggaccctgcctcgggaagggtcctttctcattcccaccttaactgattcccagagctccatgtttacagaagctctaaggctgtcctgagatcttctgcccttgatctactgtttaattcaggagccccgagacacacgtggccaccaagcatttgagatttggtttgtccaaactgagctgtgctgtggctgtcaaaagcccactggattttaaaggcttagtatgaaaaaaaagaataaaaaaaggtctcaactttttctttttagtttagttttgtttatttgagatggagtctcactctgtcgcccaggctggagtgcagtggcacgatctctgctcactgcaacctccacctcccaggctcaagcgatcctcccacctcagcttcttgagtagctgggattacaggtatgcgccaccatgcccagctaatttttatattttagagattttggtcagactggtctcgaactcctgacctcaagtgatccacccacctcggcctcccaaagtgctgggattacaggcatgagccactcacccagcctcaactttttctgaaatgttaaattgagagtatgttggatttagtgggttaaataaaatatattgtaaaaattaagttcgtctatttccagtgtggctgctagaagatttatactcacacatgtggcattcataccatctcttttggaaagcaaagctctagaatctcctaccattccgagtgaccagctctcggtgtgtacatgtgagagcatcacacaaaggggaccaacttcccttatagggacaaagtctgtcaaccaaatactcaccaaactgccctcctgctgagggttcagcaccttcaccattatttccaaactgcatcaatgaatctaaagtgcggggggacatcggcaggtcaatggtattgctgcaggtcgttctgtaggaaatggggggcagcaggaggggaaacggggggttgacaagacacaatggaaaaaaaaaaaagaacaaaacacacacacacaagccatcaaactctggtctccaacagaaaaataaaagctcaagctttttaaacacacaaggtcactttgagtactaaacatagcccaggggcttccaacctttggcagattaactctcacccagtgtcccattcccagggataactgaggatattagaaatgaaggcaaaacggggaaaggaagccacttacggtgtcacacagataaacttggtcttcaggtatggggcagcgcctgggaagaagaaaaccagttttcttactgactgtgacttcgcattcagtaagcagagctggaggaagccatctgcctcggcaggactgatttgaaactcactcatcctcatgccaagattgtctggaaagctccatctgcccctcagggttgtctgccctcatttatactatttgatctcccaggcactagcagctgtgaacttcagttctttgcacaaagctgtcctgagctgcagagacttttcagcataaccttttcccacctgaccctagactaatgccaccttgtgtcccttctttccctagattatgtaaaagtttaacagcctccacgtggtctgagcattctattccggcctggtcatatctcttagataacttctctgcatgcaggaaccgagcctgtgtagtctttgcatggtgtccagcctaaataccaatatcaccaagtctttaaagaacatggagactgctaatgcttgtggttccaaagccaaaggttatatctcttattcctaccagcactaatctggcctctaccacatttttggatgagggcatgagtaactttctagttggataaatacgtcaatcaaaaagcaccaaagagaatgtgactttgtaaggcagtacaattgcttcaactagaagaccggagacctgggtccaggtacatcttcaatagctaagagacctggagcaaggcatggtctctctcttttgttgctgttgttcttattgttttgagacagagtctcactctgttgcccaggctcaagtgcagtggcacaatctcggttaccgcaacctcctactcccaggtcaaaacgattctcctgccttaggctcccaagcagctgggactacaggtggcaccaccatgcctggctaatttttgtcttttttttttttgagacggagtcttgctctctttcgcccaggttggagtgcagtagcgccatcttggctctctacaacctctgcctccagggttcaagtgattctccttcatcagcctcctgagtagctggattacaggcatctgccaccatgcctagctaattttttttttgtaattttagtagagatgaggtttcaccatgttggccaggctggtcttgaactcctgacctcaggtgatccatctgcctcaccctcccaaagtgctggattacaagtatgagctatcatgcccagccttggccacaatgcccagcccatattctcttttatgtataaaataagagggagggggaagacaaggtgccaattttctatgagctttgtcatttataattcttgttctacagttagaaatgcgttgacgggaataaaatgaattttagatgctgaatgcttacaccaagaggtcaaggaaccttggggatactggcatgaaatctggggaattcaggtgaacaaaccattgagaaggcatggggcagggtgaggtgggctgagaacagcacggtcataaaacatgaggcttagacagaacctgagggatcagagagcatgatgaccatgtgaaagaaggcactgcagagtggctcttgggctgccatctgagtttactttgggccaagaaactgatcaattcagtgcagaattcaaaggagctactgaggcaagactctagtgtcttataaatccaactgttttggcccagcccttagggagctgacaccctagacagaaaaggatttaattctccagcattcaagatagctgaggccaggcacagtggctcatgcctgtaatccctgcactttgggaggctgaagcaggtggatcacttgaggccaggagttcaagaccagcctcaccaacatggggaaaccctgtctttaatgaaattacaaaaatagctgggcgtggtggcacgcctgtaatcccagctactcaggaggctgagacaggagaatcacttgaacctgggaggcagaggctgaagtgaggtgagatcgcaccactgcactccagcctgggtgacagagtgacagactgtcaaaacaaaacaaaaacaaaaacaaggctgggcactgtggctcacacctataatcccagcactttgggaggcccaggcgggaagatcacttgaggtcaggggttcgagaccagcctggccaacagggtgaaacccggtctctactaaaaatccaaaaattagccaggcatagtggtgcatgtctgtaatcccagctactcaggaggctgaggtatgagaatctcttgaacctgggaggcagaggtttcagtgaagcaagatcgcgccactgcactccagtctggacgatagagcgagactcaggctcaaaaaaaaaaaaaaaaaaaaaaaaaaagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatggagtccctcagggcacactcctctcagcaaggcaaggcaaattactcaagtaattagttcctttctcctgatgagtgcctggcccctgaggaaacgctgacatcgctgggcaggaaaggacctggcctcccagcccacaggaagggcgatggtaatggaggatgcagcctcagactgggaggtgggaccttgaaagcaaaatgagtcaaaaggaccagccgtgggaccccaacgtcctctgcagaaggaacaaagagccgtgtggcaggggctgataaacagatctcccaactgaagcacacatgcaaagggagataggtggcagacaggaagtgagtaactcttacagcaggaacaagactcaggaccccaacaaaggagaaaggcaacggtcaattagctccaactccctcttccaagccccattctgccccatctcaagaaatccctcagaaggaattcctaggaaaaagtgggagggaagttggtaggtttctgtgtgtgtgctatttggacaaaaatagttttttcaacagcaactagggcaaggcgccaaccctaaaggatcacattaaagagcccatcattaggccaggcacagtggctcacgcctgtaatcccagcactttgggaggctgaagtgggcagatcacctgaggtcaggagttcgaggccagcctggccaacatggcgaaaccctttctctacaaaaaatacaaaaatcagctgggcatggtggcacaagcccataatcccagctactcgggaggctgaggcaggagaattgcttgaaccgggaggtggaggttgcagtgagccgagatggtgccactgcactccagcttgggtgatagagcaagacttagtctaaaaaaaaaaaaaaaaaaaaagcccatcattggctttatgattacagaaagttaaatcaaacaaagaatggcaaaccagagactccccatcaagacctgcacaaagaacccagagagtcaaaacagcaagtgctgaaggggaacagacagggctaccccctccacactgaggacagctgcagagattacagttttgtttcgtttttttctttctcttctttgtgtgtgtgtgtgtgtgtgtgtgtagtggggtcttgctatgttgccaggctggtcttgagttcctggcctcaagtgatcctcctgcttcagcctcccaaagtgctaggactgcaggtgtgaacccccatgcccagctgagattacagtatttttaatttctctctcttttttttttttttttttttggtgagtcaaggtcttgctctgtcacccaggctggagtgcagtggtgcgatcatggctcactgcagcctcaacctcctgggcttaagcaatcctcccacctcagcctcccgagtagctaggactacaggcacaaaccaccacacgtggctaatttaaaaaaaattatttttgtatagatagggtctcactatgttgtctaggctgttctcaaactcccaggctcaagtgatcctcccgcctgggcctcccaaagtgctaggactataggcatgagccacttcacccagctaaaataatttatatataacatataagtacatgtcctcttacacattaaaatataccttattttcaatagttgcacactctaaatactaatcccttgcccctccacccagtcactgtcttccccttcaaacgtgatgctcccagctcttctactctagtgtaaaccatactcccatgcagctaataataatttcctccagaaaccctttcttcagaccatctggcacactgacatggttcagttacaggcaaaaagccatatgctgggctgaaatctgggcctcaaaccttctagcatctactaagaagcactgtgccagcagggcatcctgttaactgccctcactttcccttctcgtgtttcaggcatgttttgggggacgtatgtgtattgatcccctctttatttttattttttgacacagtatctcactctatcagccaggctggagtgcggtggcatgatcaccgctcactacagccttgaactccttggctcaggtgatcctcccacctcagcctcccaagtagctacgactacaaatgcgtgccaccacaccgggtaatttttttggattttttgtagagacgaggtttcaccatattgcccaggctgtatcccctctttagactcatgcactctctgtggagcaggaactacactactctaagtgattctgattctcctctcaaatcccatcggtcaccccaacaaaagcactcactacaattctttcccataaggagaaataattatcccccaggttattcaggcatttgcctatctatcctccaaggatcccaaaatttccaacttttcccaaaaattaaatgccaggaacatggaaaatcaacaactacctgggtcagcttcaggatgctcctggctctctggccgacaatactttccgaatgcctcctccttgggaatgtcaggatagagatagaccagtggagacaccaggatattggtagcatccatgatcttatagcccatgatgatttcagcaaatgacatgttgttcagctgctgctttgtgtatggttccacggactggatctgggtcttacctgtcacaggacatgggaaggaaagatcatggaacctacagctaggtcatctcagagaaaactgcccattttttctttcctcgaaggggaaaagacttaagccaccctagtgttgagaccctgaacaccctgttcagtggcctggcactgtggaaatattcaggctggcttctaattaagaagaggctactagttgggtcatagaaaataaacttgaatataactacttgcgtaagatatattaacagggttaagtagaaaaagagatgaagaatacaatttaaattgcaaaattctcaacaaatagtcactggagcaagcaaaacaaagcaaaccaatccttcagctggaaggatttagaagtcacgcaaatgtgttttgcgagtctgagtgaaacagggagtcaaggccatctccacccaccagggggcagtaggtgcttgcaactagaagcagtgatgaggcctcagcagccaccagcaggtggggtgggtgggagcctcccttaccgctgatgtccttctccacccaagtgaaagtgacgcctccttctttgctgctttcactgaatcttagcaggaaggtgcctggaggcttagtgctcaagatggcccgctcccgctccttactgataaagcccatgatgtacctggagccaaggaggaggaacaatgttgttattgctaacagggcatccatcccctgccactggcttgctgagagcaggggacttggttacatctgtgcacactctgtccaacctacccttcgttccaaagggccaggatgtactttttcacaaggtcaatgatattgtccagccagacccagaaggagaagcccttgccagccatgttttcctggagaaaagagtaatgggaaagccaagtctactgccatcccagcccttcccttcctaggggtgcagtgcatcacccaaatcctcaggcccgtctaccttcaggcaggtcctactggccgctggaccaagagttcagggccttcaagccagagccctcaacgacagccgtgcaggtgagcattcccattcccacgagaatttaacaagattgcttactttgcaaaatttagcccatgtgatctgacaccctgaataattcacaccaggtcctgaaggaaagaaaaagagtcaagtagtacattttcagcttggggtcaagaggttatttcttaaaacagaacacacacacattcatcccacaatgggccacaaaataatcagctttcacatctttgaaggtaggcactgttgtgtgtgtgcacatgaggacaaacactatcccatcatttgactcacttgtgttgctgggtagcccagcagggatggagggtgatataacaagtccccctgctcttcccaacctcgggtggtaggctgggaaccaacagcagcactcactaacaagctgacatcgggtgtcagacaggtgtatttggtggcaacagctttattagaacaaagctacttctagcccaggtggcacataaaatattccactaattcttttttaaaaactagcctacgctgggcacagtggctcaagcctgtaatcccagcactttaggaggccgaggtgggcggatcacgaggtgaagagacggagactatcctggccaacatggtaaaaccccgtctctactaaaaatacaaaaattagctgggcgtggtggtgagcacctgtagtctcagctactcgggaggccgaggcagaagaatcgcttgaacccagaaggcggaggttgcagtgagccgagatcacactactgcactccagcctgggcaacagagcaagactcgtctcaaaaaaataaataaataaataaaataagacaaaaaaaaccaactagcctatagtttattaaaaaaatggacagggaatgtcaagcctttagtgccaccttccaacacacacttaaaagatcttctaaagttagatagagtgggtgaatgagacagcaaccaggagaaaagaaatctacctcccacctcaaaaatgatcacctcgactgaaaactgcaaactgtctctgcaccccaactccccaactcccctgtttcctggcaccagcacagcgccttgctcaggaaagaaacatggcctaatgctcagtagacatggcccaaatgaacagccctatgggccggatcccttttctgggcgggtgggcgggagggagaaggggtgaaatgcggacccaagagtttctctgccagtgtagtcagctgctcgatgctcagtcctcgcttggtggtggaggagaactgccagctcaggacctcggccacttgatcccaggttccaattgggggcttggtaaaaaagtttacattctattggaaagaacacatttgcttgtttagatgagggatggtgctcattgtctatactaggtacccctaagtcgcaagagatcccggggcaccaactaaaaggagggggcactaaccttgggattgttggtcagcatgttgtaccacaggatggacgcccaggcatttggcatctgacagatgttggagatcaccacaactggcaaggagtgggtctgcggagggagtggggactgagctggggaggcagaggggctctcacagccttggaaatctcttcacccgcatctcacggggctcagaatgaaaggacatgccataaaccacacctgctgccaactctaggcgaggagtgtgagtgagtcagctcagtgagcactcatagtggaaagaatgcccagcgtggccacacaactcaggctgcagtcggaatataccggtcccttgtaaaacctgacttgctcaaagcttgactcacaatccacagattccccatttttaagaccttggaggcattctccaagacttgaagctgtatcttcacatgaaacagggaggtctcaggaatcaaagaccaggattcctgcttttctaggtatatcttaatttaaaaatcaagaaagttgggaaaggagaatgtcattgccacaattttctgtatactaaacacactggctgctaagactcttatgcccaaactttataaagtcagttctaatttcttttttttttttttgagacggagtctcactctgtcacccaggctggagtgcaatggcacaatctcagctcactgcaacctctgcctcccaggttcaagtgattctcctgcctcagcctcccgagtagctgggattataggcgtccgccaccatacccagctaatttttgtattttagtagagacggggtttcgtcatgttggccaggctggtctcgaactcctgacctcgtgatccacccgcctcagcctcccaaagtgctgggattacaggcgtgagccaccgcgcccggccaatcaatttctaaatagagattttcatatcaagtttgctgaaagctgaatatacacacatcttctaagcattcaagcaagactttattgccagatgggatgccaaggatttttttggagaaaagtaagcaaaaataaacacagtgttaagcaaacagtaatcattccaccttctcttgtaaaaatcccagtggaagtttttgtcctgagtcacccctgtacgtagcctctcaccgattctgctgcagaacttacctctaggtcaatcttgaggccttggtgatacacctcggtctcaaaggtgatcaggtgcagctcctcagtcacaatcagggaagcctacagtaacgagaaggacactcttaggccaggtgtggtggctcatgcctgtaatcccagcactttgggaggccaaggcaggaggattgcctgagcccaggagttcgagaccagtctaagcagcacagcaaaactccatctctgcaaaaaatacaaaaattagctgggtgtggtggtgcacacctatagccccagctactcgagaggctgaggtgggaggatggcttgagcctaggagatggaggctgcagcgagctatgattgtgccactgcactctagctggggtgacagagtgagaccctgtcttaaaaaaaaattaaattaaataaaaaaaaaggctgagcgtgatggctcacacctacaatcccagcattttgggaggccgaggcaggtggatcacatggtcaggagttcgagaccagcctggccaataatttggtgaaaccccgtttctactaagaatacaaaaattagctgggtgtggtagtgggcgcctgtagtcccagctactcaggaggctgaggcaggagaatcgcttgaacccaggaggcagaggatgcagtgagccgagatcacgccactgcactccagcctgggtgacagagtgagactctgtctcaatcaatcagtcaatcaataaaaaagagaaggacacttttcctcagagagaatggcattcagtactaacagccacagccaaggaaagtgacatgccaagcctcaccacaccaagaagggtaagccaccaggtggtcacaaacaaactgccagggacacaacttgctcggcacttactctcttcaacaccaagaacttccaatgctgtgatcctcaacctaatcctttactcagtttgtattataatattacatagatccaattggttatttgtaaaatacgtaaggcacaaagaataacaaaacaatatgaacccaccattcaatttaaggaaaagtccatcactcctaaaattctctgggtgcccttccccaaccccatccccttccctcctccctcagaaataactgctattttgtcttttgggtttatcatttcctagccctttttgtcttgttttgttttgtttttttacagttttaccatatttgtttatctaagcaatgcaggtattgtttagtttgggacatttgtgaaccttacacttatggactccaatgaattcttttgggattcacttttcacttgatgtgaaatgaatccacatggttatgtgtatctgcagtgtattccttttcacagctgcggagtattccattgtgtctataccacaaataatgtattcattctaatgttgatgggtatttatttgggttgcatttagagcttataatcaggctgatgtccactttatatatgtctcctgggacatatatgcaaagatttctctgctattaaatcctgggaatggcaccgttggtttacaggtatgttcatttttatactgccaaattgttttccaaactgactacaacaatgtctcacatcagtacagcaaccttattttaagtaagagttgtcaatgaattctcaaaaattgaattctagtctgggcacagcggctcatgcctgtaatcccagcactttcggaggccgagatgggtggatcacgaggtcaggagttcaagaccagcctgaccaatatggtgaaaccctgtctctactaaaaatgcaaaaattagccaggcgtggtggcatgcacctatcgtcccagctacttgggaggctgagacaggagaatcgcttgaacctaggaggcagaggttgcagtgagctgagatcgcaccactgcaatccgatagaacgagactccgactcaaaaaaaaaaaagaaaaaagaaattaaattataattcatttttaatactatttttctgattataaaagtaatatattcagtttaaaatgcaaatatcacagagacagtctagaatagccatggataccaacagcagcactaatacacatagcactgctggtatattcctccagaatttcttaatatacatatgaatacacataagagtatagtgtatttttaaaacacatatactaataatactattcaaattattttacattttgctttttcttaatatgtcatgtacattttcccatatcattgcatacaggctacttcactctactgtcaagtaaaattccacatttttaaaaaggactgctacattttattttatttatttttttgagacagagtttcactctgttgcccaggctagagtgcagtggcaaaatcttggctcactgcaagctccacctctcaggttcaagcgattctcatgcctcagcctccccagtaactgggactacaggcgtgcaccaccacacccagctaatttttgtatctttagtagagacgggctttcaccatgttggccaggctggtcttgaactcctgacctcaagtgaccagcctgccttggcatcccaaagtacggggtgtgagccagcacgcccagctaggactgctacattttaaagaggaagaattgttcaggggacaaatgtaagaaaaagaacggggcatcacaatttttaaaaatgactgaaaactagccttccgtcacatttacctttttttgtttgtttgtttaaagtttattcttgacaataagaatccaataatctgaatcaatgaaaagcagaaaataagggggataaagaacaagatgggtttttgtttgttcattttattttatgtactcttttcctaagcaagctaatgcaaggtggtcatttattttaaagtttaactcaaatctgttgcttttacaccctctatcccacctcagtgggagagaaaaacagggcactaaaaatggagccaagcagggtcagccgcaggagctggatggggaatttggaaagccccaggcaaggtggaaagctgctttataccacatgggtgtggagaacaactcagcaagggactttccacttctccttaaggaggagccaactcccagatattcacggaaatgttccaagccagagagctccatggcacatggaacttctgttcatgtcactttggcctgaagtgactttttggaataactacagctgaaagaacaggttgatgtttctaattctggggattaagaaggatctttacccctctctccctcaaggaaaacaccccagttgtctttcatccccaacaaaacttacatcacaattggctcggcccccattcccacatctctgctccctcagggtctgtaagaaaagaaaaaggcaggtgtcctgtgaggctctccctagccctctccggcagccagaggccctttgtgaaggggagctcctcccacataccaagtgtttgaattctgcagagaggctgccgttgttggattcttccatgttcatcacttttgtgtttgtgcccagaatgttaaatttccgggatctgaatcacaggggaacaatcaactatgtaggtgaccaagtagccggaggatgaagttaggttaaacggaacaaaaggaagcctctaggctgaacttaccctctgagagctgcaacgtccccagagtctctgtaagaacacagactgttgttaataaaataggctctgtgtttcttcaaaaagcctactttgaccacctgttatttactgtcatgaaaaaacctctgtgctcctgggcatttctttaaactattcagttacagttgatcagcgcaacataacacctctgcgtagcaggcacagttggttgcctccccataggaaggggaacctatgtttcatattgcatatgtacttattaaacctaccaccttcgtcaactcccttatttcattattttccagtgcatcctcatgaaatttccacataattacatcaactaaaaataagaatgcattttatcttttcttttttctttttttttttttgagatagtttcgctcttgttgcccaggctggagtgcaatggtgtgatctcggctcaccacaacctccacctcctgagttcaagtgattctcctgcctcagcctcccgtgtagctgggattacgggcatgcgccaacacacctggctaattttgtatttttagtagagacaaggtttctccatgttggtcgggctggtttcgaactctcgacctcaggtgatctgcccacctcagcctcccaaagtgctgagattacaggcgtgagccaccgcgcccagccacattttctcttttcttttctttttttttttttttgagatggagtctctgtcgcccaggctggagtgcagtggtgtgatcttggctcactgcaaactccacctcccaggttcatgccattctcctgcctcagcctcctgagtagctgggactacaggtgcccgccaccacgcccagctagtttttttgtatttttagtagagacggggtttcaccgtgttacccaggatggtctcgatctcctgacctcgtgatccgcccgcctcggcctcccaaagtgctgggattacaggcatgagccaccgcgcccggcccacattttctcttttctaatgtcgtcaaagggtatatgtattttacatcctgaaaggtattgtgaaattttgcgtattccattatatggtaaagtgtggaacaattaaaaaaaagagatctattctttccacatgctatgtatggaaagaatatataacgacgtttcggtcaacaacaaaatgcatatatgatggtggtcccataagattatcatggagctgaaaaattcctacttcattgagatgtgttacaattgcctacggtattcagcacagtaacatactgtacaggtttacagcctacgaccagtaggctctgccacatagcgtaggtgtgcagtaggttctgccacccaggtttgtgtaaggactatatactctacaacatttgcacaacaaaattgcctaatgatacattttgcagaacgtatcccagtcgttaattaacacatgatctcagtcttatatataatatgcatgaatgacatgtacaagtaaaaaactaaacaaggaaaagagggactggttgtcacaatagcaaccacaaatcaaatctgtacccccagctttgtggctttgttcagacacgtaaatgacaatgcaccccaaggcttttgaaaacttttgtccacaaaatgaagatctctgaataaagacagagtctctagttcaaatgatgtctgtcaaagttctcatttttctattcctcatttgaaaaacagagctaagataggagtacttacttgtcaatgcacactttaattttaagctgataattcaactcagggaatttgaccagcaacctatttaaaaagaaaaaatccaaggaaaaaaagtcagtaactctcccataaccttttcttgaagaaatgtaaaattcataattcttcatttccaacaggtaaataggccaagctgtctataattacaggctcacatctataatctcagcactgtgggaggccaagctgggaggatcccttgagcccaggagttccataacagtctgggcaacaaagtgagagcccacatctataaaaaatttaaaaattagcggggtgtggtagcatgtacctgtagtcgcagttactcgggaggctgaggcaagaggatcacttgtgcccaggagttcaaggctacagtgatctatgatcatgccactgcactctagcctagatgacagagcgagatcctatctctctttctctttttttttttttgagacagtttctctcgttacccaggctggagtgcaatggcgcaatctccgttcaccgcaacctccgcctcctgggttcaagtgattctcctgcctcagcctctcaagtagctgggattacaggcgcgcgccaccacgctcagctaattttgtatttttagtagagacagagtttctccatgttggtcaggatggtctcgaactcccgacctcaggtgatccacccaccttggcctcccaaagtgctgggattacaggcgagagccaccgtgcctggcccctatctctctctttaaaaaaattaaaatagggctgggtgcggtgactcacacctgtaatcccagcactttgggaggccaaggcaggtggatcacaaggtcaggagttcgagaccagcctggccaagatggtgaaaccccgtctctactaaaaatacaaaaatcagccgggcatggtggcaggtacctgtaatcccagctacttgggaggctgaggcaggagaatcacttgaacccaggaggcagaggctgcagtgatccgagatcacacctcagcactctagcctgggtgatagagaaagactccatctcaaaaaaaaaaaaaaaaaaaaaaaggccgagcgtggtggctcacatctgtaatcccagcacttttggaggccggggtgggtggattactgaggtcaggagttttgagaccagcctggccaacatggagaaaccctgtctctactaaaaatacaaaaattagccgggcatggtggagtgtgccggtccagctactcagggaggctaaggcaggagaatcgcttgaacctgggaggtggaggttgcagtgagttgagattgcaacacgcactctggcctggccgaaagagcgagactctgtctcaaaaaaaaaaaaattagccgggtgtggtggcacgcacctctattcccagttactcaggaggctgaggcacaagaatcacttgaacctgggagatggaggttgcagtgagctgagatcatgccactgcacaccagcctgggtgagagtgagaccctgtctcaaacaaaaacaaaagatgagtatcactccttcaagccaaaggtactgagaaaacatctaagaactaacaacttaaagttgtgagagattcacaaaaggataatcaaagccatataatgaaaaatattacaggaacacatgctgtgcagctggcattttgttctattaatcctgaaaccgaacaccatactaagtttctgaggagggaaattttgctgcagaaggtcaaaaccccagcacacctgttctgacttgagtgtgaaagtaacacctcaccctacaggcccaccacccacctgccctggggcctctcagcttccccatcactaagccttactctttcccttaaaatccacagggaagagtagcctcaaagaacagaaaatagatgacattattttgtcccttgggcagaaggagaagctgtggcctgagactccaggtctacaatcataggaatatgcccaggtaccttcaaaaagatgactgctcttttgcttttgacatcagaatcagagagcaagcagatagtatggcaacaaatttcaaccccgcaacagtgtactgcctgtgacaccacacctggaaagaatgaccctggccaccaactctaccctcaccctaacagtgtccctcagtaaaatctctactggaaatggaagtggcatggcctacctgactttagtagtgaactggacgccggtcttgatgacgaggggccggtcaggatgcatgggcatgcagggctgccgctccaccacaaaggcactgaggaaagagaagatgggctcacgcgccacggccatgaccagaagtcagcccgcctctcactctaccacgtgagtctttaggtattttttagatgagggaaagggacaaggatgctaaattaccttttcattaagtttctaaacagctccacgattctctcctccagcatcggccggtgctgtacaatggggtcccctttgtaggaaactttttgctgcaactcctccagtttcttaatttgttgacgggtctgaagttgagattctgctaatgacgttatcctgccaataaattaagaaagatgctaattaccaaagtgaatgtatacaggtgagatggagaaggggaaggaaatactgaagacatggagaccactacaataagaacaaggaatttttttattgtggtgaaatatatatagcatgaaatttacaatttttcatcttaagtttacagttcagtgacattaagaaaagaggaatttttcaccatgttgggtggatgctgaaaaaataaataaaaaaagaaaataatttatttatttatttattttttgagctggagtgcagtggtgcaatctcggctcactgcaacctccatttcccgggttcaagtgattctcctgcctgagcctcctgagagattacaggtgtaagccactgcgcctggcctttttttttttttttttttttttgagatagagtcttactctgttgcccaggctggagtgcagtggcacagtctcagctcactgcaacctccgcctcccaagttcaagtgattctcctgcctcagcctcccaagtagctgggattacaggcacccaccaccactcccggataatttttgcatttttagtagagatgggattttgccttgttggccaggctggtcttgaactcctgacctcaggtgatccatctgcctcgacctcccgaagtactggcattacaggtgtgagccaccatgcctggccagaaaataatttattttaccttttattactagtcccttcctaaaatctcaaatttctaagagggggctgggcacacaagaagtattaaaatttataccactaggaggcattgatggagttatcactggaaaatgacaagcatctgagcccagatatgcagaacacgaaatatggaatttagcacttactttactcatcctaacttgtctatgaacataaagactcagaaaaagagattagacagctcccaaagatgggtttgagccagctctgtcacacactatctgtgcaagctttgccaggcccttcaccatcatgggccttagcatccccttgcatgaagagaagggcttgaactacatgagccctttcttttctttctttctttttttttttttgagacagggtcccactctgtggcctagtgcagtgcaatggcatgatcatagctcactgcctcctccaactcctggacatgagtgatcctcctacctcagcttcctgagtagctagaactataggtgtgtgccaccatgcctgtttagtttagtttagttttttgagatggagtctcactctgtcacccaggctgaagtgtaatggcacatgtctagttttttaaatttttgtagggatgggatctcactttgttgcccaggctggtctcaaactcctgggttcaagtgatcctcccgactctgcctcccaaagcattgggatttacaggcgtgagccacaacacccaatccccataagccttttcaatgtcagccttcaactgatcaaaggacatgacattatgtttcaaaatattgataacatgcacaaggaataagtgaatagagagggagaaaaagctcattaaatctatctccaagaatagagatattaggccaggtgcagtggctgacacctgtaatcccaaaaatttgagaggccgaggcaggtcgatctactaaaatacaaaaaaatagccaggcatggtggcatgggcctgtaatcccagctacttggaaggttgtgactaagaatcgcttgaacctgggaggaggaggttgcagtaagccaagatcatgccactgcactctaacctgggtgacagagtgagactctgtctcaaaaaaattaaaaaaagagagaagttagcatcattccatcattctttgatggtttatcactagtgtaacaaagaccaaaagaccagaaagacagaaagtgaaaggagagggagggggaccgctgcagggatttctgaactcctgagctcttttctggcacttctatcctcccattcccagaacttaagcttcttcgttccctggtcaggaagcatttaaaactgctttcagtaaattaacaacactcagggttagtgaggatatgaatagacaggcattctcatgtagagttgcgctaaatttccagtgcaggctctgtatctcaagtttctcctaaggcaagctggtgcaacatgctcactatagggccttgcacaggaagggttgcagtaagatatgctggatgaaggtaaaagtgcaaattacagaaaagcatataaaggaagatcctgggctgggcacggcagctcacatctataattccagagcttttgagaggccgaagtgggatgatcccttgagcccaggaatttgagaccagcccaggcaacaaagtaagaccctgtctctataaaaaatttaaaaattagccaggtgtggtggtgcatgcctgtagtcccagctactgagaaggctaaggtgggaagactgcctgagcccaggaggtcaaggctccagtgagccatgactgcataactgtactctagactgggtaacacagtgagaccctgactccaaaaaaagaaaaaaaaatgatcctaatataaactgtataaatttctatctttatgtgtatatacataatgtgtatatacataatgacagatgtctagattgagcatcaactaaattttaactactagtactgctgatgatttcatttaaaaattttttcttctcttgattaattttctgtatttgaattttttcccttaaaaagggcatgtgtcattttagattactaaaataactaaaattaaaaggtttgtctatctgttaaatacagttaaaccaaaagccttaattgaattattaagtaaaatatacttaaaatataataatataaatacattttttaaaacaaagtttctccaaataaagtaaaaactttattttatttttatttttttgagatggagtctcactctgtctcccaggctggttggtgtgcggtagtaagatctccgctcactgcaacttccatatcccaggttcaagtgattctcctgcctcagccgcccagagtagctgggactacaggtgcgcaccaccacgcccggctaatttttttatgtttttagtagagatgtgttttcaccatgttggccaggctggtctcaaactcctgacctcaagtgatccgcccatcttggtctcccaaagtgctgggattacaggtgtgagccacagcgcctggccgaaataaagtaaaaactttaattcttgggctaaatttgaatatggaaaagtccccacgttggagatatagtaccaattctgtgggcctgcagttaagatcagaattcaatctagctttcgagaaagaaaggaaaagcttctttcatcctttaccagttttctagccgatctaggcagatgttgggcgggcctccaatgcaggcaatctgttgccgcctcttccagtcagccagctcctcgtccgtgagagttttctgcacgtactccatcgctgacaaaagccccgccagctcactcacgatgctctggttggaaaccaaaacaaagtcagaaaacatttcctcagactgtctctaaccacattctttagtcaactccagagcaggaacttcttagaaaccaagcaagttctgccacaagacgctgaaatcccgcaagtgagcgagacacatgggggaagtggtccgacctatgcccttactctccgcatctggtccagcgcagtgagcatctgttccagctgctgcatcttctgcctggtcactgactggttgtttccattcagatcttgcatgtctgcgaaggaagaaaaaactccttgacctgagggaatactccttgacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactccttgacctgagggaatactcctggacctgagggaatactcctggacctgagggaatactcctgtccttaatgaccaggctcctttgaggacccgtacctcccttgcgccccgcccgccttaagatctaaacagagttaagacaaatgagtctttcaactcaacaacacaaactcactttctagagattttaacatctctaatattcacttgcctccttgactcttgagggttttatagttgaaatcaaagtcatcctggagattctctaccactttcattttctgttctagatcctgtttaaaataagcaaacaaaaaaacagaagtaaagaaagatttccttgggaacagaaaatataaagtttctgaggagaattcaaatgaagccaaaacctcaaaaaagatacatgcaggacctgcaggcagtatccccaagagaaggctccctgttggccaggtgcagtggctcacgcctgtaatgccagcactttgagaggctgagttgggaggatcacttgagcccaggagttcatgatcagcctggacaacacagggagacccccatctctacaaattttttttttttaattagctgggcgtggtggtgcatgcctgtggtcccggctacttgggaggatgaggtaggaggatcgcttgggcctgagaggtcgaggctgcagtgagctgtgatcatgccactgcagcccagcctgagtggcagagcaagaccctgtctcaaaaaaaaaaaaaaaaattaatgaaagctccctgcccgaggcttgtaacttgcatcacctgcactctcttccggacatcctgaaggtgctgctccagcatctgctgcttctccgtcaccacggctgctgtggggtggttggcctggcccccttgctgccaaaaaggaggtcaatgcacatgtgaacacagaactatggggagaggaatacctctacccagcttccatcccaccctaactacccttcttgtttggcttgagacgctgctgccatcacaagaggaagggaaacagaggcagtggtgctgtcactacacaggtgacactacacaggtcataccataaaccccctttatggcactaagagaccacatgttcagctaagacatggtctatgccttcaaaaacctcatgggcaagtatgtcaaaaaattcaaaacaatttatgacagcagatgttggatgtctacttaaacgtggtgtccagtatatttctgagggataataaaaaaaaagtcctgccctagggatgaaattccatattaaaagatattatcttggggagaaggggaggctggtaccttggaaaatgtcaaatagcacatggaaaaagaaaaagaagaaagaaggctggatgtagcagctcacacctataatatcagcacttgggaaggctgaagtgggaggactgcttgaggccaggagttcaaaactagcctagtcaacatagtgaggccccatctcgaatgaataaatgaatgaatgaattaaagaaataacaaaaaataaatagcatatgaaacttaaaaattacaggttcgtgccaggtgcggtggctgatgcctgtaatcccagcactttgggaggccaaggtgggcagattacctgaggtcaggagtttgagaccagcctgaccgacacggagaaacccatctctactaaaaatacaaagttagctgagcttggtggtgcatgcctgtaatcccagctactcgggaggctgaggaaggagaatcgcctgaacccgggaggtggaggttgtggtgagccaagactgcgccatgcactccagcctgagcaacaaaagtgaaactccatctcaaaaaaaaaaaaaaaaaattacaggcttgggctaggcatggtagctcccacctataatcctagcactttgggaaaccaaggcaggaggatcacttgaggctgggagtttgagaccggcccagggaacatagaaagagacctcatctcaaccaaaaaaaaaaaaaaatttttttttaactagctgggcatggtggcatatacctgtagttctagctacttgggaggctgaggtgggaggatcatttaagtccagaagtttgaggccacactacagccagttttatgggcaaccattctcttcctttcccatggtccctatccaagcccacagaatacaaacttcttagaagttttgggaaggtgacccatgcccctacttcttcccacagtgacagtgactcatctgattggtaagatggagagaaagactctgtgtacacacagatcttcaaagaacccagcacctaagctggtgcctccctcctctcactcttgccttcctagggcccaccataagcaagagcagcagcctggtttctagaagcaggtctagaggcctatccctctgccttgttggtctatggcagctgaagctccatatggatggctggggtggggtgggggtgctgctctgcacatccagtctctctaccccaagatctaactcagggcacaggcattggaaagcccctatggttaccagctcaagccacactttccattctagttttaccaacaatacagctgatgttttaaccttcattcctttctcatgtctatttctcaagcaggactacacttaaagggagaaaacatgattaacgatcacccacagaaacccacctctaataccttcgtaaaaaactgtattggctccccactgcttccagctataaacatctcaggccaacacagaaagctgtttcacacaattgataacttcaactttccctccctgtgccttggtcaccccagactcccaactcttccctgcatgcagtgtgtttccacactctcttcccacccgctatccactcagcatggcctgggcttcagcccaaacacacctgaactcactcaccttcaaattcagttcaaatgtttcttttcctgagaaatcttattcaacttccttagacaaaatgacacacatccttttctgtgtttttctcactttgagtgtttgtgtacttataatcccaactagcctgacagcccttggtagcagggattacatccactcttctatctttaaccaattctagacacttaagagcatgccaggtattgtaaacagaaaaaatagcagtgaggcctgggttgaggccacaaataaccaacttatagctttatatcaggggttgcaaactttttctctaagggacagagggtaaatatttttggtttcctgggtcatacagtccctgccacaaatagccctgccactgcagcaccaaagcagccacagataatgcataaataaatgagtgtggctgggttccgaaaaaacctcatttacaaaaacaagcagcaggctggatttgggccacgctcacagtttgcagacccctaatccgtacgattgaaaacatccttgggataactttggctttcctacctcccatggtaagttggagcctctatccaaattgacttaaaccacttatttttatcttgtggagcaggataaaatacaaaggttttccacagcagaaaatcctagtgctgcctgagcaaatgcctgtgtgctaacctcttgggctacagggcactgcacagtaagtgttacctaccacctcgctcacacctgagcatatcagttttctgcttaaaattcctcactagggccggacacagtggcttatgcctgtaatcccagcactttgggaggccgaggtggatggatcacctgaggtcaggagtttgagaccagcctggccaatatggtgaaaccctatctcactaaaaatacaaaaaattagcccagtgtggtggctcatgcctgtaatcccagctacttgggaagctgagacatgagaatcgcttgaacctgagaggcagaggttgcagtgggccgaaatcgcgtcactgcactccggcctgggtgacagagtgagactctgtctcaaaagaaaaaaaaaaaattcttcactgggtccccatttcctacagtaatggtgagggtgatgatagtgatgtcagcagcagcagaaagcagttaaattattttgcatttatgtgtcagatactgttctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctaccaaaaaaaaaaaaaaaaaaaattagctgggcatggtggcatgtgcctgtagtcccagctactcataaggctgaggcaggaggatcgctagggcccaggtggttgaggctgcagtgagctgtgatcacaccactgcactccagcctgggtgacagagtgagactgtctcaaaaaaaaaaaaaaaaaacaaaggttacaaaggtaaatttgaaatgtaatgttatgtgtatttcaccacaattttttaaaaagcagggggtcacggagaaaaagaaaaaatgtccctgattataggatattaaagacggtaaaacccctcacagaaagtaaaaaagtctcctatgaccgactactttaatgatttagtatatgtgtttccagatattttcccatacataccaatagtatatgcaaattgcatacatttagttttactactatgaatcagatctttctttttttttttttttttttttcagtcggagtctcgctctgtcgcccaggagtgcagtggcgcaatcttggttcactacaacctccgcctcccaggttcaagcgattctcctgccccagcttcccgagtagctgggactacaggcgcgtaccaccacacccagctaatttttgtatttttagtagagatggggtttcatcatgttggccaggatggtctcaatctcttgacctcatgatctgcccaccttggcctcccaaagtgcttggattacaggcgtgagacatcgtgcctggcccagatctttactttcattacatcttctaacaggttactgctgctactgattaggggaactgcagattctaaaaatatttatcttgtatacaatggcctttctaaaccttgctagttccaattgttattgttagttttgtttctcttggatcttcgaggaagacctatctatctgtaaataataagagttctgtcccttgctttccaatatttgtaccctcatttctttttctttttgcataggctggatccctcagaaaagtatcaatggtaaaagacatccttatcttttgctgtttttactgagaatagtgtttcaccactgtgcatcatgctccctttggtttctgataaatattctttcttgtgtttagaaagatccttaattaagccaggtgcggttgctcacgcctgtaatcccagcactttgggaggccgaggcgggcggatcacgaggtcaagagatcgagaccatcctggctaacacagtgaaaccccatctctactaaaaacacaaaaaattagctgggtgtggtggcgcgcgcctgtagtcccagctacttgggaggctgaggcaggggaatagcttgaacctgggaggcagaagttgcagtgagctgagatcacgccactgcactccagcctggcaacagagcaagactctgtctcaaaaaaaaaaaaaaggctgggcgtggtggctcatgcctataatcccagcactttgggaggctgtggccggtggatcatgaagtcaggagatcaagaccatcctgcctaacaaggtgaaaccccatctctactaaaaaaaatacaaaaaattagccaggcttggtggcacacacctgtagtcccagctagtcgggaggctgaggcaagagaatcgcttgaacctgggaggcggaggttgcagtgagctaagatggcaccactgcactccagcctggacgacagagagagactctgtctcaaaaaaaaaaaaaaagagagatgaggtctcgctacattgccccagctggtctcgaactcctgaggctcaggcaatctgcccgtctcagcctcccaaagtgctgggattacaggcgtgagctactacacctggctgttttttaggttttgatatgaggatttttccagcctcataaaataagctgaaaacatcccttgttttcctatactttggaaaagtttgaatgatattggaataatctgtactatgaaagtttgtcagaacaggccgggcacagtggctcacgcctgtaatcccagcactgtgggaggctgaggcgggcggatcacctgaggtcaggagttcgagaccagcctgaccaacatgaagaaaccccgtctctactaaaaatacaaaattagctgggtgtggtggcacacgcctataatcccagctactcttgaggctgaggcaggagaatcacttgaaccctggaggtggaggttgcagtgagccaagatcgcgccattgcactctagcctgggtaacaagagcaaaactctgtctcagaaaaaaaaaaaaagaaaaacaaagaaaatttgtcagaacaaaacaaaacttttaaaccattgggtctgttggattcttttggtggaactttcttttttttagagtttttcaatgtattttggggggtggaactttctttttttttagagtttttcaatgtatttttatgattattgatctatttaatttcttttccttcttttttagtagatctaataatttatctcattataaagttgtttgattttccattcctcccagaccagggatttgttttgtctcaggtctcacctgggccgcagtggctgcagtctgtagaaggcgtgattcttcccacaggcaccgggccacaatccgggcaatctccattggcttctcaagatacctgctctataagtaggagagaaagagaataaaaatcagcagcagaccatggagatgtggactgaactgtggcaccttaaaactaatgtattcatcaaggaaagcatttattctaggaaacaacggaacaaaggcttcagagcctgggtgaaggctctctgtcggcggggggcgaaggggaggtcgttactatttctgtaacagaaggcacattagcctgagtcttttttttttttttttgagactggctctcactctgtccgccaggctggagtgcagtggcgcaatcacggcttattgcagcttcgacctcccaggctcaaacaattttctcacctcagccttctgagtagctgggactacaggtgcatgccaccacaatcagctagtttttaaaaaaaatttctgtagagatggtgtcttgttatgttgcccaagctggtctcaaaactcccaggctcaagcaatcctcccacctcaacctcctaaggtgttgggattacaggcgtgagccaccatgcctggccttgtctgagtctttacacagtatactatcctggtcttgcagggaagctactgacttagtcaagaagtatcccattatggtcaaacatttaacatgtaacagtgagagtcatcttcctatcagtggaccgcgttaacatgctaacatgtatgattaacataacaatcactttattacttcaactgtgacaagagaagtgattctcaggtaatgatgctcacgggtaagtatacagagctttgagaaagggctaattacttctcctgtgattgaaaatacaagatagattctcgttacttagccaaatgagaaaagagatgcttccaggaaagaacactaacacccgactctgcgggtcctgtttctccttgtcctcagtttctcatcatacctgaagaaactgcttgattcttcgtagattgtgctgatagagaacattcgactcttgcaggaagcggctatactgctggtcaatctctcccaggagattatgaaacaccaaagtggcatgtgattctttgctggccgcatatgccctaggaaaaggaagaatgataaagaatggctctgaagccgacgcatacacacaaacacagaaatcaccatcaagaaagaggaaaaaaacaaaaaaacaaagcaaacctgatgctataacccattcatcatgttagattcttcttgctcagcaataaaatgccatcaatgtaataattattaacaattattccaggccaggcatggtggctcatgcctgtaatcccagcactttgggaggctgaggcaggcggatcacctgaggtcaggagttccagaccaacctggccaacatggtgaaacgctgtctctactaaaaataaaaaattagccaggtgtggtggtgggcacctgtaatcccagctactcgggaggctgaggcgggagaatcgcttgaatccaagaggcagaggtgcagtgagccgagactgtaccactgcactccagcctgggctacagccagactccatctcaaaaaaaaaaaaaaaaaaaccacaaaacaaaaaaacaattattccagatattattacccactctcataatctgttgtatttgtaaaatatttgagcaaagtagacagatatgctgttttgctttaaaccctcaattaactctggtcagatttattagtacaaataagtaatcccaggctgggatggcctatctccaacatctgtgaatcacctcctggcccttcaccaaatcagagtatgcattctggaaaaaccaggtcatattaacactggcctgaattaaaccaaaatcagtagtgagcctgagcatattaaagtgaagaaaatagttgctggacatctgtgccattatctgctctatgaatggaatctacttcccttatcctgtgatctagtttggatctacatccctgcccaaatctcatactgaaatgtaacccccactgtttgaggtggggcctggtggaaggtgactggatcatgggggtgggtttctcatgaatggtttaataccatccctgttgatactgtcctcgagacagtgagttcttgtgagatctgatagtttaaaagtgtgtggcacctcccccttgctctcttgctcttgctgtggccatgtgacctgcctgctccctctctgccttccgccatgattggaagcttgctgaggcctccccagcagcagatgctgctatgcttcctatatagcctgcagaactatgagccgattaaacctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgcccttctaagataaaaaaggctttacaagaccaaagggtgcccctttatctcctgatctcattttccccatcacctgtacccatacattttttaatggaacagcaaggcatgacattaagagttcatgtctcttgactcaaactgaaacctaacaatttggagagtcacttaagaaggacttaccaatcttgactctcaatccaaggggccagaaactgccgcagctccattgggaagctgtcactgtagagctgatggagctgctccaggtaccgtgtgtcaagctgctgtagctgattccattgggccatcctgctaaaatcaggggtcccaactgtaaaccaaagtgtgcatatgttcaccacaagtcccagtaggggtaaacaatctagaagtagccattgcccaacacaggtgtcaggtctgtgactagggataaagatgctctggggaggaccctgcttctttctcccagtttattttatttttaaaaaatagagatggggtctctattttttgcctgttgcccagggtggccttgaactcctggactcaagtgatcctcccaccttggcctcccaaagtgctgagattacaggcataagccaacacacccagcctgtttctcccagtttagaacaatacaaacacattcacaatccccaccttgggataatcacagctcctttttattattttttgaagacagagtcttgctctgtggcccaggctagagtgcaatggcatgatcatgggctcaagagatcctcccacctcagcctcccgaggagctgggactataggcacacaacaccatgccacactcattttttaaaaaatgtttcgtgagacaaacaaaacatgcccaggctggtcttgaactcctgggctcaagtcatcctcctgcctcggcttcccaaagtgctgggattacatatgtgagccaccccatctggccacacatctcttttacactgggatgacaagtggctattatgccaggttctagaatccattatctaccagaagtgtgtgaaattaaaaaattacttaactcccagatttctattcccttgtctataaaatagagataataattcccactcctcagaggtattgagatattcctacagcatccagctcagtgcatggcacataacagatgcccaacaaatgtcggttcctttctttctcctccacagcccttttagttatacacagtaaacctgtactgtagccaaaatgtagaaattggatgtttggggttgggggacagagcactaattccaagactacaggtttaaaagtataaatgaggatccaggaagatctgcctgagattctcctactcaacaaataataactattttaaaaattgcttagtctgggacaacagagaaggaaagaaaaatgccaggcataaaagttgtcccaggttcaggaacatcccagtgaaatgctctggtatgagaaacccagccagctaattacctgtaatcctctttctgaatagcatgggtcatggaaatatcaatagaggccaagttgttttaacaagttctaaaattaggccaggcgcagtggcttacgcctgtaatcccagcactttgggaggccaaggcgggcagatcacctgaggtcgggagtttgagaccagcctgaccaacttggagaaaccctgtctctactaaaaacacaaaattagccaggcgtggtggcacatgcctgtaattacagctactcaagaggttgaggcaggagaattgcttgaacctggaaggcagaggttgaggtgagctgagatcgtgccactgcattccagtctggcaactagagcaaaactctgtctccaaaaaaaaaaaaagagaagttctaaaaataattacaagtcagagccaaagatgaaggtatgtacagaccaaggtccaatgagatggttctctgggatagtgagaacatttaatgagagactgaacacacgcaaacatactagagttcttgattctcagagaaggcacgaagaagcacctagttagcactggctttttcataaaaatgactgagcaaactggcaacaaaaccagcaggtcttctgttctcaaggcagcaaatgtaacggaatgaaaggtgcgatcgtggaacctctaactcctgcaacctctaactcctgggctcaggcaatcctcctacctcagcctcccaagcagctgggagtacaggcagcattgctgcacctggctaatttttttaaaaaaatttttgtagagatagggtcttcactgtgttgcccaggctggtctcgaactcctgggcttaagcaatcctcctgcctcaacctcccaaagtgctgggattacaggcgtaagctaccacgcctggcctgggatcaggttttctgacagaacctgagagggctgcacttctccctccctctttgggggacagactcagaatacccctcttgctactgtgaagacggctggtggagctctcaagcatatattcagggaagtgcaggtagtacctcccagcagtctttacattgaataattaataatctaaggcagcagcatccaacagaaatagaatacaggccacacatgcattttaaattttctggtagccatacttaaaaagttaaaagaggctgggtgcagtggctcacgcctgtaatcccagaactttgggaggccaaggcaggcggatcatgaggtcaggagatcgagaccatcctggccaatatggtgaaaccccgtctctactaaaaatacaaaaattagctgggtgtggtggcacatgcctttaatcccagctactagggaggctgaggcagaagaatcgcttgaacccaggaggaggaggttgcagtgagccgagatcgtgccactgcactccagcctgatgacatagcgagactccatctcaaaaaaaaaaaaaaaaaagaaaagaaaagaaacaggtgaaattaattttaatgtattttatttcatttaatatatccaaaatgttattgcaacatatgaacatacaaaacatattattatttatttatttattttttggagacaggcactctgtcacccaggctggagtgcagtggttcaatcacagctcactgtagcctcaacttcccagctcaaacgatcctcccacctcagcctctcaagtaactgggactacagatgcgcaccacatctggctgattatttttgtagagacggggtcctactgtgttgcccaggctggtctcaaactcctagactcatgcatctcagcctcccaatgtgccaagagtataggcttgagccaccgtgtccagcccacaaaaactattaatgagatactttacactcttttttttgctacgaagttttctaaatctcctgtgtactttacatgtgcagcacagctccaaggtattttccctcctcatgtatcaagggcttaaattccactggtgaaaaagctcagtaaagcaaatagagagaatgtcagaataaggtatttgccccaattaggccaatacgcttctataaattaactaaatattccaacaatgttattttgttgttattgtttttgagatggaatcgcctaggctggagtgcagtggtgcaatctcacctcactgcaacttcagtctcccgggttcaagcgattttcctgcctcagcctcccaagtagctgggattataggcacgcaccaccatgcccagctaatttttttttttgtattttttagtagacagggttttaccatgttgcctaggctggtcttgaactcttatcagttcaagaccagtctggccaacacagtgagatcctgcttataattaattaatttaaaaatgtaggctgggcacggtggctcacacctgtaatcccagaactttgggaggccgaggcgggtggatcacgaggtcaggagttcgagaccagcctggccaacatagtgaaaccccgtctctactaaaaatacaaaaattagccgagcatggtggtggccgtctgtaatcccagctactcaggaggctgaggcaggagaatcacttgaacccgggaggtggaggttgtagtgagccgagatcgcaccactgcactccagcctgggcaatacagcaagactccctctcaaaaaaaagcaatgttacttgccaccttccaccctaagattcacctgccacaggacaaatgctgcctgggcagtggtacaggtacactaagcactagccagagtaaaagcagtggctgacgtgcatactatatgctgaagcattgtaaccatggcatgtattgattgccctctgtaagaaatcaaaggccattagatctctcttacaatatttgcattagggccaagttaaaatctgcctcacatggaggttgcagtgagccaagattgtgcatctacactccagcctgggtgaccaagtgagactctgtctcaaaaaaaaaaaaaaaaaaatctgcctcatagactaaaagcatcatgacctgacttatgctatgcaagaactgatgtgcatacaaagaaatctgcataatatgccaatttatgtagattctattgcatacaaatttactgaaactctaaacctacacagtccagtatggagtcactagccacatgtggctactgagcacttgaaatgtggctgcttcaaactgaactatgctgtcaatataaaatacacactggattttgaggacttagtgaaaaacaaaagaatgtaaagtatcttgttcatgttgaaatgataatattttagatatattgggttaaataaaatatattattaaaattaacttcacccatttctttttacttcttttaatatggctactagaaaacttaacattggtagggcatggtggctcatgcctgtaatcccagcacttagggaggccaaagcatgtggatcacccgaggtcaggagtttgagaccagactggccaacatggcaaagctccatctctactaaaaatacaaaaattagctgggtatggtggcacatgcctgtagtcccagctactcgggaggctgaggcaggagaattgcttgaacccgggaggcggaggttgcagtgggccgagatcgtgccactgcactccagcctgggcaacagagtgagactgcatatcaaaaaaaaaaaaaagaaagaaagaaagaaagaagagaaaagaaaagaaaagaaaaagaaactaaaagaaaacttaacattacatatgtgacttggatcttatttttattgaacactgctactctagacaatgtagccaaaaagcggtggttctcctaaaaaaaaatgatttaaaaaaagaaccaactgctttttgtaataaactccagtgtttaaaattaattttaaaaacagactttattttttgagacagggtctctctctgtcacccaggctggagtgcagtggcaaatatagatcactgtaacctccaactcctgggctcaagcaatcctcctaactcagggacctgagtagctgggactaggggcacaagccacaatgttcagctaattttttgtagtttttgtagagacaaggtctcattttgttgcccagactgatcttgaactcctggcctcaagcgatcctcccacctcagcctcccaaagtgctgggactgcaggcatgaggcatcatgcccagccaaaaatagactatttaattatttgtcttggatacaaatgcagaggcatcacagtctactccctgaaggtccaaattaaatcatgaaacagcatcccactatacctgctccatcatagattaacactggggtcatgcatgaatatttgcattttcaaactaacatatcctaaaaacgtgtaagttattgaaaattatctaattcatttccagtacataactaaggattttttggttgttgctgttcttatttttagctggggacagaggagggctagtaagtagtacaataattgtgttcttttttttttttttttttttgagatgaaatactgtcacccgggctggtgtgcagtggggcgatcttggctcactgcagcctccacctcccaggttcaagcgattctcctgcctcagcctcccgagtagctgggactacaggcatgccccaccacgcccggctaatttttgtatttttagtagagacggggtttcactatgttggccaggctggtctcaaactcctgacctcgtgatccgcccgcctcggcctcccaaactgctgggagtacaagcgcaagtcatggcacccggcctgtgttatttcttaaaacagaaaccagctagtagttttttccataaaattaaagcaccaggctgggcacagtggctaacacctataatcccagcactttgggaggctgaggtgggcggatcacaaggtcaggagtttgagaccagcctagccaatatagtgaaaccctgtctctactaaaaattcaaaaattagccaggcgtggtggtgggcgcctgtagtctcagctacttgggaggctgaggcaggagaatcgcttgaacctgggaggcagaggttgcagtgagccaagatcgtgccattgcactccagcctgggcaacagagtgagactctgtctcaaaaaaaaaaaaaagaaggcaccagggcaccaacaatgactgatttcatgttttacttcttagtctaatcaccataggtaatactttaatagttattctacaggggaaaataaaagtataacttaaagccaaagaccaggtagtattttcaaggagagaatatgcaaatacttccatagtcttctccttacaggctgcttagctacaaaccatatttaattaacagcagtcacaggagatgactagccaaagtgtctaggaaaatcactgccaagcagctttactgtaactgttttactggaaaagacctcaaagagcccatgttatttcacaatttcaattttggtttttcaaattacaagttaatctaaagaactccactaagttctaactacattacttcatatctacggaataattctaagcctgtgggtttttaaaaaaattttattagacattctagaattgggcaacacttcattcaatgccataggatgaatgttctccccaagcctgtgacttaataactacttcattgagccccagaacacacaaagttatctgaggaacaacttgagtgccaactaccactctgggtgcataagagagaagacaattcattactccatataggctgccttaggacattatatggggctcaattcaaagcatttactcaggttaagtcagcagatagtagatgcactgtacaaaggcaaggtgggtgtaatcctgttttctataactgaagagaaaagaaaaaaatgaaacagcaagtcatcaaagactttttggacttttcaaaacaggaatttctcagtcccttggggataacctaccaacagcaagtcataaaacaaataactattgtctaattgggaacttattaccgtaaagatgactgaaaaagtctgtccaaagttacagttctcatttatatacttgaatctaatgaaaccaaaagatatattgagaaacgcagtcaagaccacttacaaaagggatttactacacagcttcataaaactttttaaagttaagacttgtacttcacatccatgcactagtggatttacaacgagggtgagggaaggcggaaagagagacgaaaatcaggctcatacaataatccagaacagaaagtgatctaaagataacttctgttccactttgcaatgtgtcatgacattttcctttgggtaccacctatacttttattataaatacatgcattttaaatagagcatacctgtgttttatctgctgcctacactaacctcttctttgctgtcaggaaaggcccagtgatcaaggcaaccaaagtataaagaaacacagaagatttcttgcactgaattctataggaaccagtccttttaagagatatgtttgaaagattataaaataatgttcaatgtggaaaatttagaaaaatataaaaaagaaaataaaagataaaaacatccatatcccaccatcccactatgcagaacaaaaactgacatgttgccaggtgtggtggtctgtgaccccagcactttgggaggctgaggggggaggatcacttgaggccaggaagtcaaggctgcagtgagctgtgattgcaccactgtactccagcttgggtgacacagcgagaccctgtctccgaaaaaataaaaattgacatgttgatgtaattcctttaaatctatttcagaatgtgtttgtgtgtgtgtatatatatatatatatttttttttttttacattggagtcatagcattaatacagctgcatattcttttaaagtttattgtgtagtaaacatttttctatgaaaagagtattgtgtttgtttgtttgtttgttcaaatagagaccagctgcccaagctggtctcaaactcctggtctcaagcgaccctcctgttttggcctcccaaagtgctgggattacaggcgtgagccacagtacctggcctgaaaagagatgttttgttattgttgttgttgttgtttgagacagaatctcactctgttgcccaggctagagtgcagtggcaccatctcagctcactgcaacctccatctcctgagttcaagtgattctcatgcctcagcctctggagtagctgggattacaggcatgcgccatcatacccggctaatttttgtatttttagtagagacggcgcttcaccatgttggccaggcttgtcttaaactcctgacctgaggtgatctgcctgcctcagcctcccagggtgctgggattacaggtgtgagccactgcgcctggcctgaaaagaaatttttatttaaagcgcataaaagaactattttgtttctattggtgttttcaatacaaccctgctaatcccactgagggccacataatttattaagatttggaaaccccaatttatttgttctcaccataccacgttctaaaaataatctgaagtatctgcaagtagattaggaaggaaaaaaatgagaaaagtaagagaaagcaattcacgctagagaaaaacattcaatcttcataaaattttcaccacaggataaacagcataatggatgacagagagtccacattaaaatactgtaggccaggtgtggtggctcatgcttgtaatccttgggaggctgaggagggtaggtcacctgaggtcaggagttcgagaccagccaggctaacatggcaaaagcctgtctctactaaaaatacaaaaattagccaggcatggtgaaatacacctgtaatcccagccacttgggaggctgaggcaggagaatcacttgaacccgcgaggcagaggttgcagtgaaccaagatggtgccactacactccagcctgggcgacaagagcgaaactccatctcaaaaaataaattaaataaataaataaataaatactgtagctttaaactattagagtcattcataatttaaccattcataattactctagacattaagaatggaatttcaagtttaaaacataactcaaaataagtacacttatatagtaagcacacaatttcatagttttaagtccaaatagtacctttgtaagatttaagactagatacttgcaataagaagtctatatataaatctagttttgatttcctaaagagacaaaatattaacacttgagtgcccaatctgaaacaaattactataattactgtaatgttcaattacatataacaggatttgctttaaaattaaaaaccaatgacgatcaagcttgtaaaaatgaacatcaatctataagaaaacttgagttatagttccctactaatatgacaaaatttgaatatatgaaagaagtaaaggccaggcatggtggctcatgcctataattctagcactttgagaggccaaggtggaagagggattgcttgagctcaggagttcaagaccagcctgggcaacaccgtgagaccttgcctctacaaaaaaatttttttaaaattagcctagcatggtggcccatgcttgtagtcccatggaggctgaggcaggaggatcacttgagcagattgagactgcagtgagctgtgatcataccactgcgctccagcctgggtgacagagctagaccccatctctaaagaaggagcaagagcttaacaaacctaattccctctaaattaaaagtaacaaacatgatttgtcaattactgagtgcacagttgattgttaaagctgcctaagaacaggtctgagctctacaaaaactaaaactaaaacaagaaaacccacaaaacagaccaaatttgtgcatcagatgacctccccacttgggaacacttccacttccccaaccagacacattcctctgtatcagtgtggtgtgggggaaaggacagtagagacgggagctggatgggcctgggtgcaaaaccctgcctgacatttattagctatttgtctttgggaatggtatttcactaccaaatgggctttctcttcagtaaaacagggaactctctctcctttgaagaactgttgtaaagttaaaatcaataatggttgtacagcatccctctgtgctggtgctgctggtgccagatcctcagagctgcagttattgttcctttcccccagggtctccctttcatggacatttcttactttttttttttttttttttgagatgtagtctcactctgttgcccaggctggaatgcggtgggcacaatctcagctcactgcaagctctgcctcctgggttcacaccattctcttgcctcagcctcccgagtagctgggactccaggcgcccgccaccacacccggctaattttttgtatttttagtaaagagggggtttcatcgtgttagccaggatgatctcaatcacctgacctcgtgatctgcccacctcggcctcccaaagtgctgggattacaggcgtaaagccaccgcacccagccagatatttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataagtaatgattatagctatgatttatatagcactttttacaagaagccaggcgctgttttaaacacttgacatacttatttgctcatttcataattgtaacaaccctatcagataggtactatttttatcccactttacagaggagaaactgaggcacagaattttaagtgatttggccgggtgcggtggctcacgcctgtaatcccaacactttgagaggctgaggcgggtggatcacgaggacaggagatcgagaccatcctggctaacacggtgaaaccccgtctctactaaaaatacaaaaaattagccaggtgtagtggcgggcacctgcagtcccagctacttgggaggctgaggcaggagaatggtgtgaacctgggaggcagagcttgcagtgagccgagatcgcgccactgcactccagcctgggcggcagagcaagactccgtctcaaaaaaaaaaaaaaaaaaaaaagatttttaagtgatttatccaaagtcacaacacaggtagtaaaggcatggagctggaatcataacgcacagtctgttttcggaatgtctgttcttcaccactataggagtcttgttttttcttttttttaaattagagatggcgtctggccatcttgcccaggctggtctcgaactcctaggctcaagcgatcctccagcctcagcctccaaaagtgctgggattacagatgtgacccaccgtacccagctactacaggagtattagaaagtgggaattttggccaggctcagtggctcacgcctgtaatcccagcactttgggaggctgaggcaggtggatcacctgaggtcgggagttcgagaccagcctgaccaacatggaaaaacctcatctctactaaaaatacagaattagctggccatggtggcacatgcctgtaatcccagctactcaggaggctaaggcaggggaattgcttgaacctgggaggcagaggtggcagtgagccaagattgtgtcattgcattccagcctaggcaacaagagcaaaactccatctcaaaaaaaaaaaaagaattttagttgatttttaagtaacccacaaaccaaccattgtaactagccaatgtgatcttatggtattttaatagacatactagtacttggattttgaaggatctagtagtctagctgtaacagacccacatctggatgctattctaattctgtgtatcaaaattgaaatggaacactaaaacaaccaaacacatccagggagggacaaccagggtgtgaggagttgaagaccttgaatattttgctcagcaagaagatgcaggcaacaggagtgaggttaggagagaaaaacatgaattacagaagagtggcccctcaaatacctggaaatctgtacgagaaaggataaatcactctaggactagaacctgtctcctcacaacatcttctcccaaattcttccccatgaagtaatacagaggtctccaccctggctgacactaaaaaatatatacagcaagaaagatgcctgggaaccaaaccagtgccaaattggaacctctgacagtgggaccaggtttcaaatttcgaaagctacggctgggcacggtggctcacacctgtaatcccagcactctggggggcctaggtgggtggatcagctgacgtcaggagttcaaaaccagcctgaccaacactgtgaaagcccacctctactaaaaaatacaaaaacattagcaggcatggtggtggatgcctgtaatttcagctacttgggaggctgaggcaggagaatctcttgaacccgggaggcggaggttgcagtgagctgagatcacgccattgcactccagcctgggcaacaagagcaaaactctgtcaaaaaaaaaaaaaaattcctcagatgatgctaaagtgaggccaaagaataataataaattttttcgtgatcattaataaatataacgagaacctcgaaatcagagcagagatcagggctcaactctgaatacgcctcagaatctcctgaggagctctacaaagccaggtgccagttcttagcccagaactagcaaataataatctccagggttctaatgaagcagtacactgtagagactgtacaaggagaccacggcagaagaggaggctggagaaggctctcctgtcaagatatctgcactttcttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacagccacagcaactcaaaataatactgtaggaaaagcaagtagatatttaaccaaaaagggttcagggtttgtactccagctgaatggtaaaacctgccatcccctcaggaaaagaggcagaggcaagagaaaaatcaggcagaaacatcagagccaaaatgcatagggggccatggcaagagctgttaactgtctcccaacatctgtgtgcttgcctccaggccattttccacactgtgggtagagagaccttttcaagacacaaacttgatcttgccacacccctacttaaaaccctcctgatgactgctctgttcttaggctaaaaaacaagatttgttatcttaaggcagaatagcatggatttgaatcctggttccaccacttcgatcacttagcgtgtagctggtgccagttatttatcctctttgtgccttaatttcctcatctatagaaaggggagagaacagtgcttacctcacagggttgctgtacaaattcatcgagctaatgaacacgtagcactcaggagcccaatagcgtgcagcatgtaagtgtttgtactcattactagcatgaccgacatcctggctggctctgcccctctcgtatggctggtaccagctggtggctaagttcctggcactcactctgctccttcttcaggtcctcaaaaacaccaggctcctgcctgccactggccctcacacatgccttccttctatcaccatcaccatgacttgcacccaagtactgtgactccattaacttggactcataaccactatgctggactgaaagccccatgaagacaagaagagtcttggcttttgctcactagcgtgtcctaccctgaaccctggcatccagcatagtgtctggctcataataggtgctgaaaaaataggtattgaatgaatgaacgactggagtgaattacaactaaagtgtgtagccaggttctcccaagtgaggacactgcgcccaattagaaaatattctgaggaataggccaactcttccagttttgctgtttgaaaaattcaagaatgatcaagaatcactgattcaagaataatccttcagtgattcttcaataagagtaaaatcacagcactccccagctcaaaaacacacactaacatctcattgtccaatgcaaaatctttacccttatctcaggctctgtaactactcagccaactttagccccttccagttcctctctccagcctacagatgactttcattttttgagacagggtcttgctctgttacccaggctggagtgcaataatacgatcacagctcactgcagcctcaacctcctgggctcaagcaaccctcccacctcagcctcctgagtaactgggattacaggcacatgccaccatgtctggataattttcttttttttttttttttggtagagactcagtctcaccatgttgcccaggatggtctcgaactcctgggctcaagttgtcctcctacctcggcctcccaaagtgctgcgattataggcatgagccatggcacccagcctccaggtgactttcataagtgttgtcttccttcaagtcaacttatctcctccttgccccccacccacagactttgttcctttttcatatttgttcttgcctaaaatgcttttttctctgggtggcgttatccatccctttcttgtgtctgtcagacaggctctccctaaccccacccctagtccaatgactgctttcactctgaatccccacggtacatatataagcatctgaggctctttcctattggctttgattctacctccttcacttgaggagcagctctctgctggcaaccacgtaccatcctgatttagaacttcccacaggctaacttaagacaccaaataaacacttgcacacacacataaccaccacctcccattacagaagtacacctcccctactgaacagatgatggccacgatactgaaaagcatggcatcaacatgacaactgcatcctgaaagatcagcctatatataggtttggttatcttgaatttcgagtttggagagaagcaaagtatttttctaataaactgtgaatgctgaggaattcaccttcataggagtcagaaacaggctgccaaacttttcaaaagaaaaacagtggtaggttgagcaagcacattgtcatgtcagattttccaggctcgagggccactgaagggagaagagcgagtagctggaaaaaacctgtgggtactgttatctttggccaaagctcaaataaaagaatcacaaaaacatccactgatctaaaatgctatgtaagtcattaatattcatctaagagaggcaactgaaataaagcagataaagagaacttaagccattctcttacctcagcctcccaagtagctgggattacaggtgcccgccaccacacctggctaatttttgtatttttcgtagagatggagtttcaccattttggccaggttggtctcaaactcctgacctcaagtgatctgcctgccttggcctcccaaagtgttggggttacaggcgtgagccactgcgcctggccaagaatttaaatttctgagtctcaaagtcataaacctataatatggctcaatgcttacctcagtgcttactggagagaaggaagattcttttctcaaatttattcaggtcactttccctatacgaaatactaaggtagtcctggtcacttacatggaacaatatacctggggctgacgatgcttggatatatagaagtccttcagtcaaaggaactatgaacttttgaggcagaacctcaaattcagaaggcatttgtggtggttggataacatggccctaaattctctcattatgccccactctctgagaggagggggtctttgttcccttcctttgaatctagctaagtccataactgttccaaccaatagagcatgctgaaagcggcgagatgtcatttccacctgatttcattggaagtctcattctccagaaccagccacattctgtgagaaacccaaggcaaaaggggaggccacaagtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaagttttttttttttgtttttttttgtttttttttttgagacggagtcttgctctgttgcccaggatggagtgcagtggcgtgatcttggctcactgcaacctccacctcccgggttgaagtgattctcctgcctcaacctcccaagtagctgggactacaggtgcccggtacaacgcctggctaatttttgtattttcagtagagacagggtttcaccatattggccaggctggtctcaaactcctgaccttttgatctgcccaccccagcctcccaaagtgctgggattacaggcatgagccaccgtgcccggcctgttaaagctattttaatagtaaacttattttctctatgcactcctttctaaattattcagccccactttctttcaaaacaacgtttatacactgacaattctcaaatttatgtctctagccccatccgctaatatgaacatcagacacttatagccaactgcctcttcaatatctccacctggatgtctaaaatgcatgtcaaacttaatgtatccaaagccaaccccttcattaaaaacctctcccagccggcttctcctccagtctcccccattctagcaagtgacaactccattcctgcacatgttgaggctaaaaaccttgaaatgagccttaacttcaactccagtctctctctctcttcctccccctcctcctgccacacctaatccattaacaaatcctgttggctctgtcttcaaaatctggaagtgaccgggcacaatggctcaggcctataatcccagcactttaggaggctgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggtgggggtatcacttgagcccaggaggcggaggttgtagtaagctgagattgcaccactgcactccagcctgggagacagagtaagatcctgtctcaaaaaaaaaaaaaaaaaaaaaaaaggaaggtgagcctttctcacaacctcccactgacgcagccttaatccaggccaccagcatctcttacctagatagctggactaggctaactggcctggatgctttcatccttgtccctctaccttctattctccacattacagatcctttcaaaataagagtcctggctggcacggtggctcaaacctgtcatcccagcactttgggaggccaaggcgagcagataaattaaggtcaggagttcgagaccagcctggccaacaaggtgaaatcccgtttctactaaaaatacaaaaattagccaggtgtagtggcaggcgcctgtaatctcagctactcgggaggctgaggcaggagaagttgcttgaaccggggaggcagaggttgcagtgagctgagatcgcgccactgcactccagcctgggtgacacagcgagactccgtctcaaaaaacataaacataaaaataaataaaaaataaaaataaaaacagaaattcgccggcatggtggcccaagcctgtaatcctagctactcgggaggctgaggcaggagcatagcttgaacccaggaagtagatgttgcaatgagccgagattgcgccactgcacttcagcctcggcaacagagcaagattttgtctccaaaaaaaaaaaaaaccagagtcagatcatttcattcccctgctcaaaacccactcaggaaaaaatccaaagtcctaccacggcccaccagtcaatccattttgccccagatgtctctctttgcctccttccctacaactctccccttgctcacagctgtcccctctctgctcctggaacacaccttgcccgtttctgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtaccataggaggttaattcacttcatataacagcataaactgcccttccttaagtaggagacaataggtacaataatgcatgcaaatgttaagtggtaaagcaaacatacaaagtttcccaatagaagagtttaaattaaaatctaaacttccagccaggagcagtagtggacgtctagtcccagctactcaggaggctgaagcaggaagatcacttgagcccaggaattcaaggccagcctgggtaacataggaagaccccatctctaaaaacataaaaataaaaatctaagcctcaaaagaaaaaaaataaataaacaaaaggcatttcctataaagttaaactgttacagaattgtttttcttaaactgcaataatgagactttagcactctcttgtcctctaaaagacattatttcatgacatgtgcccattggcagtatttgagaatctaagaaagtagatcacactaaatattgatatgcagacactaaaatcgtacaaccacttggatgactaggtttgagatattcccaaagtgacaggtttttgttttgttttgttttgttttttgagacaaggtctcgccctgtcgcccaggctggaatgcagtggtgcaatctcagctcactgcaacctctgcctcctgagttcaagcaattctcctgcctcagcctccctggtagctgggactgcaggcatgcaccaccacacctggctaatttttgaatttttagtagagacagggtttctccacgttagccaagctggtctcgaattcctggcctcaagtgctctgcctgcctcagcctcccaatgcaaccagcctttttttttttttttaacttttattttaggtttggggttacacgtgcaagtttgttatataggtaaactcatgtcagaggggtttgttgtacagcttattttgataaaatattaagtattaagcccaatacccaatagttatcttttctgttcctctccctcctcccactctccaccctcaagtaaaccccagtatctgtggtttccttctttgtgttcacaagtccttatcatttagctcccacttataagtgagaacacgtggtcttcggttttctgttcctgcattactttgctaaggataatagcctccagctccatccatgttcctgcaaaaacatgatctcagccgagcacggtggctcacacgtaatcccggcactttgggaggccgaggtgggaggatcatgaggtcaggagttcaagaacagcctgcccaacacggtgaaaccccatctctactagaaatacaaaaattagccaggcatggtggagggcacctgtaatcccagctactcgggaggctgaggcagagaattgcttgaacctgggaggcggaggttgcagtgagctgaaatcgtgccacctgcattccagcctgggcaatagagcaagactccatctcaaaaacaaacaaacaaacaaacaaacaaaaacatgatctcgttgttttttatggctgcatagtattccacagtgtatgtaccacattttctttatccaatttgtcactgatgggcatttaggttgattccatgtctttgctattgtgaatagtgctgcaagtaaatctctttaaacagcaaatctattactgcctgcttttcaatgctttaccctcaagaaacttgggctacaactcaataacaaaaagcagcatttttgttcttgttgtttttaattcagtttcttttttttgttttgttttgtttctaagagacagggtctcactctgtggcccaggctggagtgcagtggcaggatcatagctcactataacctcgaactatcaaactcctgggcctaagtgatcctcccacctcagcctcctgagtagctaggactacaggtacatgctgccaaacccagctaattaaaaaatattttttttttggtgatgaggtctatgttgcccaggctggtctcaaattcctggactcaagcgatcctcctgcctcagcctcccaaaacattgggattatacagatgtaagtcactgcactttggccatgtgttggttttttgttgttgttttttgagacggagtcttgctctgtcgcccagactagagtgcggtggcgagatctcggttcactgtaacctccacctcctggttcaagcgattctcctgcctcgcctcccgagtagctgggattacaggcacccaccaccatgcccagctaactttagtatttttagtagagatggggtttcgccatgttcacctggcctcaagtgatccgcccaccttggcctcccaaagtgctaggattataggcatgagccaccacacccagccttttttttttttgagacagagtcttgctctgtcgtccaggctagagtacagtggcatgatctcggctcactgcaacctccgcctcccaggttcaagcgattctcctgcctcagcctcctgagtagctgggattacaggcgcctgccaccacacctggctaatttttgtatttttagcagagacggggtttcaccatattggccaggctggtctcgaattcctgacctcgggtgatctgcccatctcgggtgatctgcccgcctcggcctcccaaagtgctgggattacaggcgtgagccaccgcgcccagccatcttctcatttctttggtgagattgtttggtttttgcttctgaagattttcctgtttttctttttttgtttttttttttaagagacagaatcctgctctgtcacccaggctgaagtgcagtggcgcgatctcagctcgctgcaacctccgcctcccaagttcaagcatgcaccacctacaggtgtgcaccacaacacccagctaatttttttttttttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagaggtagaaccaacaggatttgctgatgctttgaatgaaagcagagataagacagaacagggaatttaaggatgattcctagatttctggcttgcacaaaggagtagatggtggtctaccatttatttagatggggaagtcagacagggagagaggcacaaacttgcagagagaaaagtttaagagttatattttgggcaagtagacaggagacaactacaagttacttgagggaagatgtcaagtttgcagcaggatgcaggagctgggagcccagagcgactgggtggagggccacacttgctagtcatcacagcggctaacacgtcttcacagtaaaagccaaaacaggcggggcacggtggctcacacctgtaatctcagcactttgggaggctgaggcaggcggatcacctgagaacggggagttcaagaccagcctgaccaacatggagaaacctcgtctctaattaaaaaaaaaaaaaaaattagccaggcgtagtggcgggcgcctataatcccagctactcaggaggctgtggcaggagaatcgcttgaactcaggaggcggaggttgcagtgagccgagattgtgccactgcactccagcctggtcaacaggagcaaaactctgtctcaaaaaaaaaaaaaaaaaaattgaggccaggtgcggtggctcatgcctgtaatcctaacactttgggaagctgaggcaggtggattacctgagctcaggagttcaagaccagcctgggtaacacagtgaaaccccatctctactaaaatacaaaaaaattagcagaacatggtggcgtgcacctgtaatcccagctacttgggaggctgaggcaggagaatcacttgaaactgggaggcggaggctgcagtgagccgagattgcgccattgcactccagccagggcaacaagagtgaaactgtgaaactctgtctccaaaaaaaaccaattttaataggtataccattatacacccattaaaatggctaaaatccaaaacactgacaccactaaatgctggtgaagatgtggagtaacaggaactctcactcactgctgatgggaatgtataatggtacagtcactttgaatatagtttgatagcttcttacaaaactaaacatactcttaccatatgatctagcaattgcactccttgatatttatccagaggaggtgaaaagtcctgcactggaatgtttatagcagctttattcataactgctcaaacttggaagcaaccaagatgtctatccttcaggtgaatgtttgataaacaacatgtggtatatccatacaatagagtattactcaccaatgaaaagaaacaacctatcaagccacaaaaaaacatgaagaaacctgaaatgcatatcatttactgaaagaagccaatctgaaaaggctacacactgtatgtccaactatatgacattctggaaaagacaaaactatggagatattataaaagatcagtggttgccagtggttcagcagaggaatgaataggtggagcacagggggtttctagggcagtaaaactattttatataattgtgtactggcaaatatacatcatcacacatttgtcaaaatccatagaatgctcaacagagtgaaatgtaatgtaaactatggacttcaggctggacagagtggctcacacctgtaattccaacactttgggagactgaggcaggaggattgcttgagcccaggagtttcaggctatagcaagctatgatgatgccactgcaacctggcctggacaacacagtgagaccctacctctaaaaaataataataataaaataaaaatagaaataaaataaactcaggaatttggttaataataatgtatcgagttggttcattagttgtaagggacgtactatactaatgcaagatgttaataatagaagttgtgggagaaagtaaggggtatatggaaactctctgtactttccacataatttttctgtaaaactaacactgctttaaaaaataaagtctagactggccgcagtggctcacgcctgtaatcccagcactttgggaggccaaggcaggcggatcacgaggtcaagagatcgagacatcctggctaacatagtgaaaccctgtctctatcaaacatacaaaaaattagccaggcgtggtggcagacaactataatctcagctacttgggaggctgaggcaggagaatcacttgaacctgggaggcggaggttgcagtgagccgagatcatgccattgcactccagcctgggcaaaaagagtgaaactccatctcaaaaaaaagaaaagaaaagaaagaaaacacgtatctactaaaattacaaaaactagccgggtatggtggcaggcacctgtaatcctagctacttaggaggctgaggcaggagaatcacttgagcccgggaggtggagtttgcagtgagccaagatcacaccactgcactcagcctgggtgacagagcgagactctgcctcaaaaataaaataaaataaaaataataaagtctattaatttttaaaatatattaattgagccgggcgcggtggctcacgcttgtaatcccagcactttgggaggccgaggcgggtggatcacgaggtcaggagatcgagaccatcctaacacggtgaaaccccgtctctactaaaaatacaaaaaattagccgggcatcgtggcgggcgcctgtagtcccatctagtcaggaggctgaggcaggagaatggcatgaacctgggaggcagagcttgcagtgagccgagatcgcgccactacactccagcctgggcaacagagcgagactccgtctcaaaaaaaaaaaaaaaaaattaattgagctttatggttaagtttttaaaaagataaatctgacccataaagtttaaataatagtcaagatggaagatgagtgatctccccaaggagacaagcttttctatgaaaatcttatcaaaatgtataatgtacttagaaaactaagtgacctcattacacatcatagttttgcatgatgtaaccactcttcagagaatatctcattttgtccttcagctcccacacaagagaaggttaaggaaattccactactcatgaaattataatcccacaatgtaagtgaagtggtggctgtgcctaggaaagaaagagaatacacgcttagagagaatctagaaagaaacattatccagtttgtgttggggatagcccatgatctaaattctaaaaagcacacccatatagaacctagcctgggctgggtgcggtggctcatgcctgtaatcccagcactttgggagactgaagcaggtggatcacctgaggtcaggagtttgaaaccagtctgaccaacacagtgaaaccccgtctctactaaaaatacaaaaaaattagccaggcatggtggtgcatgcctgtaatcccagctactcgggagcctgaggcaggagaatcgcttgaacctgggaggcagaggttgcagtgagctgagatcgtgccattgcactccagcctgggcaataagagtgaaactccatctcaaaaaaaaaaaaaaaaaagaacccagtctgaagcatgaattcacattgcgttttccagtcaatcactcagccaaagagaacctgaggtggccaagataatgtaacaaccctatcaagtaggtgttattcccatttacagataaggacagaaatgttaagtgactacacatggatgcaaacttggaatcttcaaactcccaggctagtagccaaattacctgtttttaaatctcatctctgctatctgatctctgccaagcaaatttccctttgaatttgttatgcaaacaattaacgagaataaaggaaaatgagagctttatatacgttacatgtaataactggaagttaactttattaagacatctgaaataagtcaacacttttaaaacttaaaggctattctttaccagaatcgtctgtaggaattaaccccagcagtcagaaagtaccttaaaacaaaaccaacattaatctggtaatgtcatgacttcataaaatatccttaatattcaggtacgtgcataccaagaagagtaaacagaataaaaagaaatctctaaaacattttccctcattcactacatgtctactcttccacttacctttatctctaaaacaaaaacattttctaaaccctgtggacatgacttcactaatccaaagaagactttatattctatgggccttgtaaagccacatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctgaggttgggagttcgagaccagcctgaccaacatggagaaacccccatctctaataaaaatacaaaactagacgggtgtggtggcacatgcctgtaatcccagctactcgggaggcttaggcaagagaatcacttgaattcgggaggcggaggttgtggtgagccgagatcgcgccattgcactccagcctgggcaacaagagcgaaactccatctcaaaaaaaaaaaagaaaaagaaagaaagaaaagaaataatagagccgggcgcaatggctcacacctgtaatcccagcactttgggaggccaaggtgggcatatcatgaggtcaggagttcaagatcagcctggccaacatggtaaaaccctgtctctactaaaaatgcaaaaattagccaggtgtggctgctagcccctgtaatcccagctactcgggaggctgaggcaggagaattgctggaacctgggaggtggaggttgcagtgagccgagatcatgccactgcactccagcctgggtgacagagtgagactccgtctcaaaaaaaaaaagagaaagaatgattgataaaccaactgggatactggcagatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaccggccaggtgcggtggctcacacctgtaattccagcactttgggaggccaaagcgggcggatcacaaggtcaggagatagagaccatcctggctaacatggtgaaaccccgactctactaaaaatacaaaaaattagccgggcattgtgacgggcgcctgtagtcccagctacttgggaggctgaggcaggagaatggcatgaacccgggaggctgagcttacagtgggcccagatcgcaccactgcactccagcctgggcaacagaatgaggctctgtctcaaaaaaaaaaaattggcggtttatgggtttgtggggggtacaattcctgcctgtccaagtgacagactcatttaattatccccaagttaatgtttaagtgcaatggggtaaaacatgcactctgttaactaaaaagccacatttccaaatagtatacatattacgattaaaacattaaaaatatatgtgtacagatttattcatataagcccaaaaacaaatgtcagacaatgtttctgtctttggaacctgactcaaaataaggttcctcctgttggcttcttcctgagacacagccaacgctaatttgccgcccaggcaaatcatctatgcctatcattaggaaatcaaatttatgatatgcatagcctagaatactactctgtagtttttttgtttttgtttttgttttttgagacagaatcttgctctgtggcccaggctggagtccagtggtgtgatctcagggttcaagtgattctcccaccacagcctcccgagtagctgggattacaggcacacactaccatgcctggctaattttactatgtagattttttaaacatgaggtatatacacatgtatttgcattgagtattctctaagataaagtgacaaaaagcaaaatacagagtttggtgtatttgctgctatatatggaaggaacaacacccagagaataacatgtttgcatgcatacatatgaagtaactcaggagagataaatagtaggtaactagctgtccctgggaaagagtcccaaggataaggtgcggactaactttccacttactacatatcttttgtactgattcatttcaaaatttactctaaaatattggtattacaataaagaaaactggagtctagaactgaatgacaaaactgatacattcttactacaaatctgtggttaagattagcattaatctttcctaggcaaagaggaaaaagtttaacccaaagactgtatggatcttctctaccctacatctccaatctcattcccattactcagaaaatattctcactgggtatagaggtatgaactcccattggaaaacttagggtaaacgtccgtggaatctatggggcactgctgacccaggacacctgggatatttctgcagaaacaggattttttttttttttttttttgagatggagtcttgctccatagcccaggctggagtgcaatggcgcgatctcggctcactgcaacctccacctcccaggttcaagcgattctcctgcctcagcctcctgagtagctgggattacaggcgtgagccaccgcacccagccagattattcttaatcagttgattatttctggctccagaatgcttcaattattccacctgcccctatgtataagcgttaccaccctaattatgcttgtttttgtttttttggttgtttgagacggagtctctgttgcccaggctggagtgcagtggcacgatctcgactcactgcaacctctgcctcccaggttcaagcgattctcttgctttagcctccagagtagctgggattacaggcacgcgtcaccacacccagctagttttttgtattttcagtagaaacaggatttcaccaagtcggcaaggatggtcttgaactcctgacctcaagcaatccacatgccttggtctcccaaagtgctgggattacaggcgtgagccatcgctcccggcctcctaattatgtttcattttggttaatgtttcaataaatgtgctttccctaaacatactgatgaaaagaggcccaaatgcaaaactgatttgtcgagaaagtcagtctgagatgaaatatttattatgtctaaaccacaagtagaaaaaaattcaaaggccgactatttcaatgctaactcaatgcaatattgcactttgtttggtttacgggagaggtaatttacacagctaacatttgggttttcaagattacattgtggggagagaaggggaaaacaagaaaagtctaatgcttttagattctgtcagaaaaagtgtttgctaaaaagcaaaacaaaatgaacatgagaaaaaatgtgaaaaaacatgcattttaggaagctttcaccgaagcaggtgctcaagttcagactcaaatcttccaactcttgtaataaaaatgagaggtcagaataccacaaactaatcaaatcaatcaaacaaagcgggaaacaggtggctgacaccagactgggcagggttttcctaaattgggcttaccttcactaatccaaatcagttttcagaaatggcttctacaaaaactacccaaacatccccctaataatttgcactcctcctccacaatagggaagccaagccgtttatttcccagaaggtttactttctctttcaagctctgctggcttcttcctgccccgcatacggccaggaaaaaagaaaagcactgccttttctttcctgccttctctaaaactggggagatggggtgagagaacctgtttcatggacaagctgggtggttcttaactgcaacactgttctgaatacagattagtttgcaaaggaaagttacaggacaggaaaataaaggtctacccctccaactaactcatacacatgtacatttgcatgtacgcacacacacagatgtgagggcacatttaattcagctgagtaatgtgcagcaatcagctcccagcttcatacctggccaccgggatgcctcctcactcccaccttctttacctgactcaaaataaggttcctcctgttggcttcttcctgagacacaaccaactctaatcattcctcttcccctcaaaccttcaacactacctgcactttctgggtcgggagcaattccttgggtggtaatccatttttaatgtgttaaatattacttaaaataagggagaggtaatcatggactgtgggcaatgcagagatttatcagaagggcatttgtgtaaacaggaatttacagtttgccttacctattccttttatatgacagcctcaatttcctctaacagaatgtaagtcccccatccctattcatttagtttttttcccattaggttagaatctgctaattattctttctctcctttgggtcattagtggctgccatgaatcataatttgcctgactttgtaatatctaacagatattaccattttagtttagtttttgatatgacagttttttgttttttgtttttgtgacggagtcttgctctgtctcccaggctggagtgcagcggcgcgatctcagctcactgcaacccccacctcctgggttcaaaagcaattctcctgcctcagcctcccgggtagctgggactacaggcacccgccaccacaacaggctaaattttatatttttagtagagacggggtctcactatgttgggcaggctggtcttgaactcctgacccgcctcggcctcccaaagtgctggaattacaggcgtgagccaccatgcccgacctcctaattatgttttattccacctgcccctatgtataagcgttaccaccctaattatgctttttgtttttcggtttttttgagacagagtctcactctgtcacccaggctgtagtgcagtggcacgatctcggttcaccgcaacctccgcctcccgggttcaagcgattatcctgcctcagcctcccgagtagctgggattacaggtgcccaccaccacaactggctaatttttatatttttagtagagacggggggggtctcactctgttgggcaggctggtcttgaactcctgacctcaggtgatccacccgccttggcctcccaaagtgctgggattacaggcgtgagccaccgcactcggcctgatattatagtttttaataagagtaattcagcctaggcaacgtgacgagatcctgactcaaaaaaattagaaaattagctgagggtggtagcacacacctgtagccccagctaccccgaaggctgaggcaggaggatcacttgagcctaggaggtcaaggctgtcatgagctgtgatctcaccgctgcactccagcctaggtgacagagtgagaacctgtctcaaaaaataaatagtaataatagtaattattagcacttgaatgttacctgtctgcccggcactatgcaaagtacttgatatgcatcatcttgcttcatcctctcaattactctacaagtggacctcgtttccacaattgtggacagagaaactgaaaaccagagaagtgaaaacaacaggcccaaggtctaagagaaggcagaactgggattaaagcccaataggtctgacctgatagtccactcttttaactgctatagtaactttggaccatgaaaccctcaaacataccaaccaagtgtttcaaaactacaatagcaatcaccttaggaatactcaaaatataagttctttggctgacgcagttaaaaattcaaaggtcaggtaaaatttcagtgatgagcaaggtcatttattcttatggctgggggtagcaggaaggaaagccggatcgtcgaagcattattttcttgtaggggcagatttaccttccttattattcttttgctaggctgttaaaaggaatttggaaggccaggcgtgctggctcacgcctgtaatcccagcactttgggaggccgaggcaggcggatcacaatgtgaggagattgagaccatcctggctaacacggtgaaaccctgtcgctactaaaaatataaaaaaaaaaacattagctgggcgtggtggcgggcgcctgtagtcccagctactcgggaggctgaggcaggagagtggcgtgaacccgggaggcggagcttgcaatgagccaagatagcgccactgcactccagcctgggcgacagagcgagactccatctcaaaaaaaaaaaaaaaaaggaatttggaataaatatgtctccaagataacctggtaaacagaaagggctgcaaaaaatctgaataaaagcaagtcaattaacaggatacatgtaaaacacacattttatattcctacaagtctttttttttataatagcatgttattacttttctaaaaaggacaaaataacttattttaatgacatttaaacccaattattaacagaaaagggataagaactgtggttccttggcctcctttccccttggtttagttctcctaaattaagaacttctacttatagctccctgaacacacaaggctgttttaagcctctgcaccctcatgttccttcagccttgaatgcaactttttgtaacgcaacttcgtggaaagaattcctattcatcctataaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgactaggaagtggcagatccaggattcagtcccagatctgtttgacttcagagccagagtcttgaaccactcactgccctgtcgtctcccctgtcctacttccatactggcatagcacacacctcggtccctgcaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagctcactgcaagctccgcctccaggactcatgccattctcctgcctcagcctcctgagtagctgggactacaggcgtctgccaccacgctgggctaattttttgtatttttagtagaggcggagtttcaccgtgttagccaggatggtctcgatctcctgacctcgtgatccgcccacagcctcccaaagtgctggaattacaggcatgagccaccacacccggctgggtaagagttgcagtaatcctaacatgacaaatgagaactgaccataacagaaattcattcttccatatgttattcccaggcctcataacctctccttcctctgaagacatgtagcattcagtgtagcactgtcagaatgtctcactctgtcccccagtctggagtgcagtggcaggatcttggctcactgcagcctccacctcccaggttcaagcaattctcctggctcagcctccagagtagctggaactacaggcgtgtgccaccacacctggctaatttttgtatttttagtagagacggggttttaccatgttggccaggctggtctcaaactcctgacctcaagtgatccgctcacctctgcctcacaaagcgctgggattacaggcatcagccaccatgcccagcctgtttttgccttttttttttttttaaagaaacaaagtggtctcactatgttgcccaggctggtcttgaactcctgggctcaagcaatcctcttgcctcggccttccaaagtgctgggattataggcatgagccactgctcctggcccgatatgctactccttttaaaaactggaggcatctcaaacaatttaccaccaaaggaccatgtggccatactgactaaagcgcactacactttacgcttacgtcttgtaagccaaggtgtctaacaaagagtatataaccaccatattaattctttacaccataatcaataagggctgggccagcccagcaatgccatcctcctggatctcactgaggctgctccagaacaccagaagttcttcaggattcggggatgtccctcaagtactctttcagtggtttttataaatgactcaaaagttatggtgaaatttttaagtgccaaagacataaaatatgagtggtggtttgtatccaatcaaaaatcctcaaaaaacacttctgcacttaagcacactatacttttttcacccaaagtaccaaatcaaactagtcaggatacctacctttgtacaatgtcagactccagttaataactcccctagggcagagggcatatgcactgatttactttgtacaaattaaccagcatcaggcaatcaggcctgtgcctaacacatagtaagcactctatgattaaacatcagtgcttcggctccaaagttttatttatttatttatttatttattttttttttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccgcgcccggcgccccgaaagttttaaaagcttcccctacaaaagaacagaactgaaattccttggtcctgtattcaatgtcttttgtaagtaatcacttctcccctacttaccctcctagtctaccgggctaccaggaattttttttttttttggagacagggtctcactctgtcacccaggctggagtgcggtggcgggatcacggctcactgcagccttaacccccggggcttgggtgatcctcccaccttagtctcaccagtagctgggactacaggtccacgccaccaggcctggctaattttttttatttttaggggagagggagttttaccacgttgcccaagctggtctcaaactcctgggctcaagcaatcctcctgcctcagcctcccaaagtgctgggattacaggcataaaccaccgcaaattctttacacctatcaaattccacccattatttgggacccagttgaaatccctctttggcaaaaagactttctagacaactccaggcctcataacctctcctttctctgaagatctgtagcattcagcctagcactgtccaatagaacgttctatgataacagaaaagttctacatctgtactgtatgttcttttatgtagaacagctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcgccaagccggggtgcctgtccaggatccggttggggcttgttccctcggctgcgacgtcggaacccccggctccccctcccagtctgcgccgccgcagctccggaaacc

SEQ ID NO: 2052 - DNA, 75171 bp, Homo sapiens; identical to SEQ ID NO: 2051

SEQ ID NO: 2053 - DNA, 75063 bp, Homo sapiens
acggttcctatataacgtttatttctggaagttaaagtagatacagcaatataccaaaaaaaaaaaaaaaaaaaaaagacaaaaaacctcacaataatataaatttttacactatgaagtacacattggaatttgaatgcagtggccaggacagcagcttataaaccaccttataggtaggtaagcaacccacgggattccctcggctgggctggggatggggagggggcagtggacaggaagcgggcagggcctgaggaccctgttctttaatgggccacaacagggctcagctcctctcagaacttttgctacaatcagagttaagaccagatacatgctacctaaggccatgaacttgacaatatctgctccagagaagccctgaaccctcgccctaggtccctatgatttaaacccaatggtaagcccaagtctcacctttctaaatattctgtttatcagttaagcttattatgtactgaagagtgttgctggagaagtaagagctctgcatgacacatcaactgtctccaggcaggaggactggggcgaaccctgttcatcttagagaaggtcgtctcccccttaattcagagaccagctaatttgatttaacaaacagaattccacagaaactctgatcagctgaggcaaggtggttttgagttgccaaatccggccatgcctctgagtcagaggcagcccatccagcacgtgctaggtgttcccatacgcacaggagaggcgagctagccagccaaggcgggcaggcggggaggccctctagctgttctgcctcacctgtggggccccagcagggaggagtcaccagcctcagagggaggccaggtatacaccctcatacgagggcagactcaagtttatcagtaagcctttgccctgcatgaactgaatgaagacgccattacaagtgccactggatatcaccaagaaactggctaagaaccatattccctgagctcaaccagacacgtcgctggggccccatagtgtgcatcatgtccaacctgtaactctctccccctcttcttccatgaggtcctgagaccaggattcctaaaacaaacaggatgagggacctttagacacgcaaggagacatgcctctagcaggatcagggggactggggtcgggagggtggggcaggaaggaagccagaatcagaagtatcccagccctgataaggcacccacagaaacaacctagcctctgaaacagcagatcaagtccagggagaaagggagtcaaggttgtaagcaccctctgcccagccttactcactaaaaggccaatacattacaaaggaaaataagtctatttataaaaaaaagtctaaaatgcttagattctccttaaaccttcctatttcaacaccaaaggccaggttgcagcttcagatgtcttaagggtttgacctgaagcccgtttcagggattatataaattaccagcctgaaggaagctgaatgcttaaagcaccaaggaggctgttaactgaagtttcttttttttttttttttttttgagacagagtctcagactgtcgcccaggatggagtgcagtgtgcagtggtgcaattttggctcactgcaacctccgcctctcaggttcaagcgattctcctgcctcagcctcccgagtagctgggactacaggcgcccaccaccacacccagctaattttttgtacttttagtagagacggggtttcaccgtgttagccaggatggtcttgatctcctgaccttatgatccgcctcggcctcccaaagtgctgggattacaggcgtgagccaccatgcccggctgcttaagtttcttaaatacagaaaggctatgctgatacagtgttttttgccctttaattgttattatttcttaatttaaaaagaaacctagggcttagatagtcctatcttctatttggatgtcagcaaggttaaaaagtgcaatgccaggagtatgtagctataggtggcctgtggcatttgcttacagaaacaggcagaaggatgccgcaggcaccaggaggcacttgtctaagaacaacaacaacaataacaaaaagctgctgagaaaggagggcaggggaacaaaacaacacaagacatttcctttttctccctctagccaccccccgccacatcccctgatcatgggtctcagagaacacatccttatttgcatttagataaaagcagatcacccacattcactcatttctctatttttaaaagtgcccagattgctcaaagatagcagaagtaggagattaaaaaaaatctggaaccacaaagttagtagtttcagatgatctggggtttggctgtgtgaggggtggcagaatgcaggtaggcgcctcagtcgtatctttctgcagcttccgttctcagctcctcacatgggggaggtagcgcactccgaggtcaactccatgtcaaaggtgagggactctggagggacagacagggaaaactagttcagttgtccaccctctgcaactggcaggccacgcccccagcccttcagaggacagggcccaggctaccactgctatccaatctcctgccccttaaggcccagggatggtcagaaaagccagatttaccctcctccctggaggaccctgcctcgggaagggtcctttctcattcccaccttaactgattcccagagctccatgtttacagaagctctaaggctgtcctgagatcttctgcccttgatctactgtttaattcaggagccccgagacacacgtggccaccaagcatttgagatttggtttgtccaaactgagctgtgctgtggctgtcaaaagcccactggattttaaaggcttagtatgaaaaaaaagaataaaaaaaggtctcaactttttctttttagtttagttttgtttatttgagatggagtctcactctgtcgcccaggctggagtgcagtggcacgatctctgctcactgcaacctccacctcccaggctcaagcgatcctcccacctcagcttcttgagtagctgggattacaggtatgcgccaccatgcccagctaatttttatattttagagattttggtcagactggtctcgaactcctgacctcaagtgatccacccacctcggcctcccaaagtgctgggattacaggcatgagccactcacccagcctcaactttttctgaaatgttaaattgagagtatgttggatttagtgggttaaataaaatatattgtaaaaattaagttcgtctatttccagtgtggctgctagaagatttatactcacacatgtggcattcataccatctcttttggaaagcaaagctctagaatctcctaccattccgagtgaccagctctcggtgtgtacatgtgagagcatcacacaaaggggaccaacttcccttatagggacaaagtctgtcaaccaaatactcaccaaactgccctcctgctgagggttcagcaccttcaccattatttccaaactgcatcaatgaatctaaagtgcggggggacatcggcaggtcaatggtattgctgcaggtcgttctgtaggaaatggggggcagcaggaggggaaacggggggttgacaagacacaatggaaaaaaaaaaaagaacaaaacacacacacacaagccatcaaactctggtctccaacagaaaaataaaagctcaagctttttaaacacacaaggtcactttgagtactaaacatagcccaggggcttccaacctttggcagattaactctcacccagtgtcccattcccagggataactgaggatattagaaatgaaggcaaaacggggaaaggaagccacttacggtgtcacacagataaacttggtcttcaggtatggggcagcgcctgggaagaagaaaaccagttttcttactgactgtgacttcgcattcagtaagcagagctggaggaagccatctgcctcggcaggactgatttgaaactcactcatcctcatgccaagattgtctggaaagctccatctgcccctcagggttgtctgccctcatttatactatttgatctcccaggcactagcagctgtgaacttcagttctttgcacaaagctgtcctgagctgcagagacttttcagcataaccttttcccacctgaccctagactaatgccaccttgtgtcccttctttccctagattatgtaaaagtttaacagcctccacgtggtctgagcattctattccggcctggtcatatctcttagataacttctctgcatgcaggaaccgagcctgtgtagtctttgcatggtgtccagcctaaataccaatatcaccaagtctttaaagaacatggagactgctaatgcttgtggttccaaagccaaaggttatatctcttattcctaccagcactaatctggcctctaccacatttttggatgagggcatgagtaactttctagttggataaatacgtcaatcaaaaagcaccaaagagaatgtgactttgtaaggcagtacaattgcttcaactagaagaccggagacctgggtccaggtacatcttcaatagctaagagacctggagcaaggcatggtctctctcttttgttgctgttgttcttattgttttgagacagagtctcactctgttgcccaggctcaagtgcagtggcacaatctcggttaccgcaacctcctactcccaggtcaaaacgattctcctgccttaggctcccaagcagctgggactacaggtggcaccaccatgcctggctaatttttgtcttttttttttttgagacggagtcttgctctctttcgcccaggttggagtgcagtagcgccatcttggctctctacaacctctgcctccagggttcaagtgattctccttcatcagcctcctgagtagctggattacaggcatctgccaccatgcctagctaattttttttttgtaattttagtagagatgaggtttcaccatgttggccaggctggtcttgaactcctgacctcaggtgatccatctgcctcaccctcccaaagtgctggattacaagtatgagctatcatgcccagccttggccacaatgcccagcccatattctcttttatgtataaaataagagggagggggaagacaaggtgccaattttctatgagctttgtcatttataattcttgttctacagttagaaatgcgttgacgggaataaaatgaattttagatgctgaatgcttacaccaagaggtcaaggaaccttggggatactggcatgaaatctggggaattcaggtgaacaaaccattgagaaggcatggggcagggtgaggtgggctgagaacagcacggtcataaaacatgaggcttagacagaacctgagggatcagagagcatgatgaccatgtgaaagaaggcactgcagagtggctcttgggctgccatctgagtttactttgggccaagaaactgatcaattcagtgcagaattcaaaggagctactgaggcaagactctagtgtcttataaatccaactgttttggcccagcccttagggagctgacaccctagacagaaaaggatttaattctccagcattcaagatagctgaggccaggcacagtggctcatgcctgtaatccctgcactttgggaggctgaagcaggtggatcacttgaggccaggagttcaagaccagcctcaccaacatggggaaaccctgtctttaatgaaattacaaaaatagctgggcgtggtggcacgcctgtaatcccagctactcaggaggctgagacaggagaatcacttgaacctgggaggcagaggctgaagtgaggtgagatcgcaccactgcactccagcctgggtgacagagtgacagactgtcaaaacaaaacaaaaacaaaaacaaggctgggcactgtggctcacacctataatcccagcactttgggaggcccaggcgggaagatcacttgaggtcaggggttcgagaccagcctggccaacagggtgaaacccggtctctactaaaaatccaaaaattagccaggcatagtggtgcatgtctgtaatcccagctactcaggaggctgaggtatgagaatctcttgaacctgggaggcagaggtttcagtgaagcaagatcgcgccactgcactccagtctggacgatagagcgagactcaggctcaaaaaaaaaaaaaaaaaaaaaaaaaaagctgagaaaaatgacttcattgtgtggctttgtacaagattgtaaatgtactttatctaatttgtaagtggctccgaacctctccctcaagccataaggaaatgctatgtgggcttccagtagagaaggaagagagaagagtcttgggaggataatctaacctgagaccctcataccataatactcttgtgatggaaatagagaggaaatggtcacatgctcatcgtcctgaaggcacccattttaaaataacacagggacacccccacacccgtcaccacactcacatggagtccctcagggcacactcctctcagcaaggcaaggcaaattactcaagtaattagttcctttctcctgatgagtgcctggcccctgaggaaacgctgacatcgctgggcaggaaaggacctggcctcccagcccacaggaagggcgatggtaatggaggatgcagcctcagactgggaggtgggaccttgaaagcaaaatgagtcaaaaggaccagccgtgggaccccaacgtcctctgcagaaggaacaaagagccgtgtggcaggggctgataaacagatctcccaactgaagcacacatgcaaagggagataggtggcagacaggaagtgagtaactcttacagcaggaacaagactcaggaccccaacaaaggagaaaggcaacggtcaattagctccaactccctcttccaagccccattctgccccatctcaagaaatccctcagaaggaattcctaggaaaaagtgggagggaagttggtaggtttctgtgtgtgtgctatttggacaaaaatagttttttcaacagcaactagggcaaggcgccaaccctaaaggatcacattaaagagcccatcattaggccaggcacagtggctcacgcctgtaatcccagcactttgggaggctgaagtgggcagatcacctgaggtcaggagttcgaggccagcctggccaacatggcgaaaccctttctctacaaaaaatacaaaaatcagctgggcatggtggcacaagcccataatcccagctactcgggaggctgaggcaggagaattgcttgaaccgggaggtggaggttgcagtgagccgagatggtgccactgcactccagcttgggtgatagagcaagacttagtctaaaaaaaaaaaaaaaaaaaaagcccatcattggctttatgattacagaaagttaaatcaaacaaagaatggcaaaccagagactccccatcaagacctgcacaaagaacccagagagtcaaaacagcaagtgctgaaggggaacagacagggctaccccctccacactgaggacagctgcagagattacagttttgtttcgtttttttctttctcttctttgtgtgtgtgtgtgtgtgtgtgtgtagtggggtcttgctatgttgccaggctggtcttgagttcctggcctcaagtgatcctcctgcttcagcctcccaaagtgctaggactgcaggtgtgaacccccatgcccagctgagattacagtatttttaatttctctctcttttttttttttttttttttggtgagtcaaggtcttgctctgtcacccaggctggagtgcagtggtgcgatcatggctcactgcagcctcaacctcctgggcttaagcaatcctcccacctcagcctcccgagtagctaggactacaggcacaaaccaccacacgtggctaatttaaaaaaaattatttttgtatagatagggtctcactatgttgtctaggctgttctcaaactcccaggctcaagtgatcctcccgcctgggcctcccaaagtgctaggactataggcatgagccacttcacccagctaaaataatttatatataacatataagtacatgtcctcttacacattaaaatataccttattttcaatagttgcacactctaaatactaatcccttgcccctccacccagtcactgtcttccccttcaaacgtgatgctcccagctcttctactctagtgtaaaccatactcccatgcagctaataataatttcctccagaaaccctttcttcagaccatctggcacactgacatggttcagttacaggcaaaaagccatatgctgggctgaaatctgggcctcaaaccttctagcatctactaagaagcactgtgccagcagggcatcctgttaactgccctcactttcccttctcgtgtttcaggcatgttttgggggacgtatgtgtattgatcccctctttatttttattttttgacacagtatctcactctatcagccaggctggagtgcggtggcatgatcaccgctcactacagccttgaactccttggctcaggtgatcctcccacctcagcctcccaagtagctacgactacaaatgcgtgccaccacaccgggtaatttttttggattttttgtagagacgaggtttcaccatattgcccaggctgtatcccctctttagactcatgcactctctgtggagcaggaactacactactctaagtgattctgattctcctctcaaatcccatcggtcaccccaacaaaagcactcactacaattctttcccataaggagaaataattatcccccaggttattcaggcatttgcctatctatcctccaaggatcccaaaatttccaacttttcccaaaaattaaatgccaggaacatggaaaatcaacaactacctgggtcagcttcaggatgctcctggctctctggccgacaatactttccgaatgcctcctccttgggaatgtcaggatagagatagaccagtggagacaccaggatattggtagcatccatgatcttatagcccatgatgatttcagcaaatgacatgttgttcagctgctgctttgtgtatggttccacggactggatctgggtcttacctgtcacaggacatgggaaggaaagatcatggaacctacagctaggtcatctcagagaaaactgcccattttttctttcctcgaaggggaaaagacttaagccaccctagtgttgagaccctgaacaccctgttcagtggcctggcactgtggaaatattcaggctggcttctaattaagaagaggctactagttgggtcatagaaaataaacttgaatataactacttgcgtaagatatattaacagggttaagtagaaaaagagatgaagaatacaatttaaattgcaaaattctcaacaaatagtcactggagcaagcaaaacaaagcaaaccaatccttcagctggaaggatttagaagtcacgcaaatgtgttttgcgagtctgagtgaaacagggagtcaaggccatctccacccaccagggggcagtaggtgcttgcaactagaagcagtgatgaggcctcagcagccaccagcaggtggggtgggtgggagcctcccttaccgctgatgtccttctccacccaagtgaaagtgacgcctccttctttgctgctttcactgaatcttagcaggaaggtgcctggaggcttagtgctcaagatggcccgctcccgctccttactgataaagcccatgatgtacctggagccaaggaggaggaacaatgttgttattgctaacagggcatccatcccctgccactggcttgctgagagcaggggacttggttacatctgtgcacactctgtccaacctacccttcgttccaaagggccaggatgtactttttcacaaggtcaatgatattgtccagccagacccagaaggagaagcccttgccagccatgttttcctggagaaaagagtaatgggaaagccaagtctactgccatcccagcccttcccttcctaggggtgcagtgcatcacccaaatcctcaggcccgtctaccttcaggcaggtcctactggccgctggaccaagagttcagggccttcaagccagagccctcaacgacagccgtgcaggtgagcattcccattcccacgagaatttaacaagattgcttactttgcaaaatttagcccatgtgatctgacaccctgaataattcacaccaggtcctgaaggaaagaaaaagagtcaagtagtacattttcagcttggggtcaagaggttatttcttaaaacagaacacacacacattcatcccacaatgggccacaaaataatcagctttcacatctttgaaggtaggcactgttgtgtgtgtgcacatgaggacaaacactatcccatcatttgactcacttgtgttgctgggtagcccagcagggatggagggtgatataacaagtccccctgctcttcccaacctcgggtggtaggctgggaaccaacagcagcactcactaacaagctgacatcgggtgtcagacaggtgtatttggtggcaacagctttattagaacaaagctacttctagcccaggtggcacataaaatattccactaattcttttttaaaaactagcctacgctgggcacagtggctcaagcctgtaatcccagcactttaggaggccgaggtgggcggatcacgaggtgaagagacggagactatcctggccaacatggtaaaaccccgtctctactaaaaatacaaaaattagctgggcgtggtggtgagcacctgtagtctcagctactcgggaggccgaggcagaagaatcgcttgaacccagaaggcggaggttgcagtgagccgagatcacactactgcactccagcctgggcaacagagcaagactcgtctcaaaaaaataaataaataaataaaataagacaaaaaaaaccaactagcctatagtttattaaaaaaatggacagggaatgtcaagcctttagtgccaccttccaacacacacttaaaagatcttctaaagttagatagagtgggtgaatgagacagcaaccaggagaaaagaaatctacctcccacctcaaaaatgatcacctcgactgaaaactgcaaactgtctctgcaccccaactccccaactcccctgtttcctggcaccagcacagcgccttgctcaggaaagaaacatggcctaatgctcagtagacatggcccaaatgaacagccctatgggccggatcccttttctgggcgggtgggcgggagggagaaggggtgaaatgcggacccaagagtttctctgccagtgtagtcagctgctcgatgctcagtcctcgcttggtggtggaggagaactgccagctcaggacctcggccacttgatcccaggttccaattgggggcttggtaaaaaagtttacattctattggaaagaacacatttgcttgtttagatgagggatggtgctcattgtctatactaggtacccctaagtcgcaagagatcccggggcaccaactaaaaggagggggcactaaccttgggattgttggtcagcatgttgtaccacaggatggacgcccaggcatttggcatctgacagatgttggagatcaccacaactggcaaggagtgggtctgcggagggagtggggactgagctggggaggcagaggggctctcacagccttggaaatctcttcacccgcatctcacggggctcagaatgaaaggacatgccataaaccacacctgctgccaactctaggcgaggagtgtgagtgagtcagctcagtgagcactcatagtggaaagaatgcccagcgtggccacacaactcaggctgcagtcggaatataccggtcccttgtaaaacctgacttgctcaaagcttgactcacaatccacagattccccatttttaagaccttggaggcattctccaagacttgaagctgtatcttcacatgaaacagggaggtctcaggaatcaaagaccaggattcctgcttttctaggtatatcttaatttaaaaatcaagaaagttgggaaaggagaatgtcattgccacaattttctgtatactaaacacactggctgctaagactcttatgcccaaactttataaagtcagttctaatttcttttttttttttttgagacggagtctcactctgtcacccaggctggagtgcaatggcacaatctcagctcactgcaacctctgcctcccaggttcaagtgattctcctgcctcagcctcccgagtagctgggattataggcgtccgccaccatacccagctaatttttgtattttagtagagacggggtttcgtcatgttggccaggctggtctcgaactcctgacctcgtgatccacccgcctcagcctcccaaagtgctgggattacaggcgtgagccaccgcgcccggccaatcaatttctaaatagagattttcatatcaagtttgctgaaagctgaatatacacacatcttctaagcattcaagcaagactttattgccagatgggatgccaaggatttttttggagaaaagtaagcaaaaataaacacagtgttaagcaaacagtaatcattccaccttctcttgtaaaaatcccagtggaagtttttgtcctgagtcacccctgtacgtagcctctcaccgattctgctgcagaacttacctctaggtcaatcttgaggccttggtgatacacctcggtctcaaaggtgatcaggtgcagctcctcagtcacaatcagggaagcctacagtaacgagaaggacactcttaggccaggtgtggtggctcatgcctgtaatcccagcactttgggaggccaaggcaggaggattgcctgagcccaggagttcgagaccagtctaagcagcacagcaaaactccatctctgcaaaaaatacaaaaattagctgggtgtggtggtgcacacctatagccccagctactcgagaggctgaggtgggaggatggcttgagcctaggagatggaggctgcagcgagctatgattgtgccactgcactctagctggggtgacagagtgagaccctgtcttaaaaaaaaattaaattaaataaaaaaaaaggctgagcgtgatggctcacacctacaatcccagcattttgggaggccgaggcaggtggatcacatggtcaggagttcgagaccagcctggccaataatttggtgaaaccccgtttctactaagaatacaaaaattagctgggtgtggtagtgggcgcctgtagtcccagctactcaggaggctgaggcaggagaatcgcttgaacccaggaggcagaggatgcagtgagccgagatcacgccactgcactccagcctgggtgacagagtgagactctgtctcaatcaatcagtcaatcaataaaaaagagaaggacacttttcctcagagagaatggcattcagtactaacagccacagccaaggaaagtgacatgccaagcctcaccacaccaagaagggtaagccaccaggtggtcacaaacaaactgccagggacacaacttgctcggcacttactctcttcaacaccaagaacttccaatgctgtgatcctcaacctaatcctttactcagtttgtattataatattacatagatccaattggttatttgtaaaatacgtaaggcacaaagaataacaaaacaatatgaacccaccattcaatttaaggaaaagtccatcactcctaaaattctctgggtgcccttccccaaccccatccccttccctcctccctcagaaataactgctattttgtcttttgggtttatcatttcctagccctttttgtcttgttttgttttgtttttttacagttttaccatatttgtttatctaagcaatgcaggtattgtttagtttgggacatttgtgaaccttacacttatggactccaatgaattcttttgggattcacttttcacttgatgtgaaatgaatccacatggttatgtgtatctgcagtgtattccttttcacagctgcggagtattccattgtgtctataccacaaataatgtattcattctaatgttgatgggtatttatttgggttgcatttagagcttataatcaggctgatgtccactttatatatgtctcctgggacatatatgcaaagatttctctgctattaaatcctgggaatggcaccgttggtttacaggtatgttcatttttatactgccaaattgttttccaaactgactacaacaatgtctcacatcagtacagcaaccttattttaagtaagagttgtcaatgaattctcaaaaattgaattctagtctgggcacagcggctcatgcctgtaatcccagcactttcggaggccgagatgggtggatcacgaggtcaggagttcaagaccagcctgaccaatatggtgaaaccctgtctctactaaaaatgcaaaaattagccaggcgtggtggcatgcacctatcgtcccagctacttgggaggctgagacaggagaatcgcttgaacctaggaggcagaggttgcagtgagctgagatcgcaccactgcaatccgatagaacgagactccgactcaaaaaaaaaaaagaaaaaagaaattaaattataattcatttttaatactatttttctgattataaaagtaatatattcagtttaaaatgcaaatatcacagagacagtctagaatagccatggataccaacagcagcactaatacacatagcactgctggtatattcctccagaatttcttaatatacatatgaatacacataagagtatagtgtatttttaaaacacatatactaataatactattcaaattattttacattttgctttttcttaatatgtcatgtacattttcccatatcattgcatacaggctacttcactctactgtcaagtaaaattccacatttttaaaaaggactgctacattttattttatttatttttttgagacagagtttcactctgttgcccaggctagagtgcagtggcaaaatcttggctcactgcaagctccacctctcaggttcaagcgattctcatgcctcagcctccccagtaactgggactacaggcgtgcaccaccacacccagctaatttttgtatctttagtagagacgggctttcaccatgttggccaggctggtcttgaactcctgacctcaagtgaccagcctgccttggcatcccaaagtacggggtgtgagccagcacgcccagctaggactgctacattttaaagaggaagaattgttcaggggacaaatgtaagaaaaagaacggggcatcacaatttttaaaaatgactgaaaactagccttccgtcacatttacctttttttgtttgtttgtttaaagtttattcttgacaataagaatccaataatctgaatcaatgaaaagcagaaaataagggggataaagaacaagatgggtttttgtttgttcattttattttatgtactcttttcctaagcaagctaatgcaaggtggtcatttattttaaagtttaactcaaatctgttgcttttacaccctctatcccacctcagtgggagagaaaaacagggcactaaaaatggagccaagcagggtcagccgcaggagctggatggggaatttggaaagccccaggcaaggtggaaagctgctttataccacatgggtgtggagaacaactcagcaagggactttccacttctccttaaggaggagccaactcccagatattcacggaaatgttccaagccagagagctccatggcacatggaacttctgttcatgtcactttggcctgaagtgactttttggaataactacagctgaaagaacaggttgatgtttctaattctggggattaagaaggatctttacccctctctccctcaaggaaaacaccccagttgtctttcatccccaacaaaacttacatcacaattggctcggcccccattcccacatctctgctccctcagggtctgtaagaaaagaaaaaggcaggtgtcctgtgaggctctccctagccctctccggcagccagaggccctttgtgaaggggagctcctcccacataccaagtgtttgaattctgcagagaggctgccgttgttggattcttccatgttcatcacttttgtgtttgtgcccagaatgttaaatttccgggatctgaatcacaggggaacaatcaactatgtaggtgaccaagtagccggaggatgaagttaggttaaacggaacaaaaggaagcctctaggctgaacttaccctctgagagctgcaacgtccccagagtctctgtaagaacacagactgttgttaataaaataggctctgtgtttcttcaaaaagcctactttgaccacctgttatttactgtcatgaaaaaacctctgtgctcctgggcatttctttaaactattcagttacagttgatcagcgcaacataacacctctgcgtagcaggcacagttggttgcctccccataggaaggggaacctatgtttcatattgcatatgtacttattaaacctaccaccttcgtcaactcccttatttcattattttccagtgcatcctcatgaaatttccacataattacatcaactaaaaataagaatgcattttatcttttcttttttctttttttttttttgagatagtttcgctcttgttgcccaggctggagtgcaatggtgtgatctcggctcaccacaacctccacctcctgagttcaagtgattctcctgcctcagcctcccgtgtagctgggattacgggcatgcgccaacacacctggctaattttgtatttttagtagagacaaggtttctccatgttggtcgggctggtttcgaactctcgacctcaggtgatctgcccacctcagcctcccaaagtgctgagattacaggcgtgagccaccgcgcccagccacattttctcttttcttttctttttttttttttttgagatggagtctctgtcgcccaggctggagtgcagtggtgtgatcttggctcactgcaaactccacctcccaggttcatgccattctcctgcctcagcctcctgagtagctgggactacaggtgcccgccaccacgcccagctagtttttttgtatttttagtagagacggggtttcaccgtgttacccaggatggtctcgatctcctgacctcgtgatccgcccgcctcggcctcccaaagtgctgggattacaggcatgagccaccgcgcccggcccacattttctcttttctaatgtcgtcaaagggtatatgtattttacatcctgaaaggtattgtgaaattttgcgtattccattatatggtaaagtgtggaacaattaaaaaaaagagatctattctttccacatgctatgtatggaaagaatatataacgacgtttcggtcaacaacaaaatgcatatatgatggtggtcccataagattatcatggagctgaaaaattcctacttcattgagatgtgttacaattgcctacggtattcagcacagtaacatactgtacaggtttacagcctacgaccagtaggctctgccacatagcgtaggtgtgcagtaggttctgccacccaggtttgtgtaaggactatatactctacaacatttgcacaacaaaattgcctaatgatacattttgcagaacgtatcccagtcgttaattaacacatgatctcagtcttatatataatatgcatgaatgacatgtacaagtaaaaaactaaacaaggaaaagagggactggttgtcacaatagcaaccacaaatcaaatctgtacccccagctttgtggctttgttcagacacgtaaatgacaatgcaccccaaggcttttgaaaacttttgtccacaaaatgaagatctctgaataaagacagagtctctagttcaaatgatgtctgtcaaagttctcatttttctattcctcatttgaaaaacagagctaagataggagtacttacttgtcaatgcacactttaattttaagctgataattcaactcagggaatttgaccagcaacctatttaaaaagaaaaaatccaaggaaaaaaagtcagtaactctcccataaccttttcttgaagaaatgtaaaattcataattcttcatttccaacaggtaaataggccaagctgtctataattacaggctcacatctataatctcagcactgtgggaggccaagctgggaggatcccttgagcccaggagttccataacagtctgggcaacaaagtgagagcccacatctataaaaaatttaaaaattagcggggtgtggtagcatgtacctgtagtcgcagttactcgggaggctgaggcaagaggatcacttgtgcccaggagttcaaggctacagtgatctatgatcatgccactgcactctagcctagatgacagagcgagatcctatctctctttctctttttttttttttgagacagtttctctcgttacccaggctggagtgcaatggcgcaatctccgttcaccgcaacctccgcctcctgggttcaagtgattctcctgcctcagcctctcaagtagctgggattacaggcgcgcgccaccacgctcagctaattttgtatttttagtagagacagagtttctccatgttggtcaggatggtctcgaactcccgacctcaggtgatccacccaccttggcctcccaaagtgctgggattacaggcgagagccaccgtgcctggcccctatctctctctttaaaaaaattaaaatagggctgggtgcggtgactcacacctgtaatcccagcactttgggaggccaaggcaggtggatcacaaggtcaggagttcgagaccagcctggccaagatggtgaaaccccgtctctactaaaaatacaaaaatcagccgggcatggtggcaggtacctgtaatcccagctacttgggaggctgaggcaggagaatcacttgaacccaggaggcagaggctgcagtgatccgagatcacacctcagcactctagcctgggtgatagagaaagactccatctcaaaaaaaaaaaaaaaaaaaaaaaggccgagcgtggtggctcacatctgtaatcccagcacttttggaggccggggtgggtggattactgaggtcaggagttttgagaccagcctggccaacatggagaaaccctgtctctactaaaaatacaaaaattagccgggcatggtggagtgtgccggtccagctactcagggaggctaaggcaggagaatcgcttgaacctgggaggtggaggttgcagtgagttgagattgcaacacgcactctggcctggccgaaagagcgagactctgtctcaaaaaaaaaaaaattagccgggtgtggtggcacgcacctctattcccagttactcaggaggctgaggcacaagaatcacttgaacctgggagatggaggttgcagtgagctgagatcatgccactgcacaccagcctgggtgagagtgagaccctgtctcaaacaaaaacaaaagatgagtatcactccttcaagccaaaggtactgagaaaacatctaagaactaacaacttaaagttgtgagagattcacaaaaggataatcaaagccatataatgaaaaatattacaggaacacatgctgtgcagctggcattttgttctattaatcctgaaaccgaacaccatactaagtttctgaggagggaaattttgctgcagaaggtcaaaaccccagcacacctgttctgacttgagtgtgaaagtaacacctcaccctacaggcccaccacccacctgccctggggcctctcagcttccccatcactaagccttactctttcccttaaaatccacagggaagagtagcctcaaagaacagaaaatagatgacattattttgtcccttgggcagaaggagaagctgtggcctgagactccaggtctacaatcataggaatatgcccaggtaccttcaaaaagatgactgctcttttgcttttgacatcagaatcagagagcaagcagatagtatggcaacaaatttcaaccccgcaacagtgtactgcctgtgacaccacacctggaaagaatgaccctggccaccaactctaccctcaccctaacagtgtccctcagtaaaatctctactggaaatggaagtggcatggcctacctgactttagtagtgaactggacgccggtcttgatgacgaggggccggtcaggatgcatgggcatgcagggctgccgctccaccacaaaggcactgaggaaagagaagatgggctcacgcgccacggccatgaccagaagtcagcccgcctctcactctaccacgtgagtctttaggtattttttagatgagggaaagggacaaggatgctaaattaccttttcattaagtttctaaacagctccacgattctctcctccagcatcggccggtgctgtacaatggggtcccctttgtaggaaactttttgctgcaactcctccagtttcttaatttgttgacgggtctgaagttgagattctgctaatgacgttatcctgccaataaattaagaaagatgctaattaccaaagtgaatgtatacaggtgagatggagaaggggaaggaaatactgaagacatggagaccactacaataagaacaaggaatttttttattgtggtgaaatatatatagcatgaaatttacaatttttcatcttaagtttacagttcagtgacattaagaaaagaggaatttttcaccatgttgggtggatgctgaaaaaataaataaaaaaagaaaataatttatttatttatttattttttgagctggagtgcagtggtgcaatctcggctcactgcaacctccatttcccgggttcaagtgattctcctgcctgagcctcctgagagattacaggtgtaagccactgcgcctggcctttttttttttttttttttttttgagatagagtcttactctgttgcccaggctggagtgcagtggcacagtctcagctcactgcaacctccgcctcccaagttcaagtgattctcctgcctcagcctcccaagtagctgggattacaggcacccaccaccactcccggataatttttgcatttttagtagagatgggattttgccttgttggccaggctggtcttgaactcctgacctcaggtgatccatctgcctcgacctcccgaagtactggcattacaggtgtgagccaccatgcctggccagaaaataatttattttaccttttattactagtcccttcctaaaatctcaaatttctaagagggggctgggcacacaagaagtattaaaatttataccactaggaggcattgatggagttatcactggaaaatgacaagcatctgagcccagatatgcagaacacgaaatatggaatttagcacttactttactcatcctaacttgtctatgaacataaagactcagaaaaagagattagacagctcccaaagatgggtttgagccagctctgtcacacactatctgtgcaagctttgccaggcccttcaccatcatgggccttagcatccccttgcatgaagagaagggcttgaactacatgagccctttcttttctttctttctttttttttttttgagacagggtcccactctgtggcctagtgcagtgcaatggcatgatcatagctcactgcctcctccaactcctggacatgagtgatcctcctacctcagcttcctgagtagctagaactataggtgtgtgccaccatgcctgtttagtttagtttagttttttgagatggagtctcactctgtcacccaggctgaagtgtaatggcacatgtctagttttttaaatttttgtagggatgggatctcactttgttgcccaggctggtctcaaactcctgggttcaagtgatcctcccgactctgcctcccaaagcattgggatttacaggcgtgagccacaacacccaatccccataagccttttcaatgtcagccttcaactgatcaaaggacatgacattatgtttcaaaatattgataacatgcacaaggaataagtgaatagagagggagaaaaagctcattaaatctatctccaagaatagagatattaggccaggtgcagtggctgacacctgtaatcccaaaaatttgagaggccgaggcaggtcgatctactaaaatacaaaaaaatagccaggcatggtggcatgggcctgtaatcccagctacttggaaggttgtgactaagaatcgcttgaacctgggaggaggaggttgcagtaagccaagatcatgccactgcactctaacctgggtgacagagtgagactctgtctcaaaaaaattaaaaaaagagagaagttagcatcattccatcattctttgatggtttatcactagtgtaacaaagaccaaaagaccagaaagacagaaagtgaaaggagagggagggggaccgctgcagggatttctgaactcctgagctcttttctggcacttctatcctcccattcccagaacttaagcttcttcgttccctggtcaggaagcatttaaaactgctttcagtaaattaacaacactcagggttagtgaggatatgaatagacaggcattctcatgtagagttgcgctaaatttccagtgcaggctctgtatctcaagtttctcctaaggcaagctggtgcaacatgctcactatagggccttgcacaggaagggttgcagtaagatatgctggatgaaggtaaaagtgcaaattacagaaaagcatataaaggaagatcctgggctgggcacggcagctcacatctataattccagagcttttgagaggccgaagtgggatgatcccttgagcccaggaatttgagaccagcccaggcaacaaagtaagaccctgtctctataaaaaatttaaaaattagccaggtgtggtggtgcatgcctgtagtcccagctactgagaaggctaaggtgggaagactgcctgagcccaggaggtcaaggctccagtgagccatgactgcataactgtactctagactgggtaacacagtgagaccctgactccaaaaaaagaaaaaaaaatgatcctaatataaactgtataaatttctatctttatgtgtatatacataatgtgtatatacataatgacagatgtctagattgagcatcaactaaattttaactactagtactgctgatgatttcatttaaaaattttttcttctcttgattaattttctgtatttgaattttttcccttaaaaagggcatgtgtcattttagattactaaaataactaaaattaaaaggtttgtctatctgttaaatacagttaaaccaaaagccttaattgaattattaagtaaaatatacttaaaatataataatataaatacattttttaaaacaaagtttctccaaataaagtaaaaactttattttatttttatttttttgagatggagtctcactctgtctcccaggctggttggtgtgcggtagtaagatctccgctcactgcaacttccatatcccaggttcaagtgattctcctgcctcagccgcccagagtagctgggactacaggtgcgcaccaccacgcccggctaatttttttatgtttttagtagagatgtgttttcaccatgttggccaggctggtctcaaactcctgacctcaagtgatccgcccatcttggtctcccaaagtgctgggattacaggtgtgagccacagcgcctggccgaaataaagtaaaaactttaattcttgggctaaatttgaatatggaaaagtccccacgttggagatatagtaccaattctgtgggcctgcagttaagatcagaattcaatctagctttcgagaaagaaaggaaaagcttctttcatcctttaccagttttctagccgatctaggcagatgttgggcgggcctccaatgcaggcaatctgttgccgcctcttccagtcagccagctcctcgtccgtgagagttttctgcacgtactccatcgctgacaaaagccccgccagctcactcacgatgctctggttggaaaccaaaacaaagtcagaaaacatttcctcagactgtctctaaccacattctttagtcaactccagagcaggaacttcttagaaaccaagcaagttctgccacaagacgctgaaatcccgcaagtgagcgagacacatgggggaagtggtccgacctatgcccttactctccgcatctggtccagcgcagtgagcatctgttccagctgctgcatcttctgcctggtcactgactggttgtttccattcagatcttgcatgtctgcgaaggaagaaaaaactccttgacctgagggaatactccttgacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactcctggacctgagggaatactcctggacctgagggaatactcctggacctgagggaatactcctggacctgagggaatactcctggacctgagggaatactccttgacctgagggaatactccttgacctgagggaatactcctggacctgagggaatactcctggacctgagggaatactcctgtccttaatgaccaggctcctttgaggacccgtacctcccttgcgccccgcccgccttaagatctaaacagagttaagacaaatgagtctttcaactcaacaacacaaactcactttctagagattttaacatctctaatattcacttgcctccttgactcttgagggttttatagttgaaatcaaagtcatcctggagattctctaccactttcattttctgttctagatcctgtttaaaataagcaaacaaaaaaacagaagtaaagaaagatttccttgggaacagaaaatataaagtttctgaggagaattcaaatgaagccaaaacctcaaaaaagatacatgcaggacctgcaggcagtatccccaagagaaggctccctgttggccaggtgcagtggctcacgcctgtaatgccagcactttgagaggctgagttgggaggatcacttgagcccaggagttcatgatcagcctggacaacacagggagacccccatctctacaaattttttttttttaattagctgggcgtggtggtgcatgcctgtggtcccggctacttgggaggatgaggtaggaggatcgcttgggcctgagaggtcgaggctgcagtgagctgtgatcatgccactgcagcccagcctgagtggcagagcaagaccctgtctcaaaaaaaaaaaaaaaaattaatgaaagctccctgcccgaggcttgtaacttgcatcacctgcactctcttccggacatcctgaaggtgctgctccagcatctgctgcttctccgtcaccacggctgctgtggggtggttggcctggcccccttgctgccaaaaaggaggtcaatgcacatgtgaacacagaactatggggagaggaatacctctacccagcttccatcccaccctaactacccttcttgtttggcttgagacgctgctgccatcacaagaggaagggaaacagaggcagtggtgctgtcactacacaggtgacactacacaggtcataccataaaccccctttatggcactaagagaccacatgttcagctaagacatggtctatgccttcaaaaacctcatgggcaagtatgtcaaaaaattcaaaacaatttatgacagcagatgttggatgtctacttaaacgtggtgtccagtatatttctgagggataataaaaaaaaagtcctgccctagggatgaaattccatattaaaagatattatcttggggagaaggggaggctggtaccttggaaaatgtcaaatagcacatggaaaaagaaaaagaagaaagaaggctggatgtagcagctcacacctataatatcagcacttgggaaggctgaagtgggaggactgcttgaggccaggagttcaaaactagcctagtcaacatagtgaggccccatctcgaatgaataaatgaatgaatgaattaaagaaataacaaaaaataaatagcatatgaaacttaaaaattacaggttcgtgccaggtgcggtggctgatgcctgtaatcccagcactttgggaggccaaggtgggcagattacctgaggtcaggagtttgagaccagcctgaccgacacggagaaacccatctctactaaaaatacaaagttagctgagcttggtggtgcatgcctgtaatcccagctactcgggaggctgaggaaggagaatcgcctgaacccgggaggtggaggttgtggtgagccaagactgcgccatgcactccagcctgagcaacaaaagtgaaactccatctcaaaaaaaaaaaaaaaaaattacaggcttgggctaggcatggtagctcccacctataatcctagcactttgggaaaccaaggcaggaggatcacttgaggctgggagtttgagaccggcccagggaacatagaaagagacctcatctcaaccaaaaaaaaaaaaaaatttttttttaactagctgggcatggtggcatatacctgtagttctagctacttgggaggctgaggtgggaggatcatttaagtccagaagtttgaggccacactacagccagttttatgggcaaccattctcttcctttcccatggtccctatccaagcccacagaatacaaacttcttagaagttttgggaaggtgacccatgcccctacttcttcccacagtgacagtgactcatctgattggtaagatggagagaaagactctgtgtacacacagatcttcaaagaacccagcacctaagctggtgcctccctcctctcactcttgccttcctagggcccaccataagcaagagcagcagcctggtttctagaagcaggtctagaggcctatccctctgccttgttggtctatggcagctgaagctccatatggatggctggggtggggtgggggtgctgctctgcacatccagtctctctaccccaagatctaactcagggcacaggcattggaaagcccctatggttaccagctcaagccacactttccattctagttttaccaacaatacagctgatgttttaaccttcattcctttctcatgtctatttctcaagcaggactacacttaaagggagaaaacatgattaacgatcacccacagaaacccacctctaataccttcgtaaaaaactgtattggctccccactgcttccagctataaacatctcaggccaacacagaaagctgtttcacacaattgataacttcaactttccctccctgtgccttggtcaccccagactcccaactcttccctgcatgcagtgtgtttccacactctcttcccacccgctatccactcagcatggcctgggcttcagcccaaacacacctgaactcactcaccttcaaattcagttcaaatgtttcttttcctgagaaatcttattcaacttccttagacaaaatgacacacatccttttctgtgtttttctcactttgagtgtttgtgtacttataatcccaactagcctgacagcccttggtagcagggattacatccactcttctatctttaaccaattctagacacttaagagcatgccaggtattgtaaacagaaaaaatagcagtgaggcctgggttgaggccacaaataaccaacttatagctttatatcaggggttgcaaactttttctctaagggacagagggtaaatatttttggtttcctgggtcatacagtccctgccacaaatagccctgccactgcagcaccaaagcagccacagataatgcataaataaatgagtgtggctgggttccgaaaaaacctcatttacaaaaacaagcagcaggctggatttgggccacgctcacagtttgcagacccctaatccgtacgattgaaaacatccttgggataactttggctttcctacctcccatggtaagttggagcctctatccaaattgacttaaaccacttatttttatcttgtggagcaggataaaatacaaaggttttccacagcagaaaatcctagtgctgcctgagcaaatgcctgtgtgctaacctcttgggctacagggcactgcacagtaagtgttacctaccacctcgctcacacctgagcatatcagttttctgcttaaaattcctcactagggccggacacagtggcttatgcctgtaatcccagcactttgggaggccgaggtggatggatcacctgaggtcaggagtttgagaccagcctggccaatatggtgaaaccctatctcactaaaaatacaaaaaattagcccagtgtggtggctcatgcctgtaatcccagctacttgggaagctgagacatgagaatcgcttgaacctgagaggcagaggttgcagtgggccgaaatcgcgtcactgcactccggcctgggtgacagagtgagactctgtctcaaaagaaaaaaaaaaaattcttcactgggtccccatttcctacagtaatggtgagggtgatgatagtgatgtcagcagcagcagaaagcagttaaattattttgcatttatgtgtcagatactgttctaagcattttacatgtatgaattaattctatgaagaaggtattgttatcactcccattggaggaacagagagagtaaaaattgtttacttaaggttacagagcaagtggcagggctgcgggttcaaaccgaagcagttggccccttgtggtaaactgctcttccagggccccactgttaggcatgactaattaaaacatcatgtggccttgactagcttgtcttccccgacccaatcagatgctgaactttctacacttctcccaagaatacacatttctgtttctgtctttgaacatgatcttctttctgcctggagagctctttctcatcagttgatgagcccaggagttcaacaccagcctgggaaacatggcaagagcccatctctaccaaaaaaaaaaaaaaaaaaaattagctgggcatggtggcatgtgcctgtagtcccagctactcataaggctgaggcaggaggatcgctagggcccaggtggttgaggctgcagtgagctgtgatcacaccactgcactccagcctgggtgacagagtgagactgtctcaaaaaaaaaaaaaaaaaacaaaggttacaaaggtaaatttgaaatgtaatgttatgtgtatttcaccacaattttttaaaaagcagggggtcacggagaaaaagaaaaaatgtccctgattataggatattaaagacggtaaaacccctcacagaaagtaaaaaagtctcctatgaccgactactttaatgatttagtatatgtgtttccagatattttcccatacataccaatagtatatgcaaattgcatacatttagttttactactatgaatcagatctttctttttttttttttttttttttcagtcggagtctcgctctgtcgcccaggagtgcagtggcgcaatcttggttcactacaacctccgcctcccaggttcaagcgattctcctgccccagcttcccgagtagctgggactacaggcgcgtaccaccacacccagctaatttttgtatttttagtagagatggggtttcatcatgttggccaggatggtctcaatctcttgacctcatgatctgcccaccttggcctcccaaagtgcttggattacaggcgtgagacatcgtgcctggcccagatctttactttcattacatcttctaacaggttactgctgctactgattaggggaactgcagattctaaaaatatttatcttgtatacaatggcctttctaaaccttgctagttccaattgttattgttagttttgtttctcttggatcttcgaggaagacctatctatctgtaaataataagagttctgtcccttgctttccaatatttgtaccctcatttctttttctttttgcataggctggatccctcagaaaagtatcaatggtaaaagacatccttatcttttgctgtttttactgagaatagtgtttcaccactgtgcatcatgctccctttggtttctgataaatattctttcttgtgtttagaaagatccttaattaagccaggtgcggttgctcacgcctgtaatcccagcactttgggaggccgaggcgggcggatcacgaggtcaagagatcgagaccatcctggctaacacagtgaaaccccatctctactaaaaacacaaaaaattagctgggtgtggtggcgcgcgcctgtagtcccagctacttgggaggctgaggcaggggaatagcttgaacctgggaggcagaagttgcagtgagctgagatcacgccactgcactccagcctggcaacagagcaagactctgtctcaaaaaaaaaaaaaaggctgggcgtggtggctcatgcctataatcccagcactttgggaggctgtggccggtggatcatgaagtcaggagatcaagaccatcctgcctaacaaggtgaaaccccatctctactaaaaaaaatacaaaaaattagccaggcttggtggcacacacctgtagtcccagctagtcgggaggctgaggcaagagaatcgcttgaacctgggaggcggaggttgcagtgagctaagatggcaccactgcactccagcctggacgacagagagagactctgtctcaaaaaaaaaaaaaaagagagatgaggtctcgctacattgccccagctggtctcgaactcctgaggctcaggcaatctgcccgtctcagcctcccaaagtgctgggattacaggcgtgagctactacacctggctgttttttaggttttgatatgaggatttttccagcctcataaaataagctgaaaacatcccttgttttcctatactttggaaaagtttgaatgatattggaataatctgtactatgaaagtttgtcagaacaggccgggcacagtggctcacgcctgtaatcccagcactgtgggaggctgaggcgggcggatcacctgaggtcaggagttcgagaccagcctgaccaacatgaagaaaccccgtctctactaaaaatacaaaattagctgggtgtggtggcacacgcctataatcccagctactcttgaggctgaggcaggagaatcacttgaaccctggaggtggaggttgcagtgagccaagatcgcgccattgcactctagcctgggtaacaagagcaaaactctgtctcagaaaaaaaaaaaaagaaaaacaaagaaaatttgtcagaacaaaacaaaacttttaaaccattgggtctgttggattcttttggtggaactttcttttttttagagtttttcaatgtattttggggggtggaactttctttttttttagagtttttcaatgtatttttatgattattgatctatttaatttcttttccttcttttttagtagatctaataatttatctcattataaagttgtttgattttccattcctcccagaccagggatttgttttgtctcaggtctcacctgggccgcagtggctgcagtctgtagaaggcgtgattcttcccacaggcaccgggccacaatccgggcaatctccattggcttctcaagatacctgctctataagtaggagagaaagagaataaaaatcagcagcagaccatggagatgtggactgaactgtggcaccttaaaactaatgtattcatcaaggaaagcatttattctaggaaacaacggaacaaaggcttcagagcctgggtgaaggctctctgtcggcggggggcgaaggggaggtcgttactatttctgtaacagaaggcacattagcctgagtcttttttttttttttttgagactggctctcactctgtccgccaggctggagtgcagtggcgcaatcacggcttattgcagcttcgacctcccaggctcaaacaattttctcacctcagccttctgagtagctgggactacaggtgcatgccaccacaatcagctagtttttaaaaaaaatttctgtagagatggtgtcttgttatgttgcccaagctggtctcaaaactcccaggctcaagcaatcctcccacctcaacctcctaaggtgttgggattacaggcgtgagccaccatgcctggccttgtctgagtctttacacagtatactatcctggtcttgcagggaagctactgacttagtcaagaagtatcccattatggtcaaacatttaacatgtaacagtgagagtcatcttcctatcagtggaccgcgttaacatgctaacatgtatgattaacataacaatcactttattacttcaactgtgacaagagaagtgattctcaggtaatgatgctcacgggtaagtatacagagctttgagaaagggctaattacttctcctgtgattgaaaatacaagatagattctcgttacttagccaaatgagaaaagagatgcttccaggaaagaacactaacacccgactctgcgggtcctgtttctccttgtcctcagtttctcatcatacctgaagaaactgcttgattcttcgtagattgtgctgatagagaacattcgactcttgcaggaagcggctatactgctggtcaatctctcccaggagattatgaaacaccaaagtggcatgtgattctttgctggccgcatatgccctaggaaaaggaagaatgataaagaatggctctgaagccgacgcatacacacaaacacagaaatcaccatcaagaaagaggaaaaaaacaaaaaaacaaagcaaacctgatgctataacccattcatcatgttagattcttcttgctcagcaataaaatgccatcaatgtaataattattaacaattattccaggccaggcatggtggctcatgcctgtaatcccagcactttgggaggctgaggcaggcggatcacctgaggtcaggagttccagaccaacctggccaacatggtgaaacgctgtctctactaaaaataaaaaattagccaggtgtggtggtgggcacctgtaatcccagctactcgggaggctgaggcgggagaatcgcttgaatccaagaggcagaggtgcagtgagccgagactgtaccactgcactccagcctgggctacagccagactccatctcaaaaaaaaaaaaaaaaaaaccacaaaacaaaaaaacaattattccagatattattacccactctcataatctgttgtatttgtaaaatatttgagcaaagtagacagatatgctgttttgctttaaaccctcaattaactctggtcagatttattagtacaaataagtaatcccaggctgggatggcctatctccaacatctgtgaatcacctcctggcccttcaccaaatcagagtatgcattctggaaaaaccaggtcatattaacactggcctgaattaaaccaaaatcagtagtgagcctgagcatattaaagtgaagaaaatagttgctggacatctgtgccattatctgctctatgaatggaatctacttcccttatcctgtgatctagtttggatctacatccctgcccaaatctcatactgaaatgtaacccccactgtttgaggtggggcctggtggaaggtgactggatcatgggggtgggtttctcatgaatggtttaataccatccctgttgatactgtcctcgagacagtgagttcttgtgagatctgatagtttaaaagtgtgtggcacctcccccttgctctcttgctcttgctgtggccatgtgacctgcctgctccctctctgccttccgccatgattggaagcttgctgaggcctccccagcagcagatgctgctatgcttcctatatagcctgcagaactatgagccgattaaacctcttttcttataaattacccagtctcaggtatttctttatagcaaattgagaacagactaatacacccctgtggctccttcctttaactaaaggggaattacaagtatcaacccaaagttctagctatgacagaattcacattcagagaaaaaatatgtctaccacatcactggattatcagaatatatagaggatctgcccaagtaaatgaggtccaaatcaaccttcaagacatccaccaccatacaggcggtttcaatgtgtcaaagacagttgcccacatgcccttctaagataaaaaaggctttacaagaccaaagggtgcccctttatctcctgatctcattttccccatcacctgtacccatacattttttaatggaacagcaaggcatgacattaagagttcatgtctcttgactcaaactgaaacctaacaatttggagagtcacttaagaaggacttaccaatcttgactctcaatccaaggggccagaaactgccgcagctccattgggaagctgtcactgtagagctgatggagctgctccaggtaccgtgtgtcaagctgctgtagctgattccattgggccatcctgctaaaatcaggggtcccaactgtaaaccaaagtgtgcatatgttcaccacaagtcccagtaggggtaaacaatctagaagtagccattgcccaacacaggtgtcaggtctgtgactagggataaagatgctctggggaggaccctgcttctttctcccagtttattttatttttaaaaaatagagatggggtctctattttttgcctgttgcccagggtggccttgaactcctggactcaagtgatcctcccaccttggcctcccaaagtgctgagattacaggcataagccaacacacccagcctgtttctcccagtttagaacaatacaaacacattcacaatccccaccttgggataatcacagctcctttttattattttttgaagacagagtcttgctctgtggcccaggctagagtgcaatggcatgatcatgggctcaagagatcctcccacctcagcctcccgaggagctgggactataggcacacaacaccatgccacactcattttttaaaaaatgtttcgtgagacaaacaaaacatgcccaggctggtcttgaactcctgggctcaagtcatcctcctgcctcggcttcccaaagtgctgggattacatatgtgagccaccccatctggccacacatctcttttacactgggatgacaagtggctattatgccaggttctagaatccattatctaccagaagtgtgtgaaattaaaaaattacttaactcccagatttctattcccttgtctataaaatagagataataattcccactcctcagaggtattgagatattcctacagcatccagctcagtgcatggcacataacagatgcccaacaaatgtcggttcctttctttctcctccacagcccttttagttatacacagtaaacctgtactgtagccaaaatgtagaaattggatgtttggggttgggggacagagcactaattccaagactacaggtttaaaagtataaatgaggatccaggaagatctgcctgagattctcctactcaacaaataataactattttaaaaattgcttagtctgggacaacagagaaggaaagaaaaatgccaggcataaaagttgtcccaggttcaggaacatcccagtgaaatgctctggtatgagaaacccagccagctaattacctgtaatcctctttctgaatagcatgggtcatggaaatatcaatagaggccaagttgttttaacaagttctaaaattaggccaggcgcagtggcttacgcctgtaatcccagcactttgggaggccaaggcgggcagatcacctgaggtcgggagtttgagaccagcctgaccaacttggagaaaccctgtctctactaaaaacacaaaattagccaggcgtggtggcacatgcctgtaattacagctactcaagaggttgaggcaggagaattgcttgaacctggaaggcagaggttgaggtgagctgagatcgtgccactgcattccagtctggcaactagagcaaaactctgtctccaaaaaaaaaaaaagagaagttctaaaaataattacaagtcagagccaaagatgaaggtatgtacagaccaaggtccaatgagatggttctctgggatagtgagaacatttaatgagagactgaacacacgcaaacatactagagttcttgattctcagagaaggcacgaagaagcacctagttagcactggctttttcataaaaatgactgagcaaactggcaacaaaaccagcaggtcttctgttctcaaggcagcaaatgtaacggaatgaaaggtgcgatcgtggaacctctaactcctgcaacctctaactcctgggctcaggcaatcctcctacctcagcctcccaagcagctgggagtacaggcagcattgctgcacctggctaatttttttaaaaaaatttttgtagagatagggtcttcactgtgttgcccaggctggtctcgaactcctgggcttaagcaatcctcctgcctcaacctcccaaagtgctgggattacaggcgtaagctaccacgcctggcctgggatcaggttttctgacagaacctgagagggctgcacttctccctccctctttgggggacagactcagaatacccctcttgctactgtgaagacggctggtggagctctcaagcatatattcagggaagtgcaggtagtacctcccagcagtctttacattgaataattaataatctaaggcagcagcatccaacagaaatagaatacaggccacacatgcattttaaattttctggtagccatacttaaaaagttaaaagaggctgggtgcagtggctcacgcctgtaatcccagaactttgggaggccaaggcaggcggatcatgaggtcaggagatcgagaccatcctggccaatatggtgaaaccccgtctctactaaaaatacaaaaattagctgggtgtggtggcacatgcctttaatcccagctactagggaggctgaggcagaagaatcgcttgaacccaggaggaggaggttgcagtgagccgagatcgtgccactgcactccagcctgatgacatagcgagactccatctcaaaaaaaaaaaaaaaaaagaaaagaaaagaaacaggtgaaattaattttaatgtattttatttcatttaatatatccaaaatgttattgcaacatatgaacatacaaaacatattattatttatttatttattttttggagacaggcactctgtcacccaggctggagtgcagtggttcaatcacagctcactgtagcctcaacttcccagctcaaacgatcctcccacctcagcctctcaagtaactgggactacagatgcgcaccacatctggctgattatttttgtagagacggggtcctactgtgttgcccaggctggtctcaaactcctagactcatgcatctcagcctcccaatgtgccaagagtataggcttgagccaccgtgtccagcccacaaaaactattaatgagatactttacactcttttttttgctacgaagttttctaaatctcctgtgtactttacatgtgcagcacagctccaaggtattttccctcctcatgtatcaagggcttaaattccactggtgaaaaagctcagtaaagcaaatagagagaatgtcagaataaggtatttgccccaattaggccaatacgcttctataaattaactaaatattccaacaatgttattttgttgttattgtttttgagatggaatcgcctaggctggagtgcagtggtgcaatctcacctcactgcaacttcagtctcccgggttcaagcgattttcctgcctcagcctcccaagtagctgggattataggcacgcaccaccatgcccagctaatttttttttttgtattttttagtagacagggttttaccatgttgcctaggctggtcttgaactcttatcagttcaagaccagtctggccaacacagtgagatcctgcttataattaattaatttaaaaatgtaggctgggcacggtggctcacacctgtaatcccagaactttgggaggccgaggcgggtggatcacgaggtcaggagttcgagaccagcctggccaacatagtgaaaccccgtctctactaaaaatacaaaaattagccgagcatggtggtggccgtctgtaatcccagctactcaggaggctgaggcaggagaatcacttgaacccgggaggtggaggttgtagtgagccgagatcgcaccactgcactccagcctgggcaatacagcaagactccctctcaaaaaaaagcaatgttacttgccaccttccaccctaagattcacctgccacaggacaaatgctgcctgggcagtggtacaggtacactaagcactagccagagtaaaagcagtggctgacgtgcatactatatgctgaagcattgtaaccatggcatgtattgattgccctctgtaagaaatcaaaggccattagatctctcttacaatatttgcattagggccaagttaaaatctgcctcacatggaggttgcagtgagccaagattgtgcatctacactccagcctgggtgaccaagtgagactctgtctcaaaaaaaaaaaaaaaaaaatctgcctcatagactaaaagcatcatgacctgacttatgctatgcaagaactgatgtgcatacaaagaaatctgcataatatgccaatttatgtagattctattgcatacaaatttactgaaactctaaacctacacagtccagtatggagtcactagccacatgtggctactgagcacttgaaatgtggctgcttcaaactgaactatgctgtcaatataaaatacacactggattttgaggacttagtgaaaaacaaaagaatgtaaagtatcttgttcatgttgaaatgataatattttagatatattgggttaaataaaatatattattaaaattaacttcacccatttctttttacttcttttaatatggctactagaaaacttaacattggtagggcatggtggctcatgcctgtaatcccagcacttagggaggccaaagcatgtggatcacccgaggtcaggagtttgagaccagactggccaacatggcaaagctccatctctactaaaaatacaaaaattagctgggtatggtggcacatgcctgtagtcccagctactcgggaggctgaggcaggagaattgcttgaacccgggaggcggaggttgcagtgggccgagatcgtgccactgcactccagcctgggcaacagagtgagactgcatatcaaaaaaaaaaaaaagaaagaaagaaagaaagaagagaaaagaaaagaaaagaaaaagaaactaaaagaaaacttaacattacatatgtgacttggatcttatttttattgaacactgctactctagacaatgtagccaaaaagcggtggttctcctaaaaaaaaatgatttaaaaaaagaaccaactgctttttgtaataaactccagtgtttaaaattaattttaaaaacagactttattttttgagacagggtctctctctgtcacccaggctggagtgcagtggcaaatatagatcactgtaacctccaactcctgggctcaagcaatcctcctaactcagggacctgagtagctgggactaggggcacaagccacaatgttcagctaattttttgtagtttttgtagagacaaggtctcattttgttgcccagactgatcttgaactcctggcctcaagcgatcctcccacctcagcctcccaaagtgctgggactgcaggcatgaggcatcatgcccagccaaaaatagactatttaattatttgtcttggatacaaatgcagaggcatcacagtctactccctgaaggtccaaattaaatcatgaaacagcatcccactatacctgctccatcatagattaacactggggtcatgcatgaatatttgcattttcaaactaacatatcctaaaaacgtgtaagttattgaaaattatctaattcatttccagtacataactaaggattttttggttgttgctgttcttatttttagctggggacagaggagggctagtaagtagtacaataattgtgttcttttttttttttttttttttgagatgaaatactgtcacccgggctggtgtgcagtggggcgatcttggctcactgcagcctccacctcccaggttcaagcgattctcctgcctcagcctcccgagtagctgggactacaggcatgccccaccacgcccggctaatttttgtatttttagtagagacggggtttcactatgttggccaggctggtctcaaactcctgacctcgtgatccgcccgcctcggcctcccaaactgctgggagtacaagcgcaagtcatggcacccggcctgtgttatttcttaaaacagaaaccagctagtagttttttccataaaattaaagcaccaggctgggcacagtggctaacacctataatcccagcactttgggaggctgaggtgggcggatcacaaggtcaggagtttgagaccagcctagccaatatagtgaaaccctgtctctactaaaaattcaaaaattagccaggcgtggtggtgggcgcctgtagtctcagctacttgggaggctgaggcaggagaatcgcttgaacctgggaggcagaggttgcagtgagccaagatcgtgccattgcactccagcctgggcaacagagtgagactctgtctcaaaaaaaaaaaaaagaaggcaccagggcaccaacaatgactgatttcatgttttacttcttagtctaatcaccataggtaatactttaatagttattctacaggggaaaataaaagtataacttaaagccaaagaccaggtagtattttcaaggagagaatatgcaaatacttccatagtcttctccttacaggctgcttagctacaaaccatatttaattaacagcagtcacaggagatgactagccaaagtgtctaggaaaatcactgccaagcagctttactgtaactgttttactggaaaagacctcaaagagcccatgttatttcacaatttcaattttggtttttcaaattacaagttaatctaaagaactccactaagttctaactacattacttcatatctacggaataattctaagcctgtgggtttttaaaaaaattttattagacattctagaattgggcaacacttcattcaatgccataggatgaatgttctccccaagcctgtgacttaataactacttcattgagccccagaacacacaaagttatctgaggaacaacttgagtgccaactaccactctgggtgcataagagagaagacaattcattactccatataggctgccttaggacattatatggggctcaattcaaagcatttactcaggttaagtcagcagatagtagatgcactgtacaaaggcaaggtgggtgtaatcctgttttctataactgaagagaaaagaaaaaaatgaaacagcaagtcatcaaagactttttggacttttcaaaacaggaatttctcagtcccttggggataacctaccaacagcaagtcataaaacaaataactattgtctaattgggaacttattaccgtaaagatgactgaaaaagtctgtccaaagttacagttctcatttatatacttgaatctaatgaaaccaaaagatatattgagaaacgcagtcaagaccacttacaaaagggatttactacacagcttcataaaactttttaaagttaagacttgtacttcacatccatgcactagtggatttacaacgagggtgagggaaggcggaaagagagacgaaaatcaggctcatacaataatccagaacagaaagtgatctaaagataacttctgttccactttgcaatgtgtcatgacattttcctttgggtaccacctatacttttattataaatacatgcattttaaatagagcatacctgtgttttatctgctgcctacactaacctcttctttgctgtcaggaaaggcccagtgatcaaggcaaccaaagtataaagaaacacagaagatttcttgcactgaattctataggaaccagtccttttaagagatatgtttgaaagattataaaataatgttcaatgtggaaaatttagaaaaatataaaaaagaaaataaaagataaaaacatccatatcccaccatcccactatgcagaacaaaaactgacatgttgccaggtgtggtggtctgtgaccccagcactttgggaggctgaggggggaggatcacttgaggccaggaagtcaaggctgcagtgagctgtgattgcaccactgtactccagcttgggtgacacagcgagaccctgtctccgaaaaaataaaaattgacatgttgatgtaattcctttaaatctatttcagaatgtgtttgtgtgtgtgtatatatatatatatatttttttttttttacattggagtcatagcattaatacagctgcatattcttttaaagtttattgtgtagtaaacatttttctatgaaaagagtattgtgtttgtttgtttgtttgttcaaatagagaccagctgcccaagctggtctcaaactcctggtctcaagcgaccctcctgttttggcctcccaaagtgctgggattacaggcgtgagccacagtacctggcctgaaaagagatgttttgttattgttgttgttgttgtttgagacagaatctcactctgttgcccaggctagagtgcagtggcaccatctcagctcactgcaacctccatctcctgagttcaagtgattctcatgcctcagcctctggagtagctgggattacaggcatgcgccatcatacccggctaatttttgtatttttagtagagacggcgcttcaccatgttggccaggcttgtcttaaactcctgacctgaggtgatctgcctgcctcagcctcccagggtgctgggattacaggtgtgagccactgcgcctggcctgaaaagaaatttttatttaaagcgcataaaagaactattttgtttctattggtgttttcaatacaaccctgctaatcccactgagggccacataatttattaagatttggaaaccccaatttatttgttctcaccataccacgttctaaaaataatctgaagtatctgcaagtagattaggaaggaaaaaaatgagaaaagtaagagaaagcaattcacgctagagaaaaacattcaatcttcataaaattttcaccacaggataaacagcataatggatgacagagagtccacattaaaatactgtaggccaggtgtggtggctcatgcttgtaatccttgggaggctgaggagggtaggtcacctgaggtcaggagttcgagaccagccaggctaacatggcaaaagcctgtctctactaaaaatacaaaaattagccaggcatggtgaaatacacctgtaatcccagccacttgggaggctgaggcaggagaatcacttgaacccgcgaggcagaggttgcagtgaaccaagatggtgccactacactccagcctgggcgacaagagcgaaactccatctcaaaaaataaattaaataaataaataaataaatactgtagctttaaactattagagtcattcataatttaaccattcataattactctagacattaagaatggaatttcaagtttaaaacataactcaaaataagtacacttatatagtaagcacacaatttcatagttttaagtccaaatagtacctttgtaagatttaagactagatacttgcaataagaagtctatatataaatctagttttgatttcctaaagagacaaaatattaacacttgagtgcccaatctgaaacaaattactataattactgtaatgttcaattacatataacaggatttgctttaaaattaaaaaccaatgacgatcaagcttgtaaaaatgaacatcaatctataagaaaacttgagttatagttccctactaatatgacaaaatttgaatatatgaaagaagtaaaggccaggcatggtggctcatgcctataattctagcactttgagaggccaaggtggaagagggattgcttgagctcaggagttcaagaccagcctgggcaacaccgtgagaccttgcctctacaaaaaaatttttttaaaattagcctagcatggtggcccatgcttgtagtcccatggaggctgaggcaggaggatcacttgagcagattgagactgcagtgagctgtgatcataccactgcgctccagcctgggtgacagagctagaccccatctctaaagaaggagcaagagcttaacaaacctaattccctctaaattaaaagtaacaaacatgatttgtcaattactgagtgcacagttgattgttaaagctgcctaagaacaggtctgagctctacaaaaactaaaactaaaacaagaaaacccacaaaacagaccaaatttgtgcatcagatgacctccccacttgggaacacttccacttccccaaccagacacattcctctgtatcagtgtggtgtgggggaaaggacagtagagacgggagctggatgggcctgggtgcaaaaccctgcctgacatttattagctatttgtctttgggaatggtatttcactaccaaatgggctttctcttcagtaaaacagggaactctctctcctttgaagaactgttgtaaagttaaaatcaataatggttgtacagcatccctctgtgctggtgctgctggtgccagatcctcagagctgcagttattgttcctttcccccagggtctccctttcatggacatttcttactttttttttttttttttttgagatgtagtctcactctgttgcccaggctggaatgcggtgggcacaatctcagctcactgcaagctctgcctcctgggttcacaccattctcttgcctcagcctcccgagtagctgggactccaggcgcccgccaccacacccggctaattttttgtatttttagtaaagagggggtttcatcgtgttagccaggatgatctcaatcacctgacctcgtgatctgcccacctcggcctcccaaagtgctgggattacaggcgtaaagccaccgcacccagccagatatttcttatcttaaacccatttccttagtgtcctggaaagcaggttaatccatcagattcactaggggttaagtgtgataatcactaatcagctttccctgctaagtaaaatacatgcatttcaatgcacactcttatcatatcgggagggaaggagtcagtgatgctgtgatttggcatgttaatttaaggagagaagggaggtcaggagagctgggtggtgacctgatcaaatatctccatacgtatttcacctaggatggctctaggtcctaaaaagagtaaaaggtgaaaacactaagtgatattcaaaacaaaagaaaaagatgaaaaataagaaccttggttaaagagcagtcgaaataagtaatgattatagctatgatttatatagcactttttacaagaagccaggcgctgttttaaacacttgacatacttatttgctcatttcataattgtaacaaccctatcagataggtactatttttatcccactttacagaggagaaactgaggcacagaattttaagtgatttggccgggtgcggtggctcacgcctgtaatcccaacactttgagaggctgaggcgggtggatcacgaggacaggagatcgagaccatcctggctaacacggtgaaaccccgtctctactaaaaatacaaaaaattagccaggtgtagtggcgggcacctgcagtcccagctacttgggaggctgaggcaggagaatggtgtgaacctgggaggcagagcttgcagtgagccgagatcgcgccactgcactccagcctgggcggcagagcaagactccgtctcaaaaaaaaaaaaaaaaaaaaaagatttttaagtgatttatccaaagtcacaacacaggtagtaaaggcatggagctggaatcataacgcacagtctgttttcggaatgtctgttcttcaccactataggagtcttgttttttcttttttttaaattagagatggcgtctggccatcttgcccaggctggtctcgaactcctaggctcaagcgatcctccagcctcagcctccaaaagtgctgggattacagatgtgacccaccgtacccagctactacaggagtattagaaagtgggaattttggccaggctcagtggctcacgcctgtaatcccagcactttgggaggctgaggcaggtggatcacctgaggtcgggagttcgagaccagcctgaccaacatggaaaaacctcatctctactaaaaatacagaattagctggccatggtggcacatgcctgtaatcccagctactcaggaggctaaggcaggggaattgcttgaacctgggaggcagaggtggcagtgagccaagattgtgtcattgcattccagcctaggcaacaagagcaaaactccatctcaaaaaaaaaaaaagaattttagttgatttttaagtaacccacaaaccaaccattgtaactagccaatgtgatcttatggtattttaatagacatactagtacttggattttgaaggatctagtagtctagctgtaacagacccacatctggatgctattctaattctgtgtatcaaaattgaaatggaacactaaaacaaccaaacacatccagggagggacaaccagggtgtgaggagttgaagaccttgaatattttgctcagcaagaagatgcaggcaacaggagtgaggttaggagagaaaaacatgaattacagaagagtggcccctcaaatacctggaaatctgtacgagaaaggataaatcactctaggactagaacctgtctcctcacaacatcttctcccaaattcttccccatgaagtaatacagaggtctccaccctggctgacactaaaaaatatatacagcaagaaagatgcctgggaaccaaaccagtgccaaattggaacctctgacagtgggaccaggtttcaaatttcgaaagctacggctgggcacggtggctcacacctgtaatcccagcactctggggggcctaggtgggtggatcagctgacgtcaggagttcaaaaccagcctgaccaacactgtgaaagcccacctctactaaaaaatacaaaaacattagcaggcatggtggtggatgcctgtaatttcagctacttgggaggctgaggcaggagaatctcttgaacccgggaggcggaggttgcagtgagctgagatcacgccattgcactccagcctgggcaacaagagcaaaactctgtcaaaaaaaaaaaaaaattcctcagatgatgctaaagtgaggccaaagaataataataaattttttcgtgatcattaataaatataacgagaacctcgaaatcagagcagagatcagggctcaactctgaatacgcctcagaatctcctgaggagctctacaaagccaggtgccagttcttagcccagaactagcaaataataatctccagggttctaatgaagcagtacactgtagagactgtacaaggagaccacggcagaagaggaggctggagaaggctctcctgtcaagatatctgcactttcttccaagggcaatggggtaagtctttgaaaagctttaaacagacaagtgatagtttgatttacatttcaaaaagatccctcaggctgcaataatcctggtgggaggtcgtggctgcccaatttaggtagcagcattgtaagtgttttgaggcagacatccatcttctgtgacattacagagctacatgtgatgggacttggtgactgactgaagggcaaaggtgactcagagaaagggaggagtaagtgacaacctcccaggttcctgtggcatttggtattcagatggcggtcacatgctcagcatggtaaatgtcatggcaggagtgccaacattgagagggcaattgggccacacagtctctaaaaactgtttgttctataaattactgtcaagctcgattccctcaagacattacagccacagcaactcaaaataatactgtaggaaaagcaagtagatatttaaccaaaaagggttcagggtttgtactccagctgaatggtaaaacctgccatcccctcaggaaaagaggcagaggcaagagaaaaatcaggcagaaacatcagagccaaaatgcatagggggccatggcaagagctgttaactgtctcccaacatctgtgtgcttgcctccaggccattttccacactgtgggtagagagaccttttcaagacacaaacttgatcttgccacacccctacttaaaaccctcctgatgactgctctgttcttaggctaaaaaacaagatttgttatcttaaggcagaatagcatggatttgaatcctggttccaccacttcgatcacttagcgtgtagctggtgccagttatttatcctctttgtgccttaatttcctcatctatagaaaggggagagaacagtgcttacctcacagggttgctgtacaaattcatcgagctaatgaacacgtagcactcaggagcccaatagcgtgcagcatgtaagtgtttgtactcattactagcatgaccgacatcctggctggctctgcccctctcgtatggctggtaccagctggtggctaagttcctggcactcactctgctccttcttcaggtcctcaaaaacaccaggctcctgcctgccactggccctcacacatgccttccttctatcaccatcaccatgacttgcacccaagtactgtgactccattaacttggactcataaccactatgctggactgaaagccccatgaagacaagaagagtcttggcttttgctcactagcgtgtcctaccctgaaccctggcatccagcatagtgtctggctcataataggtgctgaaaaaataggtattgaatgaatgaacgactggagtgaattacaactaaagtgtgtagccaggttctcccaagtgaggacactgcgcccaattagaaaatattctgaggaataggccaactcttccagttttgctgtttgaaaaattcaagaatgatcaagaatcactgattcaagaataatccttcagtgattcttcaataagagtaaaatcacagcactccccagctcaaaaacacacactaacatctcattgtccaatgcaaaatctttacccttatctcaggctctgtaactactcagccaactttagccccttccagttcctctctccagcctacagatgactttcattttttgagacagggtcttgctctgttacccaggctggagtgcaataatacgatcacagctcactgcagcctcaacctcctgggctcaagcaaccctcccacctcagcctcctgagtaactgggattacaggcacatgccaccatgtctggataattttcttttttttttttttttggtagagactcagtctcaccatgttgcccaggatggtctcgaactcctgggctcaagttgtcctcctacctcggcctcccaaagtgctgcgattataggcatgagccatggcacccagcctccaggtgactttcataagtgttgtcttccttcaagtcaacttatctcctccttgccccccacccacagactttgttcctttttcatatttgttcttgcctaaaatgcttttttctctgggtggcgttatccatccctttcttgtgtctgtcagacaggctctccctaaccccacccctagtccaatgactgctttcactctgaatccccacggtacatatataagcatctgaggctctttcctattggctttgattctacctccttcacttgaggagcagctctctgctggcaaccacgtaccatcctgatttagaacttcccacaggctaacttaagacaccaaataaacacttgcacacacacataaccaccacctcccattacagaagtacacctcccctactgaacagatgatggccacgatactgaaaagcatggcatcaacatgacaactgcatcctgaaagatcagcctatatataggtttggttatcttgaatttcgagtttggagagaagcaaagtatttttctaataaactgtgaatgctgaggaattcaccttcataggagtcagaaacaggctgccaaacttttcaaaagaaaaacagtggtaggttgagcaagcacattgtcatgtcagattttccaggctcgagggccactgaagggagaagagcgagtagctggaaaaaacctgtgggtactgttatctttggccaaagctcaaataaaagaatcacaaaaacatccactgatctaaaatgctatgtaagtcattaatattcatctaagagaggcaactgaaataaagcagataaagagaacttaagccattctcttacctcagcctcccaagtagctgggattacaggtgcccgccaccacacctggctaatttttgtatttttcgtagagatggagtttcaccattttggccaggttggtctcaaactcctgacctcaagtgatctgcctgccttggcctcccaaagtgttggggttacaggcgtgagccactgcgcctggccaagaatttaaatttctgagtctcaaagtcataaacctataatatggctcaatgcttacctcagtgcttactggagagaaggaagattcttttctcaaatttattcaggtcactttccctatacgaaatactaaggtagtcctggtcacttacatggaacaatatacctggggctgacgatgcttggatatatagaagtccttcagtcaaaggaactatgaacttttgaggcagaacctcaaattcagaaggcatttgtggtggttggataacatggccctaaattctctcattatgccccactctctgagaggagggggtctttgttcccttcctttgaatctagctaagtccataactgttccaaccaatagagcatgctgaaagcggcgagatgtcatttccacctgatttcattggaagtctcattctccagaaccagccacattctgtgagaaacccaaggcaaaaggggaggccacaagtaggcacgtggtctacagtctcagctgaaatcagcctttgagtcatcgcagcccagacatcagatacaggagtaaagaaaattccagatgattattacccccagccgcttgagttttctcagtgagacctcagacatcgcagagcaaagacaagccatccctgctgttatctaaattcctgcccacggcatcttcgaacatagtcaaatgattgctgctttaggccactaagtctgagctggtttattgcattcggcaactagaacaacatttttactaacatagtgattgaatgtagacttaataatgaaagagtccaacttccataagaaaaaaattcataattttaaaggaagaggctttgctgttaaagttttttttttttgtttttttttgtttttttttttgagacggagtcttgctctgttgcccaggatggagtgcagtggcgtgatcttggctcactgcaacctccacctcccgggttgaagtgattctcctgcctcaacctcccaagtagctgggactacaggtgcccggtacaacgcctggctaatttttgtattttcagtagagacagggtttcaccatattggccaggctggtctcaaactcctgaccttttgatctgcccaccccagcctcccaaagtgctgggattacaggcatgagccaccgtgcccggcctgttaaagctattttaatagtaaacttattttctctatgcactcctttctaaattattcagccccactttctttcaaaacaacgtttatacactgacaattctcaaatttatgtctctagccccatccgctaatatgaacatcagacacttatagccaactgcctcttcaatatctccacctggatgtctaaaatgcatgtcaaacttaatgtatccaaagccaaccccttcattaaaaacctctcccagccggcttctcctccagtctcccccattctagcaagtgacaactccattcctgcacatgttgaggctaaaaaccttgaaatgagccttaacttcaactccagtctctctctctcttcctccccctcctcctgccacacctaatccattaacaaatcctgttggctctgtcttcaaaatctggaagtgaccgggcacaatggctcaggcctataatcccagcactttaggaggctgaggcgggtggatcacttgagctcaggagtttgagaccagcctaggcaacatggcaaaaccctgtctctacgaaatatacaaaaattagccggatatagtggcgcaagcctgtgatcccagctacttgggaggctgaggtgggggtatcacttgagcccaggaggcggaggttgtagtaagctgagattgcaccactgcactccagcctgggagacagagtaagatcctgtctcaaaaaaaaaaaaaaaaaaaaaaaaggaaggtgagcctttctcacaacctcccactgacgcagccttaatccaggccaccagcatctcttacctagatagctggactaggctaactggcctggatgctttcatccttgtccctctaccttctattctccacattacagatcctttcaaaataagagtcctggctggcacggtggctcaaacctgtcatcccagcactttgggaggccaaggcgagcagataaattaaggtcaggagttcgagaccagcctggccaacaaggtgaaatcccgtttctactaaaaatacaaaaattagccaggtgtagtggcaggcgcctgtaatctcagctactcgggaggctgaggcaggagaagttgcttgaaccggggaggcagaggttgcagtgagctgagatcgcgccactgcactccagcctgggtgacacagcgagactccgtctcaaaaaacataaacataaaaataaataaaaaataaaaataaaaacagaaattcgccggcatggtggcccaagcctgtaatcctagctactcgggaggctgaggcaggagcatagcttgaacccaggaagtagatgttgcaatgagccgagattgcgccactgcacttcagcctcggcaacagagcaagattttgtctccaaaaaaaaaaaaaaccagagtcagatcatttcattcccctgctcaaaacccactcaggaaaaaatccaaagtcctaccacggcccaccagtcaatccattttgccccagatgtctctctttgcctccttccctacaactctccccttgctcacagctgtcccctctctgctcctggaacacaccttgcccgtttctgccctaggactcttctctccacctgataggctctttccctagatatctccatggcttgctccctcacttcgttcaggtctctgcacaatgtctcttgacacccctctatctaaaacagcaacatctcccctgctgaattctcctttacagtactcatcgccctccattgttcatatatttcttttttcatgtatctccttccaatatgatcaactaggaacttaagccccataagaacaaagacattcttcagttcactgctatttccccagcaactacagaatgctcaaatatttgaataaatgaatgaaaattaagtaagtttttcaaaaatctagaacacacttttagcatagagaaaactgaagtaccataggaggttaattcacttcatataacagcataaactgcccttccttaagtaggagacaataggtacaataatgcatgcaaatgttaagtggtaaagcaaacatacaaagtttcccaatagaagagtttaaattaaaatctaaacttccagccaggagcagtagtggacgtctagtcccagctactcaggaggctgaagcaggaagatcacttgagcccaggaattcaaggccagcctgggtaacataggaagaccccatctctaaaaacataaaaataaaaatctaagcctcaaaagaaaaaaaataaataaacaaaaggcatttcctataaagttaaactgttacagaattgtttttcttaaactgcaataatgagactttagcactctcttgtcctctaaaagacattatttcatgacatgtgcccattggcagtatttgagaatctaagaaagtagatcacactaaatattgatatgcagacactaaaatcgtacaaccacttggatgactaggtttgagatattcccaaagtgacaggtttttgttttgttttgttttgttttttgagacaaggtctcgccctgtcgcccaggctggaatgcagtggtgcaatctcagctcactgcaacctctgcctcctgagttcaagcaattctcctgcctcagcctccctggtagctgggactgcaggcatgcaccaccacacctggctaatttttgaatttttagtagagacagggtttctccacgttagccaagctggtctcgaattcctggcctcaagtgctctgcctgcctcagcctcccaatgcaaccagcctttttttttttttttaacttttattttaggtttggggttacacgtgcaagtttgttatataggtaaactcatgtcagaggggtttgttgtacagcttattttgataaaatattaagtattaagcccaatacccaatagttatcttttctgttcctctccctcctcccactctccaccctcaagtaaaccccagtatctgtggtttccttctttgtgttcacaagtccttatcatttagctcccacttataagtgagaacacgtggtcttcggttttctgttcctgcattactttgctaaggataatagcctccagctccatccatgttcctgcaaaaacatgatctcagccgagcacggtggctcacacgtaatcccggcactttgggaggccgaggtgggaggatcatgaggtcaggagttcaagaacagcctgcccaacacggtgaaaccccatctctactagaaatacaaaaattagccaggcatggtggagggcacctgtaatcccagctactcgggaggctgaggcagagaattgcttgaacctgggaggcggaggttgcagtgagctgaaatcgtgccacctgcattccagcctgggcaatagagcaagactccatctcaaaaacaaacaaacaaacaaacaaacaaaaacatgatctcgttgttttttatggctgcatagtattccacagtgtatgtaccacattttctttatccaatttgtcactgatgggcatttaggttgattccatgtctttgctattgtgaatagtgctgcaagtaaatctctttaaacagcaaatctattactgcctgcttttcaatgctttaccctcaagaaacttgggctacaactcaataacaaaaagcagcatttttgttcttgttgtttttaattcagtttcttttttttgttttgttttgtttctaagagacagggtctcactctgtggcccaggctggagtgcagtggcaggatcatagctcactataacctcgaactatcaaactcctgggcctaagtgatcctcccacctcagcctcctgagtagctaggactacaggtacatgctgccaaacccagctaattaaaaaatattttttttttggtgatgaggtctatgttgcccaggctggtctcaaattcctggactcaagcgatcctcctgcctcagcctcccaaaacattgggattatacagatgtaagtcactgcactttggccatgtgttggttttttgttgttgttttttgagacggagtcttgctctgtcgcccagactagagtgcggtggcgagatctcggttcactgtaacctccacctcctggttcaagcgattctcctgcctcgcctcccgagtagctgggattacaggcacccaccaccatgcccagctaactttagtatttttagtagagatggggtttcgccatgttcacctggcctcaagtgatccgcccaccttggcctcccaaagtgctaggattataggcatgagccaccacacccagccttttttttttttgagacagagtcttgctctgtcgtccaggctagagtacagtggcatgatctcggctcactgcaacctccgcctcccaggttcaagcgattctcctgcctcagcctcctgagtagctgggattacaggcgcctgccaccacacctggctaatttttgtatttttagcagagacggggtttcaccatattggccaggctggtctcgaattcctgacctcgggtgatctgcccatctcgggtgatctgcccgcctcggcctcccaaagtgctgggattacaggcgtgagccaccgcgcccagccatcttctcatttctttggtgagattgtttggtttttgcttctgaagattttcctgtttttctttttttgtttttttttttaagagacagaatcctgctctgtcacccaggctgaagtgcagtggcgcgatctcagctcgctgcaacctccgcctcccaagttcaagcatgcaccacctacaggtgtgcaccacaacacccagctaatttttttttttttttttagtagaggtggggtttcactacgtattggccaggctggtctggaactcctgacctcaggtgatccacccaccttggcctcccaaagttctgggattacaggcgtgagccaccacaccgggcctccctgttaagcccagtttatccagtatttctaggtgttttgtacaaaagagttttcagggcatttagcctaacataaagcagaaacaaaagtcaggatgagtcaagtaacagtatttgagaaaacttcagaggtagaaccaacaggatttgctgatgctttgaatgaaagcagagataagacagaacagggaatttaaggatgattcctagatttctggcttgcacaaaggagtagatggtggtctaccatttatttagatggggaagtcagacagggagagaggcacaaacttgcagagagaaaagtttaagagttatattttgggcaagtagacaggagacaactacaagttacttgagggaagatgtcaagtttgcagcaggatgcaggagctgggagcccagagcgactgggtggagggccacacttgctagtcatcacagcggctaacacgtcttcacagtaaaagccaaaacaggcggggcacggtggctcacacctgtaatctcagcactttgggaggctgaggcaggcggatcacctgagaacggggagttcaagaccagcctgaccaacatggagaaacctcgtctctaattaaaaaaaaaaaaaaaattagccaggcgtagtggcgggcgcctataatcccagctactcaggaggctgtggcaggagaatcgcttgaactcaggaggcggaggttgcagtgagccgagattgtgccactgcactccagcctggtcaacaggagcaaaactctgtctcaaaaaaaaaaaaaaaaaaattgaggccaggtgcggtggctcatgcctgtaatcctaacactttgggaagctgaggcaggtggattacctgagctcaggagttcaagaccagcctgggtaacacagtgaaaccccatctctactaaaatacaaaaaaattagcagaacatggtggcgtgcacctgtaatcccagctacttgggaggctgaggcaggagaatcacttgaaactgggaggcggaggctgcagtgagccgagattgcgccattgcactccagccagggcaacaagagtgaaactgtgaaactctgtctccaaaaaaaaccaattttaataggtataccattatacacccattaaaatggctaaaatccaaaacactgacaccactaaatgctggtgaagatgtggagtaacaggaactctcactcactgctgatgggaatgtataatggtacagtcactttgaatatagtttgatagcttcttacaaaactaaacatactcttaccatatgatctagcaattgcactccttgatatttatccagaggaggtgaaaagtcctgcactggaatgtttatagcagctttattcataactgctcaaacttggaagcaaccaagatgtctatccttcaggtgaatgtttgataaacaacatgtggtatatccatacaatagagtattactcaccaatgaaaagaaacaacctatcaagccacaaaaaaacatgaagaaacctgaaatgcatatcatttactgaaagaagccaatctgaaaaggctacacactgtatgtccaactatatgacattctggaaaagacaaaactatggagatattataaaagatcagtggttgccagtggttcagcagaggaatgaataggtggagcacagggggtttctagggcagtaaaactattttatataattgtgtactggcaaatatacatcatcacacatttgtcaaaatccatagaatgctcaacagagtgaaatgtaatgtaaactatggacttcaggctggacagagtggctcacacctgtaattccaacactttgggagactgaggcaggaggattgcttgagcccaggagtttcaggctatagcaagctatgatgatgccactgcaacctggcctggacaacacagtgagaccctacctctaaaaaataataataataaaataaaaatagaaataaaataaactcaggaatttggttaataataatgtatcgagttggttcattagttgtaagggacgtactatactaatgcaagatgttaataatagaagttgtgggagaaagtaaggggtatatggaaactctctgtactttccacataatttttctgtaaaactaacactgctttaaaaaataaagtctagactggccgcagtggctcacgcctgtaatcccagcactttgggaggccaaggcaggcggatcacgaggtcaagagatcgagacatcctggctaacatagtgaaaccctgtctctatcaaacatacaaaaaattagccaggcgtggtggcagacaactataatctcagctacttgggaggctgaggcaggagaatcacttgaacctgggaggcggaggttgcagtgagccgagatcatgccattgcactccagcctgggcaaaaagagtgaaactccatctcaaaaaaaagaaaagaaaagaaagaaaacacgtatctactaaaattacaaaaactagccgggtatggtggcaggcacctgtaatcctagctacttaggaggctgaggcaggagaatcacttgagcccgggaggtggagtttgcagtgagccaagatcacaccactgcactcagcctgggtgacagagcgagactctgcctcaaaaataaaataaaataaaaataataaagtctattaatttttaaaatatattaattgagccgggcgcggtggctcacgcttgtaatcccagcactttgggaggccgaggcgggtggatcacgaggtcaggagatcgagaccatcctaacacggtgaaaccccgtctctactaaaaatacaaaaaattagccgggcatcgtggcgggcgcctgtagtcccatctagtcaggaggctgaggcaggagaatggcatgaacctgggaggcagagcttgcagtgagccgagatcgcgccactacactccagcctgggcaacagagcgagactccgtctcaaaaaaaaaaaaaaaaaattaattgagctttatggttaagtttttaaaaagataaatctgacccataaagtttaaataatagtcaagatggaagatgagtgatctccccaaggagacaagcttttctatgaaaatcttatcaaaatgtataatgtacttagaaaactaagtgacctcattacacatcatagttttgcatgatgtaaccactcttcagagaatatctcattttgtccttcagctcccacacaagagaaggttaaggaaattccactactcatgaaattataatcccacaatgtaagtgaagtggtggctgtgcctaggaaagaaagagaatacacgcttagagagaatctagaaagaaacattatccagtttgtgttggggatagcccatgatctaaattctaaaaagcacacccatatagaacctagcctgggctgggtgcggtggctcatgcctgtaatcccagcactttgggagactgaagcaggtggatcacctgaggtcaggagtttgaaaccagtctgaccaacacagtgaaaccccgtctctactaaaaatacaaaaaaattagccaggcatggtggtgcatgcctgtaatcccagctactcgggagcctgaggcaggagaatcgcttgaacctgggaggcagaggttgcagtgagctgagatcgtgccattgcactccagcctgggcaataagagtgaaactccatctcaaaaaaaaaaaaaaaaaagaacccagtctgaagcatgaattcacattgcgttttccagtcaatcactcagccaaagagaacctgaggtggccaagataatgtaacaaccctatcaagtaggtgttattcccatttacagataaggacagaaatgttaagtgactacacatggatgcaaacttggaatcttcaaactcccaggctagtagccaaattacctgtttttaaatctcatctctgctatctgatctctgccaagcaaatttccctttgaatttgttatgcaaacaattaacgagaataaaggaaaatgagagctttatatacgttacatgtaataactggaagttaactttattaagacatctgaaataagtcaacacttttaaaacttaaaggctattctttaccagaatcgtctgtaggaattaaccccagcagtcagaaagtaccttaaaacaaaaccaacattaatctggtaatgtcatgacttcataaaatatccttaatattcaggtacgtgcataccaagaagagtaaacagaataaaaagaaatctctaaaacattttccctcattcactacatgtctactcttccacttacctttatctctaaaacaaaaacattttctaaaccctgtggacatgacttcactaatccaaagaagactttatattctatgggccttgtaaagccacatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctgaggttgggagttcgagaccagcctgaccaacatggagaaacccccatctctaataaaaatacaaaactagacgggtgtggtggcacatgcctgtaatcccagctactcgggaggcttaggcaagagaatcacttgaattcgggaggcggaggttgtggtgagccgagatcgcgccattgcactccagcctgggcaacaagagcgaaactccatctcaaaaaaaaaaaagaaaaagaaagaaagaaaagaaataatagagccgggcgcaatggctcacacctgtaatcccagcactttgggaggccaaggtgggcatatcatgaggtcaggagttcaagatcagcctggccaacatggtaaaaccctgtctctactaaaaatgcaaaaattagccaggtgtggctgctagcccctgtaatcccagctactcgggaggctgaggcaggagaattgctggaacctgggaggtggaggttgcagtgagccgagatcatgccactgcactccagcctgggtgacagagtgagactccgtctcaaaaaaaaaaagagaaagaatgattgataaaccaactgggatactggcagatattttctcaaaaatgaaagaagggaagctgtctgttcagggaaagcaactgacaatatttgttgccaatgataaaatttgagctttagagtaaaaatcagaatttgagaaagtttgtatccaccactgtgagtctgacagttgtctaatattaatgattattaatgaaaccccatctctactaaaattacaaaaattagctgtgcgtggtggcacacgcctgtagtcccagctactcaggaggctgaggcaggagaatcacttgaacccgggaggtggaggttgcagtgagcggagatcatgccattgcactccagcctggcaacagagcaagactccatctcaaaaaaaaaaaaaaaaaccggccaggtgcggtggctcacacctgtaattccagcactttgggaggccaaagcgggcggatcacaaggtcaggagatagagaccatcctggctaacatggtgaaaccccgactctactaaaaatacaaaaaattagccgggcattgtgacgggcgcctgtagtcccagctacttgggaggctgaggcaggagaatggcatgaacccgggaggctgagcttacagtgggcccagatcgcaccactgcactccagcctgggcaacagaatgaggctctgtctcaaaaaaaaaaaattggcggtttatgggtttgtggggggtacaattcctgcctgtccaagtgacagactcatttaattatccccaagttaatgtttaagtgcaatggggtaaaacatgcactctgttaactaaaaagccacatttccaaatagtatacatattacgattaaaacattaaaaatatatgtgtacagatttattcatataagcccaaaaacaaatgtcagacaatgtttctgtctttggaacctgactcaaaataaggttcctcctgttggcttcttcctgagacacagccaacgctaatttgccgcccaggcaaatcatctatgcctatcattaggaaatcaaatttatgatatgcatagcctagaatactactctgtagtttttttgtttttgtttttgttttttgagacagaatcttgctctgtggcccaggctggagtccagtggtgtgatctcagggttcaagtgattctcccaccacagcctcccgagtagctgggattacaggcacacactaccatgcctggctaattttactatgtagattttttaaacatgaggtatatacacatgtatttgcattgagtattctctaagataaagtgacaaaaagcaaaatacagagtttggtgtatttgctgctatatatggaaggaacaacacccagagaataacatgtttgcatgcatacatatgaagtaactcaggagagataaatagtaggtaactagctgtccctgggaaagagtcccaaggataaggtgcggactaactttccacttactacatatcttttgtactgattcatttcaaaatttactctaaaatattggtattacaataaagaaaactggagtctagaactgaatgacaaaactgatacattcttactacaaatctgtggttaagattagcattaatctttcctaggcaaagaggaaaaagtttaacccaaagactgtatggatcttctctaccctacatctccaatctcattcccattactcagaaaatattctcactgggtatagaggtatgaactcccattggaaaacttagggtaaacgtccgtggaatctatggggcactgctgacccaggacacctgggatatttctgcagaaacaggattttttttttttttttttttgagatggagtcttgctccatagcccaggctggagtgcaatggcgcgatctcggctcactgcaacctccacctcccaggttcaagcgattctcctgcctcagcctcctgagtagctgggattacaggcgtgagccaccgcacccagccagattattcttaatcagttgattatttctggctccagaatgcttcaattattccacctgcccctatgtataagcgttaccaccctaattatgcttgtttttgtttttttggttgtttgagacggagtctctgttgcccaggctggagtgcagtggcacgatctcgactcactgcaacctctgcctcccaggttcaagcgattctcttgctttagcctccagagtagctgggattacaggcacgcgtcaccacacccagctagttttttgtattttcagtagaaacaggatttcaccaagtcggcaaggatggtcttgaactcctgacctcaagcaatccacatgccttggtctcccaaagtgctgggattacaggcgtgagccatcgctcccggcctcctaattatgtttcattttggttaatgtttcaataaatgtgctttccctaaacatactgatgaaaagaggcccaaatgcaaaactgatttgtcgagaaagtcagtctgagatgaaatatttattatgtctaaaccacaagtagaaaaaaattcaaaggccgactatttcaatgctaactcaatgcaatattgcactttgtttggtttacgggagaggtaatttacacagctaacatttgggttttcaagattacattgtggggagagaaggggaaaacaagaaaagtctaatgcttttagattctgtcagaaaaagtgtttgctaaaaagcaaaacaaaatgaacatgagaaaaaatgtgaaaaaacatgcattttaggaagctttcaccgaagcaggtgctcaagttcagactcaaatcttccaactcttgtaataaaaatgagaggtcagaataccacaaactaatcaaatcaatcaaacaaagcgggaaacaggtggctgacaccagactgggcagggttttcctaaattgggcttaccttcactaatccaaatcagttttcagaaatggcttctacaaaaactacccaaacatccccctaataatttgcactcctcctccacaatagggaagccaagccgtttatttcccagaaggtttactttctctttcaagctctgctggcttcttcctgccccgcatacggccaggaaaaaagaaaagcactgccttttctttcctgccttctctaaaactggggagatggggtgagagaacctgtttcatggacaagctgggtggttcttaactgcaacactgttctgaatacagattagtttgcaaaggaaagttacaggacaggaaaataaaggtctacccctccaactaactcatacacatgtacatttgcatgtacgcacacacacagatgtgagggcacatttaattcagctgagtaatgtgcagcaatcagctcccagcttcatacctggccaccgggatgcctcctcactcccaccttctttacctgactcaaaataaggttcctcctgttggcttcttcctgagacacaaccaactctaatcattcctcttcccctcaaaccttcaacactacctgcactttctgggtcgggagcaattccttgggtggtaatccatttttaatgtgttaaatattacttaaaataagggagaggtaatcatggactgtgggcaatgcagagatttatcagaagggcatttgtgtaaacaggaatttacagtttgccttacctattccttttatatgacagcctcaatttcctctaacagaatgtaagtcccccatccctattcatttagtttttttcccattaggttagaatctgctaattattctttctctcctttgggtcattagtggctgccatgaatcataatttgcctgactttgtaatatctaacagatattaccattttagtttagtttttgatatgacagttttttgttttttgtttttgtgacggagtcttgctctgtctcccaggctggagtgcagcggcgcgatctcagctcactgcaacccccacctcctgggttcaaaagcaattctcctgcctcagcctcccgggtagctgggactacaggcacccgccaccacaacaggctaaattttatatttttagtagagacggggtctcactatgttgggcaggctggtcttgaactcctgacccgcctcggcctcccaaagtgctggaattacaggcgtgagccaccatgcccgacctcctaattatgttttattccacctgcccctatgtataagcgttaccaccctaattatgctttttgtttttcggtttttttgagacagagtctcactctgtcacccaggctgtagtgcagtggcacgatctcggttcaccgcaacctccgcctcccgggttcaagcgattatcctgcctcagcctcccgagtagctgggattacaggtgcccaccaccacaactggctaatttttatatttttagtagagacggggggggtctcactctgttgggcaggctggtcttgaactcctgacctcaggtgatccacccgccttggcctcccaaagtgctgggattacaggcgtgagccaccgcactcggcctgatattatagtttttaataagagtaattcagcctaggcaacgtgacgagatcctgactcaaaaaaattagaaaattagctgagggtggtagcacacacctgtagccccagctaccccgaaggctgaggcaggaggatcacttgagcctaggaggtcaaggctgtcatgagctgtgatctcaccgctgcactccagcctaggtgacagagtgagaacctgtctcaaaaaataaatagtaataatagtaattattagcacttgaatgttacctgtctgcccggcactatgcaaagtacttgatatgcatcatcttgcttcatcctctcaattactctacaagtggacctcgtttccacaattgtggacagagaaactgaaaaccagagaagtgaaaacaacaggcccaaggtctaagagaaggcagaactgggattaaagcccaataggtctgacctgatagtccactcttttaactgctatagtaactttggaccatgaaaccctcaaacataccaaccaagtgtttcaaaactacaatagcaatcaccttaggaatactcaaaatataagttctttggctgacgcagttaaaaattcaaaggtcaggtaaaatttcagtgatgagcaaggtcatttattcttatggctgggggtagcaggaaggaaagccggatcgtcgaagcattattttcttgtaggggcagatttaccttccttattattcttttgctaggctgttaaaaggaatttggaaggccaggcgtgctggctcacgcctgtaatcccagcactttgggaggccgaggcaggcggatcacaatgtgaggagattgagaccatcctggctaacacggtgaaaccctgtcgctactaaaaatataaaaaaaaaaacattagctgggcgtggtggcgggcgcctgtagtcccagctactcgggaggctgaggcaggagagtggcgtgaacccgggaggcggagcttgcaatgagccaagatagcgccactgcactccagcctgggcgacagagcgagactccatctcaaaaaaaaaaaaaaaaaggaatttggaataaatatgtctccaagataacctggtaaacagaaagggctgcaaaaaatctgaataaaagcaagtcaattaacaggatacatgtaaaacacacattttatattcctacaagtctttttttttataatagcatgttattacttttctaaaaaggacaaaataacttattttaatgacatttaaacccaattattaacagaaaagggataagaactgtggttccttggcctcctttccccttggtttagttctcctaaattaagaacttctacttatagctccctgaacacacaaggctgttttaagcctctgcaccctcatgttccttcagccttgaatgcaactttttgtaacgcaacttcgtggaaagaattcctattcatcctataaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgactaggaagtggcagatccaggattcagtcccagatctgtttgacttcagagccagagtcttgaaccactcactgccctgtcgtctcccctgtcctacttccatactggcatagcacacacctcggtccctgcaacatctccagtttcatgaaaacggacaatatttcattatccttggatcctgcctgacgcaatacctggctctcaacatgtttgctgatctgaattaaagagttgcggtaatccttttttttttcttttttttttgagatggagtcccactctgttgcccaggctggagtgcagtggcacgatctcagctcactgcaagctccgcctccaggactcatgccattctcctgcctcagcctcctgagtagctgggactacaggcgtctgccaccacgctgggctaattttttgtatttttagtagaggcggagtttcaccgtgttagccaggatggtctcgatctcctgacctcgtgatccgcccacagcctcccaaagtgctggaattacaggcatgagccaccacacccggctgggtaagagttgcagtaatcctaacatgacaaatgagaactgaccataacagaaattcattcttccatatgttattcccaggcctcataacctctccttcctctgaagacatgtagcattcagtgtagcactgtcagaatgtctcactctgtcccccagtctggagtgcagtggcaggatcttggctcactgcagcctccacctcccaggttcaagcaattctcctggctcagcctccagagtagctggaactacaggcgtgtgccaccacacctggctaatttttgtatttttagtagagacggggttttaccatgttggccaggctggtctcaaactcctgacctcaagtgatccgctcacctctgcctcacaaagcgctgggattacaggcatcagccaccatgcccagcctgtttttgccttttttttttttttaaagaaacaaagtggtctcactatgttgcccaggctggtcttgaactcctgggctcaagcaatcctcttgcctcggccttccaaagtgctgggattataggcatgagccactgctcctggcccgatatgctactccttttaaaaactggaggcatctcaaacaatttaccaccaaaggaccatgtggccatactgactaaagcgcactacactttacgcttacgtcttgtaagccaaggtgtctaacaaagagtatataaccaccatattaattctttacaccataatcaataagggctgggccagcccagcaatgccatcctcctggatctcactgaggctgctccagaacaccagaagttcttcaggattcggggatgtccctcaagtactctttcagtggtttttataaatgactcaaaagttatggtgaaatttttaagtgccaaagacataaaatatgagtggtggtttgtatccaatcaaaaatcctcaaaaaacacttctgcacttaagcacactatacttttttcacccaaagtaccaaatcaaactagtcaggatacctacctttgtacaatgtcagactccagttaataactcccctagggcagagggcatatgcactgatttactttgtacaaattaaccagcatcaggcaatcaggcctgtgcctaacacatagtaagcactctatgattaaacatcagtgcttcggctccaaagttttatttatttatttatttatttattttttttttttttgagacggagtctcgctctgtcgcccaggctggagtgcagtggtgcgatatcggctcactgcaagctccgcctcccgagttcacgctcttctcctgcctcagcctcccgagtagctgggactacagacgcccgccacaacgcccggctacttttttttgtatttttagtagagatggggtttcaccgtgttagccaggatggtctcgatctcctggcctcgtgatccgcgcgtctgggcctcccaaagtgctgggattacaggcgtgagccaccgcgcccggcgccccgaaagttttaaaagcttcccctacaaaagaacagaactgaaattccttggtcctgtattcaatgtcttttgtaagtaatcacttctcccctacttaccctcctagtctaccgggctaccaggaattttttttttttttggagacagggtctcactctgtcacccaggctggagtgcggtggcgggatcacggctcactgcagccttaacccccggggcttgggtgatcctcccaccttagtctcaccagtagctgggactacaggtccacgccaccaggcctggctaattttttttatttttaggggagagggagttttaccacgttgcccaagctggtctcaaactcctgggctcaagcaatcctcctgcctcagcctcccaaagtgctgggattacaggcataaaccaccgcaaattctttacacctatcaaattccacccattatttgggacccagttgaaatccctctttggcaaaaagactttctagacaactccaggcctcataacctctcctttctctgaagatctgtagcattcagcctagcactgtccaatagaacgttctatgataacagaaaagttctacatctgtactgtatgttcttttatgtagaacagctaccttgttagcacaagtgtaaagtctcaccatctctttgatgacaacatgttacattggatggttaaaacatttatcagctcccccagtagactgcaatttctgtgaacaagatacaacttattcttcatagcaactctgacaaagttgcaaaaggtatatatatgttggccaggcaaggtggttcacgcctgtaatcccagcactttgggaggctgaggtgggcagatctcttgaggtcaggagtttgagaccagcctggtcaatatagtgaaaccttatctctactaaaaatacaaaaattagccgggcgtagtggcgggcacctgtaatcccagctactcaggaggctgaggtgcgagaatcacttgaacccgggaggaggaggttgcagtgagccacgatcatgccactgcactccagcctgggtgatagagtgcaactccaactcaaaaaaaaaaaaaaaaaagtatatatttgttgatttgcacatcacctaagaaaaccataagctaagaaggtttggactcaggcgtctggaaagttggtcaccacctctaccccacctcatatctgaatgtcaagagacacgtagaggcagagaagttaaagcaactttctagagacagaaatgaccactgatcaagccacaatgcactctggtttaaatgacatttaggtcatgactgtccttaatctaaaacaaacctagattagtatttcttttcattagtaaatagctaaattctgatggtaaattatgctgaccaaaaacagttcctcacttcccaagttagacatagcaattagaaaaataatctaagcaagctccatttgtatttcttttttcacctgtttattgaatatttacctcccatgaagtctttcagcctattggtggtattttactgttcagatatatgttagaatttcactgatacttactgggcgcggtggctcacacctgtaatcccagcactttgggagatagaggtgggcaaatcacaaggtcaggagttcaagaccagcctggccaatatggtaaaaccccggtctctactaaaaatacaaaaattagctgggcgtggtggcgcacgcctgtagtcccagctacttgggaggctgaggcaggagaatcgcttgaacccaggaggcagaggttgcagtgagccaagattgcgccactgcactctagcctgggcaacagagcaagactctgactcaaaaaaaaaaaaaaaaagaatttcactgatacttttcacaaaatatacagaaggaggcacaaattccaccactatggcactctgctgcgttggccaagtgtcttgatcctttggcctcaattttcttatctacgatattagggtaattgttatgtgaactacccacctcacaagtcctttgtgggttaattcataactgtgctgtgggtatttctttttctttcctttcttcctcctttcctttctttctttcttaaagatgggttctcattatggtgcttagactagactctagacccaattcctggcctctcaccatgttgcccagaccagactcaactcctggactcaaggaatcctcccacctcagccttcaattagctgggatcagaggtgtgcaccaccatgcctggcactgtggatatttctaagtgattattcttctcaaatgaactacataaaaaacaaaagattcatgaatttactaatggttctttgtgatggatgtgctaatatagagactaaaatcaaggctccaacctctaaaacatttttttttaaattccagacttgtttccccatcccactgtgcaaactgaacaaaaactgggctagcactcctgtctggaacatgtaataaggaaataaatgtgctgactcagagaacacagacatatttaatataaaataagatagaaaactggctgaaccaagtcataacacagtctaaatccacatataaaagattgagatgattttctgctttgctttattcaagcccaatgctttatcagcacagccagccaaaaatttacaacccatacacagactatgtaaacctttagttgcacatacagtaagaccagcaggtacacactatacacatttttaattaaaaaaatgactaaccactgattttgtcaccacacttaacaacgacctgatatggcacagagtgatgtgtaccaaacatggaaataccaacttgggcgacggtttgaatcttgttaacttcagtgcaaccacaccccccaaatgcatgtaaagtttgcacacatggttttttcaaggccagcctgtctttgtttccctctcctctgcatttacccaagatcttggctctgagacagaaaactcccactctcaattggttcattccgtcctatgcaattaagcaacaccacaatccagtaaatgcaatggctcaattatttatcttctggccgactttaccaggtatttggaaaaggacaatgtcaagaggtttatttctctctctagagctggcttgacgggttgatggggattttattttgtctttttttctcttttttacaaggcggggacgtggggggagcataatttaacctagaaaaagatgcgagggaatttagaaagagtaccggtctgtcaatttccctacaggaaacttgattcttatgcaataaagcctacccacgaccagccagcccgtaaggctgcaggcgacagacacacctattcctgcctccaaaagggcacagctgtctcctgaaggagcgggaacagggcaagcggaggaagtggctcagcgggagccgccgaccgggcggggaggaggcgctttccgaccccccactcgcgccggtgatccccgtcggcgtgacagtcgctccggtggccggaacgtccccagggccccagggagcaggaaatcgggggactgtccctcactcctgccgccgcaaccgagtgcgccctcgccccacggtgccccctcgagcgcgttctgtttctccgaagaacgaaacttccctccagcgccccgagtcccttccgaggcccgctcctgtcatcccgaagagtcttccctcagggcgaccctccgcgtctcttcatctctcccggccccactgcagcgtccatcacaacatccccaaggtcccagaggccccctgccgctgcggagcccccgggtccccaggcctccccaacggccccaccctgcacccccttcacctgtttctccggcagaggccgagaggccggggctgcgcgtgtgccggggacgggcggcgaggctccctcaggccgaagggcctctccgagccgagggggagagacagcg

SEQ ID NO: 2054 - DNA, 77230 bp, Homo sapiens
tcccttcagaggaaggctttattgtaacataaaatacacaactttgtgactgtaactctgcataggatatatttcttttttttgaggcagagtcaaatttgaggccccaaattgtacacaatacttttttttggtggctaaataactaatctgccttgacactaaaatatgtatctgaaataatttcaccaagttttaaaaagaaaaattataaaaagtatactttcattttaagttatattcgattttagtctccccctaccccctagaaaaaacctgcacatctcacacacggagctgaaacttttgaggacttgtgtgtgtctgggagtgggtgagaggctgatggggtcgagacacaccactacctttatcttgtggtttgcaggaacaaggaggagagagaagatagaacgcagagagcgagcacacctttcatcaaaaatctccactctctaggcacagcctcggtaacaccgaggacagctcacaactggacaagcagggaaaccccagctcagggaagccacactcatcagctctcttcctccccaacccagtgccaactgcaaagtgagccaggacggcctggctgctctgtcctcagcaggccctggggtgggtccactcccaacctgaaagtgtatcaagtctgaccccccaaccagggttgctggaacagagagcgaggtctcagaggcaggtgctggtgaagcatctctgggagacgggcagggagtgactctacgagcctggatccctgagcaggcaggctctccttctcacccttccccgatgcacccatcctcatggttggaattttcatcaaatcttgaggggtagggaggggctgagtgggatgcgggtagcctgctcctcagaggcagagagactctactgcctggcatagaaaaataaatcagtgtatgaaaccaagccaaggcaaacggcagctttaaaaaagtcatcttccaataaataatttactatagaggaatatttttaacggcaaaacactgataaattcagaagttatttttgtaaaaaaaatatgtttatttactctcatgtataaaaataaggtttttggggccatcctctcctgggggtgcccatgcccttcttttggagagggggccgaggggtgaccttttaggccttacccgtaagctattttaatacacctgctcacccccctcttcctccactacctgctgtagcccattccttccttctggtgtaaagctacagaagaagtcgtggaacaaaattataccgaggctttttttgttttgttttatacttttatcaaactccccagcaaacttgctgactgcatttccacacattaccaacacctgccaggacttcacagcagggtgacccgctaagcaagctggcctaggttcagcccacactgctgctacctactcttcaagacattaggtgtgaacagagaaggggaatgaggtgacctgggtttgaatgacccagggcccaatgcacaagagagaattttgatgtcaaattagggtggcaaggagaaaacaaaaaagatccaacttagaaacagaaccatgattcaacatttgcaaaaagcatcatcaataagcctgaagaaggccacggactgtgcatccgctggctcagagaaaggctgggcagccggaacagcagcttcctgggtaaccaggcaacaatctcagcgcctgggagtcagggctgcgcactccactctggccagaacacaaacggcattggcactgtaagctctcagttacgtggccctcttttctctcctctatttctccaaacatatgtgcacacccagaggaactgagtggcaattccagggtgcgggcgggcaggaggggagagaggacaaagagagaataagatgagctaaatgttttgtgaaaagccaccgcccatccgaaagcttgtgacttcccttgccccaacaatctttgtaggttgccccttttcccattcctacccaagaacacaggggtgggggagagggaaggctctctttgtcaaaaagcagttatctacatttcagaagaaaagcagagacaatcacggttatatatcaattgcttggcagacagagtgacgaagactcactggagcacatgtgctttctcctccctttgtccttctcttattcaaacagccacatgtcaaagtccagccactcttaagacacatggccaacttccaggcttcacgaaactcactgcctttttgcacaaagtaaaaaccaccacagcttctgtctgtggcccctctgctacaactaaactctcagacagtgagagggagaaacaccataacgtgcaaacacgcacacacacacacacacacacacacacacaaacacatactcgcactcccttcgctggtgccaccatgcacagaaacactaaggtcacaactagtattaacacttcacattatgagtattgtttcaaaagagaagcgattcatggaattaaaacatccacaagagtgattcctctggtgaagatgaagaagctgaagatggagaggtcgcggggtcacgattgtgcgtgcgggatccactgactgtccattggccggcccaggagctcctccacacgccgcgctacgtccattgtgtcctccagatcgaagtccccatcggtgtcaaggactgagtcagggcttgggagggaaagaagagggatgaagggaaggggaaagcctgccagagaccaccccaagccccacaggccaccaggggagcagtctgagccagcctatgccctcagcctggggcttcatgggaaaagaacaaccattcaaacagctggctgtacagcaactcagactgaaataccctcccctgttacctctcacaccggctgtccagacacatcacaactccactcagtccttagagcaagaaaaatctccatattgagagaggggaacagatgacatttgcccaacccgactctaaaccaccaatcacttctggtcaaatctctccctcccaaaggccagagcccgggccagggctgtgtggtctcagacctagaggagctctggattcctttgaccccagccctccaggggtccagcctggggccaagcccccagttcctcccctgtggacccccacaagaatgccacctacttctgtgggtacatgttatagtgagcctggggacacacagctggggagggggcctggtccatgtacgtggcgctgccgcccccggcatctgcagatgcgttcacaaacctgcagaaggaagagaacagagcttcagctgccagggaggccagggcagctgacttggggaggggaccaaggggtatctttgtctttctcagggtgtagaaggacaaagtgccccactcggccctggggctccagctacaggagtggggcctcaggtactggcatagcatcaccaagcccaggtccttccccagggctgagacagtttccccgggggagcggaaagctgggccaggataaggatgggaggcagggtctgggggaggaggaaagaggcagaaggagagccacagccacctggacacttactcagggaccacttgcttgatctgtggcttcacgtatccatcaacagctttagctgccaagggaagaatgtagtaaatcaaagttctcaagtgaaacaaaaatgtgatcttccttatgaatcacatcttttcttaggacagaacacaaccacctaacttatctaaggatatgacacaagcacttaatatttttttgttttgttttttgaaacagtctcactctctcatccaggctggagtacggtggtgcaatctcggctcactgcagcctccgcctcccaggttcaaatgattccgatgcctcagcctcctgagtagctggattacaggtacaccaccacactttggctaatttttgtatttttagtagagatggggtttcaccatgtcacccaggctgttttctaactcctgacctcaagttatctgcccaccttggccccccaaggtgctgggattacaggcataagccaccgcacttggccaagcatttaatatttcaatctgttaggaagacctggtagaggagaaggtcagcactaaaactgaaattcaagatatcttccaaattggcttggatgtttcaataaattcttcaaaccatggaaactatgtacttcaatacaaatctaagtcaagcactaattgcatactaattaaaaaaaaaaaaacaccttgaaaagcttaaagtccaagatgcagcagagagacaggatttgttctacctgacccaggggataaaatcaggaccaggaggggcaggtcataagaggacaaatgttcagtcatgcagggaagaatgttctaagtagaactgccaggaaaagaaatgatttatcttaggaaggactgatttccttgtcactggaggttttcttttttttcttttttgacagagtcttactctgttgcccacactggagtgcagtggtgcgatctcagctcactgcaacctctgccttctgggttcaagtgattctcatgcttcagcctcccgagtagctgggattacaggtgcgcaccaccatgcccagctactttttatatttttggtagagatggggtttctccatgttggtcaggctggtctcgaacccctgacctcaagtgatccacccgccttggcctcccaaagtgctgagattacaggtgtgagccacggtgcctggccatcaccggaggttttcaagcaggaggtgcatacacgtcagggatctaatggaaaggcctaggcactggagagccgctgatctgatctgatgatgtctgaggttcctctaactctgagtgtctagtctttcaggaaagggaaggctacttttcccagcacctgcacgctccttcacgcctggtgtttctgcatttggggtactttgatgtcactagtcccagtgagtgctgttggtgccaagaatgcgatgtgtcctttgcttcccacagaatccccactgggatgtggcagatgagcagataaacctgcacgtgatctggtcaaccacagttaccttttcagaaggctgactatggaaatccaggtaagcaggtggtaagaatgtgattatctgacatgggagaatgaagtcttgtttctgggtacgtgaatatgggaatcagtacaaagttaattatactaggcaaggacgatcacactatgattataggacaaggagcttgtcatttaagtagcccaagagggtgaaacgctgcagggttcaccaattgcttattaccctaatcttcttctagggcttcaagtgtcaggagcgaccttttcataacatgttttttgtgctttacagtgtacagagtattttatagattggctaagaagttaaaaacaaagaaatgctgccagaaataggattttatttttttctgagacagggtcttactctgtcacataggctacagtgcaatggcacaatcatagctcattgcagcctcaaattcctgggctcaaccaatcttccagcctctgccttctgagtagctgggactacaggcatgcgccaccaagcgcagctaactttttcttttttgtagagatggagtctcactatgttgcccaggctggtctcaaactcctaggctcaagcaatccttcctcctccgccttctaatgtgctggaattacaggcatgagccactgtgcccaggcccaaattataagtatcttaaataaccaacatgtaactcaccatacagtgggattgtatgcagtcatcaaaatgaggttggaagattacatttactgagctgtaactctgcataggatatatttcttttttttgaggcagagtctcgctctgttgcccaggctggagtgcagtggtgtgatcttggctcactgcaacctccgcctcccgggttcaagtgattctcttgcctcagcctcctgagtaggtgggattacaggtacctgccaccatgcccggctaatttttgtatgttttttagtagagatggggtttcaccatgttggccaggctggtctcaaactcctgacctcaagtgatccacctgccttggcctcccaaagtgttgggattacaggcatgagccaccatgcccagctacctaggatatatttccaagtaaaaaaaaaaagtcacaaaaaattacatatgatatggtctagactccaacctttcaccctgaactccaaggctggagtgtcctgacctcagttcctaccacttatcttccctgctcaagaggctccagcctccctggccctcctgaggctttccagacatggccattctcaacccaggatttttgtacttgttctcttggcatacaatgtttttctctagatctttgtatggctagcttcctcacttcattcaggtcttttcaaacatcacatcctggctaggtagagtggctcatgcctataatcccagaaccttgggggactgaggaaggaacattgcttgagcccaggaatttgagaccagtctgggaaacacagcaagaccccatatctataaaaataaaataattaaccaggattggtggtgcatgcctgtagtcccaactatgtgggaggctgaggtgggaggatcccttgagtctagcagtttgagactgcagtgagcaatgtactccagcctgggcaacaaagtgagaccccatctcaaacaaacaaacaaacaaaacaacaacaaaaaaaacaaacatgtcctcagagaaaccctccttgaccactctagtaaaataacacctccactctcctccctgccacttctctatccctctaccttgctttatttgtcttcagggcgcccatcactaaattaatatatttgtgttttgtttgtttttgagatggagtctcgctctgtcaccagactggaatgcagtggcatagtctcggctcactgcaacttctgcctccctggttcaagcaattctcctgcctccctggttcaagcgattctcctgcctcagtctcccaagtagctggaattacaggcgcccaccaccacacctgactactttttgtatttttagtagagatggggtttcaccatgttggccaggctggtttcaaactcctgacctcaggtgatatgcctgcctcggcctcccaaaagtctgggattacaggcatgagccaccgcgcccggcctgaatatgtttccttgtttatggtcttcgttctgctgctagataacctccacacaggaagttcaagcaacgggtgatgcaatgtataatacatatctatatatagagtgcaagaatagtcactaaatcatccatagaggttaatctctagatgagagatgttgtgtggtatctgtttttttgttttcttttcttttgtttttgagacagagtttcactcttgttgcccaggctggagtgcaatggcacgatttcagctcaccacaacttccacctctcgggttcaagcaattctcctgcctcagccttcccgagtagctgggattacaggcatgcgccaccatgccaggctaattttgtattttcagtagaggtggggtttctccacgttggtcaggctggtcttgaactcccgacctcaggtgatctgcctgcctcagcctcccaaagtgctgggattataggtgtgagccaccacgcccgaccttccttttttttttttttttgagactgagtctcaccctattgcccaggctggagtgtggtggcgtggtctcagctcactgcaatctccacctcctgggttcaagtgattctcatgcctcagcctcccgagtacctgcgattacaagtgcctgccaccacacctaatttttgtattttttgtagagatagggtttcaccatgttggccaggctggtctggaactcctgacctcaaatgatccgcctgccttggcctcccaaagttctgggattacaggcatgacccaccgtacccagcctgttttcttttttatgcctttatgtgtcttctgaaaattttataataaatatgtaatacttctaaactcagaaagcaataaaaccatctctgtcatgaaaaacaaaattttacctaattttgtttgatctaagcttgtattaaaaagaatttgttttcttcaatttgatatttggggttagtggtagatgtgttttctgtatgactgaagaatccagcccaaggtttacatctgccctggaaaatgctcaaactgctctcactgaatggtaattgtgtgggttttcacacaagagagataacacacgcaggtatgcacacacacacacacacacacacacacacacacacacaacaaaatcaaatcagaatgcgaacattgttaccagtagcagactcgcagggaactggtgtgtagtatttggagtatacttcatcttttggccgatcaggaaacacgtagataaggtaattcaagtctcccaagcggtcggctagggaccgaatggagaagtctctggtggtaaaaggcatcagattccaaaacattctttcctctagatcaataaacagaacaatcacattctaaacatgatttctgaattaggaaatcttaaaaccccaacatactataaattcaagcttgccattataatggctccaatagaaatctccatttaaaaataaccatgggttatagatgaaatacttttatttatttacttacttacttacttattttgagacggagtctcactctgttaccaggttggagtgcagtggtgcgatcttggctcactgcaacctccaactccctggttcaagcgattctcctgcctcagcctcccaagtagctgggattacaggcacgcgccaccacacctggctaattttgtatttttagtagagatggagtttccctatgtcagccaggatggtcttgatctcctgacctcatgatccacccacctcagcctcccaaagtgctgggattacaggcgtgagccaccgtgcccggcctgaaatagttttaaaagccatgggtaggggccaggcatgttggctcatgcctgtaatcccacacttttggaggcctaggcaggtggatcacctgaggtcaggagttcaagaccagcctggctaacatgatgaaccctgtctctactaaaaatacaaaaatcagccaagtgtggtggcactcatccgtagtcccaggtactatgctgaggtaggagaatggcttgaagctgggaggtggaggttgcagtgagctgagatcatgacactgcactccagcctgggtgacagagaccccatctcaaaaataaataaataaataaataaataaaaataaaagccatgggtagataagcaggtaatacaaaaatcacttcccaagagatccaatgatctcagacgtttcaagttcaaacagtattctagccctcagtagaagaaacagtttttactggcccccaatccctgatttcccatacaaagatatataaaagctaggaagcatgcccacaaccagagaaagcataagagctattaaaagtgatgaattttttttttttcgagatggagtcttgctctgttgcccaggctggagtgcagtggcgcgatctcggctcactgcaagctccgcctcccgggttcacgccattctcctgcctcagcctcccaagtagctgggactacaggtgcccacaactacacccggctaatttttttgtgtttttagtagagacgggggtttcactgtgatggccaggatggtctcgatctcctgacctcatgatccgcctgccttggcctcccaaagtgctgggattacaggcgtgagccaccgcacccagcctttttttttttttcttttaagagacagggtcttactctgttgcccaggctggagtacagtgatgtgatcatgactcactgtaaccttgaactcccagggtcaagtgatcatcccacctcaccctccagagtagctgggactacaggcgcacaccatgagcaccaccatgcccacctaattaacttatttatttatttatttacttagagacagggtcttactatgttgcccaagctgggcttgaactcctggcctcaagagatcctcctgcctgaggctcccaaagtgctgggattacaggcatgagccaccgcacccagccaaaagttattaaaaactttaattcacagaaaatgaaccagcaagctacccttattgtgagggtcagaggagagaactaactttcctgatgccctggtgcagtggctcaagcccgtaatcccaatactttgggaagccaaagtgggggattgtttgagcccaggagttcgagaccagcctgggcaacatacaaaaaatttaaaaattagatgggtgtggtggtgcacgtctgtggtcccagctaatcgggaggctaagggaggaggactgcttgaggccaggaggtcaaggctgcagtgagccatgtttgtgccgctgcactccagcccgggcaaaagagtgagaccctgtttcaaaaaaagaaaagaactaacatcttgggtagaaatggttgatggcaatatccatatgttaattaggataaaggaatatttttactactgtaagaactccaaatcatcaaattcttcactgaaataagctttatgcagagtagtacaataaggcaaacattttaagagggaagcaactgagattctgcacggactcttgtatcataggtagccatgtcatggttaaatgttcatgtgtaaccatgctgccatatactttcatgtataaccaaattagcaattgtgtttcccataatagtatttttcataggctgccttattatgagtatgtcatggctatacatttatgtttcccataattagtactgacctcaacaaatagtaagtacccactaaattatttgttaaaataattttgtaacgaaagcagctaactttggacataagaagggaggggcactcacgagaatcaaacttccaagcaatggtgatgccgccaatttctgagtcactgaatctcaggaggaaggtcccatctggcttgttaatgagtaggtcatgggcctgttgcttgtttacaaaccccaaaatggccctggatcaccaaggacaaaggacagaagcagagtgtgacttacgatgccagagagaagaccttcagactctgtcggcgccttaagaaataatgattctcacccatcattccaatgaggcttgagatgtttttttaacacttccatcacaccgtcaaaccattgccagaaagtgtaattccgtcctggtaaattctcctggttggagatacaacagtgaacataagaacaccagagtaacacttggaatattatacacatatttaattggaaaaattaaatgggaaacaaacatctacccttgtcagaggcatacaaatatccccgcctacctgagttttacctaatggccccatggagaggaaaagagggaagaaggggaaaataccaaactgcagttaccagcacccagtgggctcctgctacagacactttcacctgggactgggctgacccgtcccttgctagtttcgatgtgtggtctgtgaccagaagcatcagtgtcacctgggagcttctgagaaatgcacgttgttaggctccaaattaaacatttaaaacaccttgggggtggggggtgtaggaaaagaaacaaaaattaaattcaaatcaaggtgatagccgggcatggtggctcacgtctgtaatcccagcactttgggaggctgaggtaggcagatcacttgaggtcaggagtttgagaccatcctggccaacatggtgaaaccccgtctctactaaaaatacaaaaattggctggacatggtggcgggtgcctgtaatcccggctactcaggaggctgagacaggagaatcacttgaatctgggagacggaggttgcagtgagcccagaatgtaccactgcactccttgtgacagagcgagacaccatctcaaaaataaataaataaacaaaaataaatagggtgggcacagtggactcacgcctgtaatcccagcactttgggaggccgaggcgggcagatcacctgaggtcgggagttcgagaccagcctgaccaacatggagaaaccccgtctccactaaaaatacaaaattgcggggcgtggtgccgcatgcctgtaatcccagctactcgggaggctgaggcaggagaatcgcttgaaaccaggaggcggcggttgcggtgagccaagatcgtgccattgcagtccagcctgggcaacaagagcgaaactctgtctcaaaaaaaaaaaatgaataaaaataaaatcaaagtgacgtctgaattagcagatgctagaggaggagtttctttcatcagcatccctctttgtgggttgagggtcccataggagcctgatctggcattacacatggggaacataagagagtaaaggggagagaggcccagagttcgcatcccctcaaaagctttgcttctcatgagctatgttaacatctgctttgctctatttcctttacaaaggaagaaaatgcattaactgtagacaaaggtcaacttatttaaaatatgcaaagatgtaattttctacacgtgacctgggtaactctcaagttgtccatctagtcagaagcttctattactttcggtacattttattagagacatgaagaataagggcccagggcagggagactcctgagagcatctggttgggaaggactgatctaacagcggctggcagctgggctcctcaccctgttgaactgggaccaggacacagacaggccactgtagtcctccaggtggctgctgctgttgttgaacagtttctgcgccaggaacacgaggttctccttggtcaggccccggttgctctgcacttcggccttgaatttcatgttgagcgcctcacacagctgtggccacagcactttgtcaggcacggcaaatggcaccctgccctgagagggagagaggccagaatctgatgagaaaacagttgcatgatttattccctcaagccacaaaagaaaaacgctgatggctgggagtggttacacacatttgtcttgcagggcctgaggataaattcagactctgctggggtacacggttctgtgaaattcagaaggttccgtttcaccttctttacacacaactagaaggtaacccatgctatccatgctgttttgtaaatgagctgctgaactaacagtcaaatcctatgttctaacggccacaaaccaaaacataaccaaggtctggctcttagattgtaaacaccttgggaatttagaaatctgaaagactggtcctctaggtacaaacagagagagtgtgcgtatgtgtgcacacgtgtcggcatgtgtgtacacacgtggaatcattgccctcgactccttctgccaagaattctagctcaaagtaaaacaacttggtatggaagagtggaaattttgagttggatggctttattgagaaataggttagaagattaacttttaataaactgcttttcaacccgttcagccatagtactccattttattttgttacaaacacttttttcaataggtgattttcacatgatttaaaattcaaaaagcacagacggctacacagtgaagtcactccctatccctgtctcccagcaacccagttcttttctttaaaggcacctaacacagtttcttgtgtatcccaccaaagatattctatgcatgccagcaatgacatataccttttccttttcttcacaaatgacagcacaaaatccacatgttctgcatcttcctcttttcacttaatcctctatctgggagacctcccatcagcacataaagaaatttcaccagacccccatagatgggcatcagtgttacagcctcatctttagctattactaacaatgctgcaatgttcttatgttatttgacccacaggacacataggcaaatatatatggagaataaatttccacaattatttttttttttaggtaaggtctcgctctgtcatccaggctggagtacagtggcccaatcttggctcattgcaacttctgcctccttagctcaagtaattatcctacctcagcctcccaaacagctgggactacaggcgtgcaccaccatgcctggctaatttgtgtgttttttgtagagacagggttttgctatgttgacaaggctggcctcaaattcctgggctcaagagatccgcttgccttggcctcccaaagtgctgggattgcaggcataaaccactgtgcctggccacaagtctttattatttattttttattttttatttttttgagacagagtctcactgtgttgcccaggctggagtgcagtggcaccatctcaggtcactacaacctctgcctcccaggttcaagcaattctcctgcctcagcctcccgagtagctgggatcataggcacgcaccaccacgcccagctaatttttgtatttttagtagagatgagagtctcaccatgttggccaagctggtctcgaattcctgacctcaaatgatccacccacctcggcctcccaaagtgctgggattacaggtgtgagccaccgtgcccagctgaaagtcttttttttaacatagcataaggtcggctgggtgcagtggctcatgcctataatcccagcactttgggaggccgaggtgggtggatcacttgaggtcaagaattcgagaccagcctggccaacatggtgagacctggtctctactaaaaatataaaaaattaattgggcgtggtggcatgcacctgtaatcccagcttctcgggaggctgaggcaggagaatcgcttgaatccagaaggcagaagctgcagtgagccgagataatgccactgtactccagcctgggtgacagagcaagactctgtctcaaaaaaattaaaaaaaaaaaaatagcataagatgtaagtagtcattaacatagctgagaatgttaaaaatgcttatttatttagacaagatacttgagtaattacatggtgcaggagatgccaaaggtacacagagagtgagatctgtggacaggcagggaaggaaacaagagatgtggcaatcttatctaggaggcttatcaggacaagaggcagacagacagtttcaaaaaggagcttctgattcagagtttgtaagtgaagtatggtaaatctcttaaaaatctcacctttgcagtaaaatactttttctctaaagaggagtgttgggaaacgttaagcctctccacgtgagccagaaggttccatttcaccttctttacacacaactggaaggtaacccatgctgtccatgctgttttgtaaatgagctgttgaactaacagtcaaatcctatattctaacagccacaaaacaaaacataatcaaggtttgttggatatacttagagaaggacatgctcttatgtcccaaatgataacccttttatcatgcttttatggactaatctctattggaaatatgtaacaaatgacctttgcctactaaaaaaatttttttctttgagacagggtgtcgctttgtcacccaggctggagtacagtggcacaatcttggctcactgcagcctggacctcctgggctcaggcgatcctcccgcctcagccccccccaagtagctgggactagaggctggtgtaccatgcctggctaattttttggtattttttgtagagacaggattttgctatgctgcctaggctagtctggagctcaagggatctgcctgccttggcctcctggagtgctgggattataggcatgagccaccgcacccagcctatgagatctttaaaatgctcatcgagcagcatgctagtgggattcagatagcgtttgggtgcataaatccaccaaattatatcttccttgaggcaaagtatctcattcttcatgagacctagaatgaatcacagaaactaaaatttggaaaagacatttaacagcatcttcatttattgaaaggaagagggtatgaagcaacttctatgctaaagtaagcctctggagagatctaacctctggagtgaacctaggagtcccaaatcccattcatagtttcacccaaggattcaaaataatatttactgagtactgactgtgtggcaagcattttctatgttatctaatttaatcttcctaacaatgctgtagagcaagagtatccctgtgctgcagacacttgctggaaactcaggctcagagaggtaaagtgaactgcccatgtggtcatggagtgaggaaatggtggagtctcagttcaaaccctggcccgatgtcaagcccatgttctttccactttccacattctttctattctgcctcccactaaagaaaacagcgtcttttttcctatgctttttttttattattgagatggagtctcactctgtcacccaggctggagtgcagtggtgcgatctcggctcactgcaacctctgccgctcgggttcaagtgattgtcgtgcctcagcctcccaagtagctgggactacaggcatgtgccaccacacccagctaatttttcggtattttttaatagaaacaggattttgctatgttggccaggctggtctcgaactcctgacctcaggtgatccaaccgcctcggcctcccaaagtgctgggattacaagtgtgagtcactgcacccggccttttcctatgctttttaaaaggataatacataaatgagattcatgacaccggcattgattttgggacccacatgcccgaggaatacactcacaggctctgcaaaagcattgtcccagagaacagtggccgtcgcattgttgtcctggctgccatgaacgatcaccaccactggcagggacagggtctaaaaagacacaagagaaggctgagcgcccacgagcctcaagttcttctccttctctcttttttttttttcttattataacaacacttttattttccaagtttcagttaatgttcctctcagacacagaatctaaatggccccaggaataatatgacttttcatactggcacaatcttagaaattttaaatattttacaagcaatgttgcttagatatttctgaaggataaagtttctcaaagttacatggagaacaggagagagaaaagactattggagatatttctgggaagaaaatacaaataacaaatttaaaacttaccacaacctttactcaaattcatcccaagtaatgtttctcatatccattttgtagtctacctctccagctagttcagttcattattgtttgttcatgttttattttttattttttaatttgttgttgttgttgagacggggtctcacaaccagctccaggctggtctggaactcctgaactcaagcaatcctcctgccttggcctcccaaagtgttaggattacagatgtgagccactgcactgggccttgcttgttcatgtcttttttttttttttttgagacagggtctcactctttcacccaggctggagtgcagtggcacaatctcggttcattacaacctcagcctcccaggttcaagtgattctcctgagtagctgggattataggcacgtgccaccacgcctggctaatttttgtactttttagtagagatggggtttcactgtgttagccaggctggtcttgaactcttgacctcaagtgacctgactgcctcaacctaccaaagtgctgggattacaagcatgagccactgtgcttggcctctgttcatgtcttaagagaacctaagtgaaacagttctcagggtgaggtcagtccattttcagtttaccaacagtcaaaaagaagaagatgctatgtgataaaaaaaaaatattttgtaacataaagtacaccacacacacacacgcacacgcacacgcagagctgagggaaggctttaccttgacttgaaaaaccagctcatttccaccaacactgaactgggattcaaacaggattgtaaatttttcttctgtcaccgactctgccccacgacggtctgacctcttaattcgtttcagggactacaaagaagaaacataagatgaaacgtaagatataagttgttcccctcaaagaccagggaaaaattcattcttcctcttcttccaccctcaccatattcctgaagtgggcactaagggtgcctgtggcttggtggtactccatgacgcagcagttgttcaagatctcgccactgtaatcactgcaaatcagagagagaccagctccaaacccatgccagggtctcaggacatgcggagtaaataatataatttggggtagcaggaaatagagaagtttgctaaaaatgtacgtcatttagaggaaatgttagctacataacacatacatgtaatcttctcggacgtatctctacaaaatgaaacaagatcaaactatcttcacagaaaacagttcctaagagaacttttttttttttttttgtgacggagttttgctcttgttgcccaggctggagtgcagtggcgtgatctcagctcactgcaatctcagctcactgcaatctctgcctcccaggttcaagggattctcctgcctcaggctctctagtggctgggattacaggtgcctgccaccacgcccggctaattttttgtatttttagtagagacagggtttcaccatgttggccaggctggtcttgaactcctgacctcaggtgatctgcccacctcggcctcttaaagtgcttggattacaggtgtgagccaccacaccaggcccaagaacttccttatattcctttgctgatgcccagaagaggccagaagggcaaacagggatctgacacaggaggcagaattctttttttcctgttgccaggacatgagacaagtagcagggaatgagaggaagctgcacaattacttgcgggtgttctcgttcttgagcagagacttggcctgctgctcactgatgatggtggccttcacctggggggggttcatgtgcacgttcagcttcccgcccaccagcaggcgcacagtggctgcaaacttggtctgggtcttcaggacctgaggaggctgcttctcaatgatgaacgtgctgcaggggacacagggacagatgcatgatgaggggctggtgcaggggaaagggctctcagtccctctgtggtgggggtggggctgcctcccgaggggctcaggaggtgaagagctcgggcacagcctctgttcctggggaagccgtgagagtccagggagaggatggagaggggagtgagataacacagaagctggcatgggctgcagcccaagggcatctcttgcagtgtccacaggagaaactgggcaagggccacagcaactggagatggagttgggagggatgagaggcaggaagtggatctgctggtctggaaggcacctgcggctccccccacgcaggcaggagctgccccaagctcctgggcatggcaaacaggcagcagtcacctggtcaccagggctgagataatgtccgtgatggtggcgttgacctcggccagcatctcctccactgggccggggatgggcagctgctggcagaggtgctcagccctgcggatctgctgccggttctgccagatgatctcggccaacttctcacacctgcacgagagccccaaggccaacaggaggacaatggctcctccgcacagacgccaggccccaagacacagctcccgttcccccaggaaggctctgtgctttcgccacacttcccacccatgggaagagcagagctccctgcctcccagaattagagacgtacacaggaggggcgaccctgactaggcccaaacagcccaagcatcaccccacacacccgaaccctgtcccatctccaggacagcagcccccttcctgggggaggtgcacaggatgggggccaaagtctgattgaggaaccaggctccctggagaaacaagagctgtcccaggatggagggggcctgctgcaggagccagcacaggacgcagaagcagccgggatccccaccagcccctcctgccctgcccgctggccgccccacaccattaccaggactgtagcacgtccaggctgccctcggggggcccgccgttcccggccagctgctgccgccgcttccactggatcagctcgtcatccaggatgatggtctgctgcttccgcagcagctgcagggtcttctggtgcttctcggccagctcctgagggaagggaggagagcagccccttctgggctcccagagaacaccgcagggcctcgctgggaaatggcagggcagggcccaggccgttccctctccccaagctgctctgcctcgcaaggcccccaggaaaaaaggcctcctgccctcccaggttctgctctcatgctggtcccagccctccctcgggtccccagagactgacttcatggcacccacgcccaggagaggcccaggaccccactcaccacgcggtactgctgcagtgtctgtgcctcacgctgcaaccaggcctccagagacacctgcttctgctggagggccgtctcccggctcagacgctcctgggggctcagctgggccagcgggccaaactgagctagaggaggggagaggaaaccatgaccatcacctcccagtgtccaacaggaggcccagagaagcccactcacccgttctggagcgagaccctcctgggctcagatactgcattaagggcaagtcggggttcctgacagccaggggggccaagatgaatgggtgccccaggaggcgcctctgggccctgctcgccagcctcctgactctgagccgtcccctctgggggcacacgggtgctggggcagctggggaggaggcctgcctgcctcctgcccgcctgcctcacagggctgccagccctcttctcgcggcccagcatgggtccaggctgtctggggtgtaagtgtgcccatgcccttgactgcaggtgaacctgggcaaatcgctttcctttcctgtgccttggcttccccacgtgtaaaacgggagattctcggcacctgcctcagtggggtgcattaagattaaatacatgaggacatggaagatgccagaaagctgcctgacatgggtgagctctgtgtgaggttcgtgcttcttggttaacggggaacaggacagagagaagaggtgacagagacaagcagctgctcggccccatccctcccgcagcaaggcctcttcagggaaacccagccccggcggctctgtctagtccctgagcacagcaatccctcctcaggggaggatgagattcttgagaggctggaaggggcccagcatgtttgtccaggtgagctcactgtgaacccagccaaccaaccagggaacacggacagacagacagaccgcagagggagagcatgtccagggccactggggatgcagagccaccaagattctctcaggaaagggaggccgaagggaggcggcttccctccacaccatctgtgaggagtctcattgatggcgggacagggagtaagttaggcctcattaccttttaaaaattattatgaaataggtaagacacagggaacgtggaacacaggagcacctgtgtatcaataacccaggctaagaaagtaaacatgtccacagttacaaccaccaccgcaggcccaccccaccctcccagcgacagcccgtctccaccacactgggactattaatcccttcccatcaccttctcaacagcccagagtccttgcttgagctgagtcagaagatgcgcgcaccagcatgtcttggtcgagctcctggctggcccctgagggccacgtcactctgaccccagccctgacccatgggatgcacaagctgggacagacaaaagcaactctatgtagccaggaacagcccagagctagaactcagaaatatggctccaatctcactgcaggtatcgagcaggaagaggatcatccagggacggacagatccaaggtatctgcacggctacctcaggaatcctgcccagccacagggagggtggtggtgatcccaacacctgggcccagccttcctatgcaagggacccacttagggctctcctggaaatttgcagaagcttttgggaaggaggccagggagacgggaagcaatttccctactccactggaggcagctgagccttccctggcaaaagcagatcaatagtctgtgtttctgctgagtgaacttgacaaatgggactgagaagacactgcgtgatagatccaaacccaacctgaatccaaacctaatccgccaccatgcacaggaaacagaaaagccaggcacgggatcagaaatactgttgacagtctaaggacttgggtaggaatagccatcccaaatcttccgtttccattctctgaaggagctgcccttcttctagggccagtctaggatggattcagataaaaaaggaagacaggctagaatcatcctgtcaacctttactcaataactgttatgtttcaggcattgtgctggcctcagggtacagagataaaagatatagtcccttctcaaagatttatattccagtggagaagataaagagtaaataagtagtatcactatagacataaaatggaacctacatacatggaattagaggagcatgtgctgtgtgtgtgtgtgtgtgctgtgtgtctatgtgtgtgtggtgtgtatgtgtggtgtgtgtgtgtgctatgtgtggtgtgtgtgtgctgtgtgtggtgtggtgtgtgtgtgctgtgtgtggtgtggtgtgtgtggtgtggtgtgtgtgtgctgtgtgtctgtgtgtgtgctgtgtgtggtgtgtgtgtgctgtgtgtgtgcactgtgtgtctctgtgtgctgtggggggtgtgtgtgctgtgtgtgtgtgtgctgtgtgtgtgatgtgtgtggtgtgtgtgtgtgctgtgttgtctgtgtgtgctgtgtgtgtgtgtgtttggaggggctgggtggttgagccaaggcttctctgagactgagctgggcatggaagcagagaggaaactattaaagctcaaactgccaaactgctacagggtcaaaagggggcgctggtggggctccacagcctcaccacagactgaagctctctgtgccccaactactaagcaggatttataccaggctagggaagctctgtccataagggctacctaaggggcgttaagtgtactctgtttcaggaagacctctgtgaataactgcatagaacattagaaatcatatacaggtccttagtacttacacgtacctgcttagaaaggtttcttttcccccttagagatagggtcttactatgttgcctaagctagtctgaaactactggcctcaagtgatcctcctgccctggcctcccaaagcaccaggattacaggtgtgcaaaaccactcccagcttagaattttttttttttttttttgagacagaattttgctctttttgtccaggctggagtgcaatggtgagatctcggctccctgcaacctccgcctcccgggttcaagagattctcttgcctcagcctcccaagtagctgggattacatgcatgcgccactgggatgcccagctaattttgtatttttagtagagacggggtttcaccatgttggccaggctggtctcgaactcctgacctcaggtgatccgcctgcctcagcctcccaaagtgctgggattacaggtgtgagccaccgtgcccagccagaaaaatttttaaacatgtaattatataatttcctatttatcatttcaataaagctccacttataatatgcctactatatacaaaagtattgtttgctagtatttatttagactgtgagctccttctcaaaagaagaaatgtcttccctggcagctcagaagctccctggatgtggggacctgagtgagatatgcacttaagcggggggtcctgtcatctccccttcctaaatctcatcctctcagcactgtcttcaatgcaaataagtccctgctactcagagaaaggtcgctgcctccgaatggaaagtgtgctttctcccaaccccaccagagctgctttccagtccccaggcccaatcctcaagttgcacaatgtgcctccaccgcgcctcaccttggatcctcaggctctcctggtactggatgatgaagtactcctgagtctgctgcagcttttttaactcattctctgtgtcctgcgtgaccagtcgcagctcctcaaacgtctggttgatctggaggtgtttctgggacatggcatcagcaaggcttccagctggagagctaccctgggaacatatggggggcagtgcaaggcagtgcgaatgggaggaagactgaggccttaatccccaggaaaagccagctcctacaaccagggtaagaccccaaaaggtaaattttgagtcgggaggaaaagcaaacgtcatcatgagacacagggtggagtgggaaaagtgagaaacaggtgagcggacagatcatggctcagatcacaaagcatgggagaagcttccatttcagatctgacctccaccagagtattccaaacgaggtccattgaattacctttggagaaactagaacgtaacctggtccagtgtcacctgggttttcctactaatgaggaggtggagtgattcctcttccactcactgacccaatgcaaggacggcattaagcattagggaggccatggggagcagggccatgtgaacacacatcatctgtgtcctcactcaagatattctcgtgatggaatcatttgcttccaccatggaagaggccaaacctcttgcaggcatcctggagaccccagggtgaagtgatgggggaggcataaacaaggtctctgtggacccagccctgtaagtgacctgatcagaccactccttccacacctgattcaggggctagggaaaagtctttcctaagtattctcacctgaatatgagcatgcctttactaaaaaattattcagctgaggttgaattactttgcacttgttcacattgtcttgtggttgcaatctcatcaaggttataaatcagttaagatcagagaccacatcttctatttcatttttttttttttgagacagggtctcactccatcacccatgagtgcaggggtgcgatcatggctcactgcagcctctacctcctgggctcaagggatcttcccacttcaggttttcgaacagccaggactacaggcatatgccaccatgcccagctaatttttttgtatttttggtagagacggggtttcatcatgttgcccagggtgctctcgaactcctgggctcaggcaatctgcctgcctcagcctcccaaagtgctgggctgcactcagtcaagtctcctatttcttttgtgccccttaggatgaagctctctttaaagagacaccaatagtgcaccctgagtcaccttgacaaaggtgggtccagagggaggtgggtaagaaaagacttcccgactgccctccccatccctatgggacactcacattgttggcttctcggaccaacctctgttcattgtacaatatatggcggatgcagcggaccagctccatggggcagcggtcatacgtgttctgaaagaatccaacagcagacatcactttgtgccactccacactatgggccctaaccatgcctcaggatggggagcctcctgagggacctcctgaatcacaggaggcactgttcctccaataccaacaggaacaagaaggcacatcatggaaatccaattgcagtgaaaaggtaagattgttttacttcttttttctttttttgagactgagtctcactctgttgcccaggctggagtgcagtggcacaacctcgggccactgcaacctctgcctcctgggttcaagtaattctcctgccttagccccccgagtagctgggattacaggggcccgccaccacgcctggctaatttttgtctttttagtagagatggggttccaccatgttggccaggctggtctcgaactcctgacctcaggtgatccacctgccttagcctcccaaagtgctgttttactttttgcatcttaatttgcctaaagtatccggggaacattcttaaaaacggaataaataagttttaaaagcctcgcaagaggagaaactggatgccactctcaaatgggcaatcaaaactactaccaccaatgaggggacgagggacactgcccccctctggatgtgatacccgagaaggacaagtcacctacaattgtcccttggcatctgtgggggctggttccaggacccacttggataccaaaatctgcagatgctcaagttccttatataaaatggcatcgttttgcatagaatgcatacaatcctcccatacactttaaaccacctatagattgcttatactatctaatacaaaagaaatgctatgtaaatagctgttctgtcatatctttatttctatttgtttttactttttttcttttcctgaatatttctgagctgcggttggtggaatcaggatgcagaacccatggacatggacagccaactatatttagaagtctgctcggagatgtgcaatgttaacgtaatcatgaggaaacatcagacaaaccccaaatgaggaacattttatctttaaaaagcagggggtacatgaattattattattattttttgagatggaatttcactcttgtcacccaggctggagtgcaatggcacggtctcggctcactgcaacctctgcctcccaggtttaagagattctcctgcctcagcctcccaagtagctgggattacagttgtccactgccacacccagttaatttctgtatttttagtagagatggggtttcaccatgttggccaggctggtctcgaactcctgacctcagatgattcacccgcctcagcctcccaaagtgctgggattactggtgtgagccactgcacccagcctacattaattattttaaaatgccaatgtaatgaaagacaaagtaaggttgcaaaatggttccagattaaaggagattaaagagacatgatgactagatgcaatatgtgatcttgggctggattctggactgcagcggggaaaaataccctaaaggacatgtttgaattagttgacaaaatggaaatccagatgagtacctaaaagtattatatcaatgctaaatttagtgaagttgatcagtgtattataaccatgcaagacaaggttcattcttagaaaatgcacagaggggctgggtgcggtggctcatgcctgtaatcccagcactttgggaggccgaggagggtgaatcacctgaggtcgggagttcgaaaccagcctgaccaacatggagaaaccccatctctactaaaaatacaaaaattaggcgggtgtggtggcatgcacctgtagtcccagctacttgggaggctgaggcaggagaatcacttgaacccgggaggtggaggttgcggtgagccgagaccgcgccactgcactccagcctgggcaacaagagtgaaactccatctcaaaaaaaaaaaaaaaaaaagacaatgcacagagggaccgggcatagtggctcatgcctataatttcaacactttgggaggctgaggtgggcggatcacctgaggtcaggagttcaagaccactgtggccaacatggcaaaaccccgtctccactaaaaataccaaaaaaaaaaaaaaactgccaggcatggtggcaggagcctgtaatcccagctacttgagaggctgaggcagaagaatcgcttgaacccgggaggcagaggttgcagtgagctgagattgctccactgcactccagcctgggcgacagagcaagactccgtctcaaaaataaataaataaataaataaataaataaataaatagaaaatgcacagaggtacttactggtgcagggacacaaggtatgcaacttactctccagtgactgaaaaacgtgtgtgtcgagagacagcgaggagtatatgacaacataaaagtcaacaacaggtgaatatgggcatatgtggggaatctttgtatgattcttgtaactttctggaagtatgaaattattctcaaataaaaagtaaaaaaaaaaaaaaagaccaaaaccacacaacaagaaccttatgcacgtgtaactcaacaatgctggactgaaggagagaaagaaagtctctacaggaagaagacccccaagggaaggtaattaagtgtgaccccagagcccacacccacctggagctgtgtggcatagtgccccagcttgatcttcagtaaaaacccatcttcccccacctggtgctctgccttcttctgcagctcctgcaccaggccctccaggagctgggtggccttaatgttctcctgtggattatcaagatctactgagtccctaggggaaaaaaattacataatctgtatacatacatgcacgtgagcctgtataaatacagcctcaacacatcctactttttcttcaactaaagtgatgtttttaatcctcactgcaaattttaagaaacagcccaacagaaatggactcaatgcctatgttaatctatttgtaatttactaaatagttggattatacagtagatttccttcttttaaaaaaaaaaatttttaacaatgtgctgcccttcttcctttctctcaatgatgtgcttggtgcttatgctatttgctccgagaaatgcaaggaaaaggaaagggttctgtgtactctgaaggaaataaggacttggataatttcctatttatagttacccctcatgggtgtaaaggaggcacaaggccaagactcttctacatgtcctttccagcctcaaggagtttggtatctgtgggtttcttaggtagagacaggtgaaacaagttattgctatttctaagaagccctggaaatgagacattcaggcagagggtgcctacaagaatttatacgagtcagacattcatgtcactagttgcagacccaggacctgaaggcaatgccaacttttccagtaaacaaggaaaaccacgctacagactttgcattgatttcaagctactgaactggtgacgggggttggatggtctccctccctcctttctttccttctttccttctttccttccgttccttccttcctttctactacttaggcaacaattgacactgggaagtaccaaattacttactcactgaagaaaccaaacagctgtcggactgaaataacattcaataactgctgactgggtctggagccaaacaagatagtggtagctaaaaggctctgccatccctaaatccctgaagatagcaactaatttcaaaaaagaggcaccaacaagtgtatcaaaacagtgagaccggccgggcgtggtggctcacgcctgtgatcctagcattttgggaggccgaggcaggcggattacctgagctcaggagttggagatcagcctgggcaacacggtgaaaccccatctctactaaaacacaaaagaaattatccgggcgtggcggcatgtgcctgtagtcccagctacttgggaggctgaggcaggagaactgcttgaacccaggaggtggaggttgcagtgagccaagattgcgccactgcactccagcctgggtgacaaagcaagattctctctacgaaaacataacaaaacaaaacaaaaaaagcagtgataccatagtccatcaaatagtacaccccaatctgcgccttgagaaggcagttaaggcaagtcagattctaaatatgtgtgccctatgtattaaatagaatacgtattaaatgaaaggctggaaggaatgagggcagccctgcacctctgtttcaactggcaacaatgcccttggtctggaaacccactctttttctttgagacgaagtctcactctgtcacccaggctgggatgcagtagcacgatcttagctcactgcaacctctgcctcccgggttcaagtgattctcctgcctcagcctcccaagtagctggaattacaggcgtgcaccaccacgcctggctaatttttgtatttttaatagagacggggttttaccatgttggccaggctggtctcaaactcctgatctcaagtgatccacccacctcagcctcccaaagtgctgggattacaggcgtgagccaccgtgcccggccaggagcccactcttaaaaggatccagtctctgagcaaaactcacagaagtcaggtattggttctttacttgaaaccttaattctctgttaaaaaaaaaaaagacttgcttagatggcttaaacataaagaactaaagatttggctgggcccggtggctcaagcttttaatcccagcactttgggaggccgaaatgggcagatcacaaggtcaggagttagagaccagcctggccaacatgatgaaaccccgtctctattaaaaatacaaaaattagctcggtgtggtggcgggcacctgcagtcccagctactcgggaagctgaggcacgagaattgcttgaacccgggaggcggagattgcagtgagccgagatcacgccactgcagcctggtgacagagcgagactccatctcaaaaaaaaaaaagaattgaaaattcttcattaaaatctttatattctgaagaaaaccaaagctaaaaaatttcaagttttccttaatatcaacacaagtcttttaattcattcagtgagaacaccaaatgagaactctgctaagtgaaatctgaaattaacagcaacttcctactcatgtttttctaaatcctccacatcagaaaacaggagagaaaatgaaaagggagtggaaagcactaaacgaggtacagctgacattctcatatttagctaatttttttccctcacttaattacatgaagttgagtttttttttaattgcctagaaaattgcctttctttggtgatctttagtttctgaacagaaatttgctactaacacgcattgcgattattctaaggcaacattacagacaggtatatggccctttgcaaatagcagcatcaaagctggttctctcagggactgtcaaagaggacccatggctaagacggtgaggcttgaagtatcaaatgaatatgtcagatcgactgacagactgtaaccaaccagcaacctcccagaccttgagcagagcagtgtacatcctgctgcctggtgtgtaataatgataccaattaaaaacctgtgctgttagtcgactgcactgtactaattctaaaagaaatttaaaacaactctcccctcccccaagtatgtaatcagtaatctggaaaataaagaaaaattaaaatgcttatcaaatctaccaccagaatgtaattagtgttaacatttgggtatattttcgtttagttttgttttttttttttaaaggcagtctcactctgttgcccaggctggagtgcagtagtgcgatctcggctcactgcaacctctgcctcccgacttcaagcgattctcatgctttagcctccagagtagctgggattacaggcgcccgtcaccacgcccaactaattttttgtattttcagtagagatgggattttgccatgttggccaggcttgtctcagaactcctggcctccagtgatctgcctgccttggcctcccaaagtgctgggattacaggcatgagccacaacacccactcaattttcttttagtctttatgtgtatatataaaatacatataaattaaaaacaccaatgtctccactgttaaattattaatttttagttttttgttagatgtaaacttattaagaaatgtaaaataatttatatttaataaactataagaaataaattataattaaattatatgcatattcacacctatctgccccattaaacactaaattattattattattttttgacataggatcttgctatgttgcctaggctggcctcaaactgctggggtcaagcaatcctcccacctcagcatcctgggtagctgggattataggtgtgcaccaccatgtccagtgaaacactgaattatctggagatgagggctttaattttgtttgtttgtttgttttgagacagggtctcactctgttgcttaggctggagtgtagtggtgtgatcatgggttacagcaacctttgcctcccaggctcaagtgatcctcccacctcagcctcccaagtagctggtactacaggtgcacaccaccacacctggctaatttttgtattttgtacagagacagggttttgctatgttgctcaggccttccttgaactcctgggctcaagcagtacacctgccttggcctcccaaagtgttgggattacaacacaatgttgggctttaatttttttcatataaattctactacttaggacactgctaggcatcccatgggcactcgaaacatatttgttggctgctctttcttagcagtaatattctaatgcttttagacagtatttactattaaaggggaacaaatcctgttttaaaaatcccaagagttattccatcccctcaatctaagatgggcttaaatacctttcacctataaaaagaaaaaaaattttaaatacctttttatggatcacatttaaaaatgtttaaaaatacaactttgaaagttgccatcatgacatctttctaaacaaactccaatattcttgtgtttcacaaaatatgatgcaaacatccttgttcacctaccatgcttggctttcaatccactgggataaataatgccgcacctcaatgggaaaatgctggccatataacgcttgcatctgatgaagggcttctccttggagctgctgagcttgtatccacacagccatggtttacaatctgttgaacaaacaatcagtgctttgggcgttttttctttattttccccttacatccaccagagtaaatattcacttagttaccaaggtaaatgtttttattttattatttatttttatttttatttttttgagacagtctcgctctgccacccaagctggagtgcagtggcacaatcttggctcactacaacctccgcctccccggttcaaatgattctcctgtctcagcctcctgagtagctgggattacaggggcacactaccatgcttggttaatttttgtatttttagtagagatggggtttcaccgtgttggccaggctggtctcgaactcctgaccttaagtgatcctcccacctcagcctcctaaagtgctgggattacaggcgtgagccaccacgtttggccaaagtaaatgtttttagcccttttggtagactaaagacaatattcttgaactgaattttaactttaaaatgttttcaaaatgtagacactcagcctggccatggaaagatacacagctgggtctatgaagctctgactatgaaatgtactaaggtcttataagcaaaagtacaaaaggagaattagggaaagaattgctaactttgacatcgtagacatattctttacttttgttcaaaattgtcagccatggtaagcagcatttcaacagtaataaataattagcagagagtttttttttttttttttttgagacagagtcttgctctgttgcccagactggagggcagtggcaagatctcggctcactgcaacctctgcctcccgggttcaagcaattctactgcctcagcctcccaagtagctgagattacaggtgcccgccaccgcacccagctaatttttgtattttcagtagagatggggtttcaccatgttggccaggatggtctcaaactcctgacctcaagtgatccatctcagctcccaaagggctggggttataggtgtgagccactgcgcccagctgagagattttttttaaaaaatcacttgttttagatttggtattttgacttcagaaatataataaacatatgccattttgaaaaagcccagtaaaagaaaagtgaaaatatctgaagtgttgattgaaccctatgcattatcactagttacctaagcagcaatgctttgcacacaaagagcacagatttatctggaaaaatgcccgaaggttcacctcctgagttactgctaaggaatttatgaagcaatgttgttaaattatagcatttacaaatctttcagacacaaaaacaatacattccacctaagagttggaaatatgaaccattatactccaatagcaggtagtttctttttttttttttttaatttgagacggagtcttgctctgttgcccaggctggagtgccgtgacgcgatctcagctcactgctagccccgcctcccgggttcacgccattctcctgcctcagcctcccgagtggctgggactacaggcgcccgccaccacgcccggataattttttgtacttttagcagagatggggtttcaccgtgttagccaggatggtctcgatatcctgaccttgtgatccgcccacctcagcctcccaaagtgctggaattacaggtgtgagccactgcacccagccggtagtttctttttttaacatgctcttgattttttaaagaaaggctttataaaactaccatgatgcccccctcagactcacctgacaatttttaactcatctggcagatgctctttgagtttaaccagattagggcagaaacatttgggtagactgggaagggacttcaggtaactctaaggactgaaaatgaatcttgctctaacactattttccataatgtagagtttggtataaggcagggttatcttgaattccatcccacatgatttggctactgatttgcacaattcttctaagaactaggttacagttaggggccggtgacttggacttggattttgtttactaccagagactgtacaagtgtgtcaggaaataaaaatctcttctgttagttgtagttgtctgatcacgtaacactgggctatttatgggacaagtcagttagccaacaatgaggtgtaggggagtgccagttatctattttagactagtgcaatgctatagaacacttgagaagtgtattatttagggcttttaggcattaaggctgggatcactgtagacccaatttgacccaagacatcaaatttcagtggttgtgagttcaccaaaacacttagataaaagagctctctccagaagcaattccactttataatcaaacactggaagtcacttaactgcacaatgtattttttaatcaaataaatcatatcgcaagattttggaaaaccagaacagataccaaatcatgatttttggatgaaggataaggaatggatggccaggcatggtggctcacgcttgtaatcccagcacttcaggaggctgaggtgggtggatcacctgaggtcaggagttcgggacaagcctggccaacatggcgaaaccccgtctctactaaaattacaaaacaattagccaggtgtggtgccatgcgtctataattccagctacttgggaggctgaggcaggagaatcgcttgaatctgggtggcagaggtggcagtgagccgagattacatcactgcactccagcctggcaagagagccagattttgtctcaagaaaaaaaattatataagggatggatgaatgaaggtgcttaggcacttaagtatatggaagagtgataaaagaatgaagagaagaatctaggtgttagtattcctaagtagtaaagagtaagaagtaggccctcaccatagctctcaatgaatatgtgagtgataccaacagatacaaaaattctcttgcatctgcattcattaggtgaattgacttcagagacaaaagaaggaaagctatgaaaacttttatctccccagagactccttcccagcccactcaaataaaacggcattctggtcactctctatcctcttaatctgctttatttttcttatcatttatcaattcctgatattgatcatatatttgcttactgacttcccaccagggtgaaatcaccatgaacacaatgactttgttttgttcaccgtgctttctcctgggtctagaacggtacctggcacataagcatcataatttttttgttgcataaataaatgtatacacacaatttgaccgattctattggctcttttcaaagttataattgaacaatatatcagtatgaaacaccaaggcatgaaaatggaacagatttccatttaaataatcaattacaattttttttttttttgagacggagtcttgctctgtcgcccagactggagtgcagatatctcagctcgctgcaggctttgcctcccgggttcaagcaattctcctgcctcagcctcccgagtagctgggactacaggcacacaccgccacgcccagctaagttttgtatttttagtagagatggggtttcaccatgttggccaggatggtcttggtctcctgacctcgtgatctgccctcctcggcctcccaaagtgctgggattacaggcgtgagccaccacgctcggccaggagcacatcttattcacgactgtgtccccagtgtctagtacggtggcttgcctatggaaagtggtcaaaaaatacttgcggagcgaataaatacacaaacaaatatttaacattccctgctggtcaagcatatttaggagcctattactgttttaggaaagaaatactgtggtgatatactatgcatgtaggggtattaaaaaatgtcactctattttgccttaaattttagattatttcttagttttcatcaaagagtagaatgctgagctcttagaatttgtagaatatttttatgattctagttatgaacatgccataataattattttctaaaatagcatcccatttgaaggataatagctggtaaataccaagtggcaatcaccttattttgataaatacaatatagtttcactacacataagtgctttgatagagctggagagtagattctgctcactgctattcaaaagtgtaaaataaaagtacactaactagtacagagtcatttttattttactgttaaactgaaaattatctatatgtgaaatatgagatgacttactgagattatcattataaattctaaacacccagtttaggaaaaaaccaactgttctcccagttacgtgaataacacctagaagctatgtagtggttttttgtttgtttgttttttgagacggagtctcactctgtcgcctaggctggagtgcagtggcatgatctcggctcactgcagcctctgcctcccgagttcaagcgattctcctgcctcagcctcctgagtacctgggactacaggcactcaccaccacgcctggctaattttttttagtagagatggggtttcaccatgttggccaggttggtcttgaactactgacctcaggtgacctgcccgcctcggcctcccaaagtgctgggattacaggcgtgagccagcgtgcctggcagttaagtagtatttttcttcatacatgtcacaactcttcaccccattatcaggctatgtccacatgcctgatatgagtagcattcatctaaccggcattcatccttctaactggcattcatctagccatcgaacgctactctgcatctacaaagactgtacctctgtccccagtacccgccatcttctgcttatttacgggcagctccaatttcagtgcgtgatgctcagacaagggaagtagtttgttctttggtaaatcatcacaggggattctctaaagactgggaaatggattcacaatcttatttttaggccaaagatgagaactatttgagctcggctgagttgcactctgtgttcacagacatttcagaacaacctaagacagccctggatgcagaaccctgtactttctgaaggcataaagcacctacctcaaccttatatatctggatatacccatgggcttggagagccaaataaatcagtcgggccctcaggcacttgttaataaaagtttcaaagtctaatagctcataatgttacaggcttactgaaaaccataaaaatgaatgtccaccacataaataaatgatataagtgagtgggatttggaataattttgtctcagtcataaatatcttttctcagatgcttttcctttctaaaagtaaaatataaactataacaaagaaaaacattactctctctctgaagacttgtagaacactgtgaccaaggtcttgccctagctaaactgcagtggagagtagtgtctgacattagaaggcccactgtgtatctgccaactcagtgaatgaattctagtgtggggtgggagtagggggttaatatgaataatattatgcataatatgaataatatgaatccagcagatttggtctgctggattcatatgtataatttaaagcattttgtaattccgattctccatcctaccccccatcccagggccaaagtctctaaactggggttaaacttttagagatgatgctgaactcacctaaatacggttctgccaaagacagcctgttaagcctctctgtgcctcagttttcttatttgtacaatgggaataataatacttatgccccttagggggctgctgtaagaatgaattagttttatgtacatacctaaaacagtatctagctaagagcaggtgctctgtaagtactcactactgttcttactgttaccttaaacttacaaaaccggcttctttctcccatctctaattttaactcaatttaataaactttccaaaaatcaatcctccacaaatagctcttgctatccttctccttaaccaatatcctccagtataaacttttctatccatccatccatccatccatccatccatccatccatccatccatccatccatccgagacagggtcttactccatcactcaggctggagtgcagtggtgtgatcatggttcactgcagcctcaaactcctgggcttgagggatactcctacctcagccacccaagtagctaggactgtgggcacatgccatcacacctggctaattaaagaaaaaaacttttttttttttttttgtagagacaaggtcttactatgttgcccaggctggtctcaaactcctcacctcaagtgatcctcccaagtcagcctcccccagagtgctgggattagaggcacaagccattgtgcctggcctttttttttttttttttttttaaggcagagtctcgttctgtcacccaggctggagtgcagtggcgtgacctgggctcactgcaacctccgcctcccgggtttaagcaattatctgcctcagcctcctaagcagctgggattacagctgcccgccaccacgcctggctaattttgtatttttagtagagatggagttttaccatcttggccaggctggtcttgaacttctgaccttgtgatccacccacctcggcctcccaaagtgctgggattacaggctgtgctgggcccttttaaaagatggcattcctatttcttaatcaatttcactggcacaaggacttctgcagacaggaactcttgggaggtggtggtggaaaggcaccatgaagtctgttctctcatctttgaatgaaagaatggagaattgtgaagggtgagggtggtacagtaacagcaaggctttgattttgccctatgcatactaaactcttaaaaaaaaaagaaaaaagaagaggccgggtgcggtggctcatgcctgtaatcccagcactctgggaggccgaggtgggtggatcatgaggtcaagagatcaagaccatcctggccaaaatggtgaaaacccatctctactaaaaatacaaaaattagctgggcgtggtgccatgctcctgtagtcccagctactcaggaggctgaggcagaagaatcgcttgaacccaggaggcagaggttgcagtgagccaagatcatgccactgcactccaagctggcgacagagcaagactctgtctcaaaaaaaaaaaaaaaaaaaaaggagaagaaaactacctattccattccttctaatatgttgttgaacagagaggactaagccagcagggagccatgcctttacctattccttccaaggacatatctgacttttaataattaaagtacaaaaaacaactaatgaaatttgaagttttcatttattatactgctttatgaattattagcaacaaatatttcaattcatctaataaataaaaataaacttcagaaataggataagaaataaataacatttatcagtgttattattatcccccatccagatttaagagctagctaagcacttagtatattacttataacaagtgcttttatgaatctactctttatcctaaatccctcagacgtaggcactattattatccccgttatggatgaggaaattgagggtcatcaagattaagtagaattgtaacatggtgaaacagttttggaaaactatctggcaattctacaaaagggtaaacatagagttactacattatccagtagttccactcctgggtatatgcctaagagaagtgaaaacatgtgtccccagaaagtgggtacacaggccaggtgcagtggctcacgcctgtaatcccagcactttgggacgctgaggcgggtggatcacctgaggtcaggagctcgagaccagcctggccaacatggcgaaaccccatctctactaaaaattaaaaaagaaaaaaatgagccgggcacggtggcgggtgcctgtaatcccagctatttgggagactgaggcaggggaattgcttgaatctgggaggtggaggttgcagtgagccgagatctgtgccactgcactccagcctggatgacagggcaagcacagcaagactctgtctcaaaaacaaagcaaaacaaaaaacaggtacacaaatgttcacagctgcattattcataatcacctcataatcgccccaaagtggaaacaactcaaatgtccaccaaaggataaacagataaatatggataggaatggataaatacaatgaataaaatggaatattatgcagatgttaaaaaggaatgaagtactgacgcatgctacagtgtggatgaccttgaaatcattatgtaaagtgaaaggcatgcaagggaacatactgtaaattccatttttatgaaatatccggaataggcaaatccatagagacggaaaatagattgttggttgccaagggctgaggggagggagaaatggggaatgattgctaaaaggtaagggctttttgaggggatgatgaaaatgttccggaattagatagtggtgataattgtataactctgagaatatacttcaaagggtgaattttatagtgcgtgattatatctcagtaaagctatttttaaaaagagaaagaggtgaaacacttgctccagggtcggtccatactactaaggggtactatctgggctggacctacctgagaacctgcacttacttgcaccactgcaccaggctgcatgcatgttgaggacttaaggtggtttgccattttctatgtacttttctgcctgtttgttatatttcataatttaaagagagcaaagaatgaaaaattaaagtaagaaacctaatactgaggggctctgattttggcaaaggctagggctgggtgacagatcaaagagatgacgtttaaacattgcttctgatctgaaaagtacaaggcaaggagccagggttcaaaactgttaaacctatcagctccagtgaatgactaaggattctgtacagaatataaagagcaagttccagccaggcgtggtggctcatgcttgtaatcccatactttgtgaggcagaggcgggcagatcacctgaggttgggagttcaagaccagcctgaccaacatggagaaaccctgtctctactaaaaatacaaaaaattagccaggcgtggtggtgcatgcctgtaatcccagctacttgggatgctgaggcaggagaatctcttgaacctgggaggtagaagttgcggtgagctgagatcgcaccattgcactccagcattggcaacaagagtgaaactccatctcaaaaaaaaaaaaaaaaagagcaaattccctaattatgtttactgctttctgttgataccaacattattaaatatattaaatggtggtggtcacctagtacagcaatttttttttttttttgagacagagtcttgctctgtcacccaggctggagtgcagtggcatgatcttggctcactgcaacctctgcctcccgggttcaagagattctcctgccttagcctcctgagtagctggaattacaggcatgtgccactgtgtctggctaatttttggatttttagtagaggcagggttttaccatgttggccaggctggtcttgaactcctgacctcaagtgatccacccacctcggcctcccaaagtgttgggattacaggcctgagccaccatgcctagcctagtatagcgattttgagggacggaaaaatattcaatagcagcaataaaggattaagacttcattcatattaaaattggactaatatcaagtaagaaggctatcacatctagaagcaggttaataccagagccatctgctctttaattttttttttctaaatactaccctatatgcaatcaggaagccaattctctttttaaaaaatcacattattaaacagatgggaagagaacagaaagaataaaagcatttggctcacaaagaagcaaacaaggaaaaatgtgcccaggcaacatagagatgatagtattctgggaagacaatccgccattaatctttatgtcacagccaaatcactgcatattacaataggaagaacagagaatggaggaggggaaaagggtaagggagggaataaaggagaaggtagagaaaggatctacttactaaatataaaaatcaggtttcaatcagcaggttactatatatttaaaactctcatctaaatataggatataaagtcttggccaaagatgcacaatctcaaaaataaagagagtagactcagacaaggatcatcacagctactaaaaccattaggtgacagttgttggggaacagcatttagtctcaaagtactactcacatattacttattattcaaaggggaaaaggtgcatttctgtggataaatctggcggacaatgccttaaccgagtgatcaaacatccccaatcatggcataaactgacattatgtgcctccagatatgatttgctgaaaagaatacacaaactaaatcatgaagaaacaatcagacaaatccaaattgtgagactctaatcaatgatcccaccccccacccaaaacaggtggaactgttctaggttaaaggagactgaagagacacaaccaagagcgtaattcaaaaacaaaaacacgactgggtgtggtggctcatgcctgtaatcccagcactttgggaggccaagcccagaggatcactcaaggtcaagcattcgagaccagcctggccaacatggtgaaaccctgtctctactaaaaatacaaaaattgtacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccacagggtccctctgcctaggaaaaccagagacctttgttcacttgtttatctgctgaccttccctccactattgtcctgtgaccctgccaaatccccctctgcgagaaacacccaagaatgatcaattaaaaaaaaaaaatgttaaaaataaactttaaaaaatatatgtgtttatacttaaaaaaaataaataaaaaaaaaatataaaaattagttgggcgtggtggcacacgcctgtagttgcagctactctgaaggctgaggcacaagaatctcttgaacccgggaggcagaggttgtggtgagctgagattgcgccacttgcactccaggctgggcaactgagtgagactctgtctcaaaacaaacaaaaacacccacagctctaaaggccattatatcattatatattagatattactttatcactgctaaatttcttgagagtgacaatggcattcaggttgcgtagaagaatgcccttgctgggagtagatacactgtcaagtatttgagggtaaatggccatgtcgtctgcatcttactttggcaggagaaacggaagagtgacagtggtggggagtgtgggaaagtaaatctaacaactgtgaacactggctcaacctaggtgaagtatatgcgagtactcattgttctattctttccacttttaagtcatgtacacttttttcaaaatcaaaatgaagggcaaacattccaaaaaagaaaaacaaagcaatgaaagcagaggtttgactctcactttgaaactgtccctggtggtcaataaaaatctggacttcttaggcgttgtgctgcagcttgcaggccaccagcatgcaagttgggctctcttgtgccatggtggcccacagtgtacatgtgttatcattatctccatgtccaaatccatggagataatggatttgcgatccctttgggaagaagctacatctgtatcactttccagatgactaaaagcacttgctgtagcccaaaattaatgaccatctgcattacggaaaaataagaaatgatttgaagctgccatgtagtcctatcttaccttcagaatttttttctttcttttcttttctttttttttttttgagacagggtctcactctgtcactcaggctgaagtgctatggcgtaatcactgctcactgcagtctcaacctcctgggttcaggtgatcctcctcccttagccccctgagtagctgggaccacaggtgtgtgccaccatgcccggctaatttttttttttttttttttagagatggggtcttgctatgttgcccaggctggtcatgaactcctgggctcaagtgatcctcttacctcggcctcccaaagtgctgggatgacaagtgtgagccaccacacccagccagcctcagaatttctagtgaaggtttatatttgtactgtaattcaagatcaactcatcttagaatctgtctcttggacaattcaaatcttttagttcaggaaaaaaactcctcagctactacaataccctgtttctatactgcttaaatgaaatataatccctttcctcttgtttgaaagttaaaaacaaacaaaacaggcaatttattaataaatccacacatgttaccaatattttccctattaaagttcatggcctccctcttaccattgagaattacagtgtttagtttctacctagcaaaattttctttgacaagtgccttgattcaggccaattcccagggatatataccgtcgggacaaacagaaataaccaaaatgtccaaaatagggggatgattagactataatgtattaatctaatgggatatggtgcaaccagttaaatgaaatataaaagctatgttgaaatataaaaaccatgtagacgcatttttaaatttttattttatttatttatttttttgagacagagtcttgctctttcaaccgggttaaagtgcagtggcacaatcttggctcactgcaacccccaccgctcgtgttcaaccaattctcttgtctcagcctcctgagcagctgggaccatagataggcatctgccaccaatgcctggctaattttttttttttttttttttttgagatggagtctcactctgtcacccaggttggagtgcagtggcgcgatctcggctcactgcaacctctgcctcccaggttcaagcgattctcctgcctcagcctcccgaatagctgggactacaggcacgcgccaccatgcccagctaatttttgtagttttagtagagacagggtttcaccatgttggccaagatggtctcgacctcatgaccttgtgatccgcccaccttggcctcccaaagtgctggaattacaggcgtgagctaccgcgcctggctgagtcttgctctttcaacagggttaaagtgcagtggcatgatcttggctcactgcaacccccacctctcgcgttcatgcaattctcttgtctcagcctcctgagcagctgggaccataggcatctgccaccaatgcctggctaattttttatttttatttttttgagacggagttttgctcttattgcccaggctggagtgtaatggcgcgatcttggctcactgcaacctccgccccccaggttcaagcaattctcctgcctcagcctcccgagtagctgggattacaggtgcccaccaccatgcccggctaattttttgtatttttaatagagacgggttttcaccatgttggccaggctggtttcgaactcctgacctcgggtgatctgcccacctcggcctcccaaagtgctggaattacaggcgtgagccaccccgcccagccctaatttttgtatttttagtagagatggggtttcaccatgttggccagcctggtgtccaactcttggccttgtgatcctcccacctcggcctcccaaactgctgggattacagatgtgagccatcacacctggcctgtagacacatttttttagagtagaaataaaagaatgttaaatgaaaagtgtatgcaacacgtatgcaagagggcaaatagagaaaggtcaaagagaagtgtaaacagttgttacatttaggtgaaggggctttttggtacaatttttgtaaagtttttgattaaattgtgtttaaaatgtaaaacttaagatataaatttaataatcaatggggaattggtactactgactatcccacaggaaccaagtttaaagagacataaaacacaggaagaaatatttcctaacatgataatatccaggttatgacactgtcttacctgggcagccttgatttaagtagaacattcagaattataaagtaaaaattcagaattataaaaaaattttaattttaagtagaacattcagaattataaagtaaaaattcagaattataaaaaaattttttttaaaatgcaattctttcactttcaaatatatagtgccttaaatgtgttttcaaatagtgatttaagactgttaatagcagattaatttgtaattctgacatatatttatatatattagtggccctctttcatctttgatgtgactaagcaaacttgtaccaactgtaaatagaacgaaatacacagaaagtcactcacaacggtaccagaatttctttaaaataaaaaactttctagctgggcatggtgactcacttctgcagtccaagctactcaggaggctgagacaggagcgctcccaggaggtcaaggctgcagtgagctatgatcacgccgctatgctcaagcctgagccacaaagtgagaccccatttctaaacacaaacaaacacatcccttacctctaatcacatacctgaacacaactggcttacgtgaaggccgttgacagttcaagagtaacaattcaaggtgtctagaaagctatcattacaagagcagatcacaggaaacctcagctgttggttcctaacttcgctcctactcaaaggccaacagaaccggggagaaatcttcctgttttgttgatatcaatttattttgtgccaagaacctatacctaaaaccaacgcagggtttgtattccccctggattcttcattaccccaggaaagtggaacagatcagaccagtttccaagaacagaagcactgcagggcaatcttgctaagggggccctgagatgtttctctctgtactaatctctatgtcttttatgtacatcaacacaaaccttcacccaaccatctctgccatcaacagcaaatctagggaagagaccaataataccttagaaaagcacacctatccaccgaaccaaaactaaatacagaaggatatggcagtttgccccgttttccaggtagctgtgttctcttaatttgccatgaattaaaatgtttcatttttacttagacataacttgaatatgtcatttcaaataacaaaataaaaactgaactgaatatgttttagttaaaacaatacaaaactgaaatctcctcttttaagagagaaacgcttcatcagctggttagttcccttgtttgcttactgggtgatatgaaacccaactacagctttccaaaaataatcccaagttgtggggtgtcctactacctgtgtttaagtaaaacaagtcctgcagaaaaagtggatccaacgagtagcaggtttgttaagaagctaaatcttggccaggtgtagtggctcacacctgtaatctcagcactttgggaggctgaggcaggaggatcacctgagctcaggagttcaagaccagcttgggcaacatatcaaggctctgtctttacaaagaaagcaaaacaaaaagtagtagcgtgtggtggcgcacacctgtagtcttagttacttgggaggatgaggtgggagaatcacttgagcctaggagttagtagctgcagtgaactatgattgcgccactgcatgccagatggatgacagagccagactcattctctaaaaaaaaaaaaaatgtatgagaaaaagaagaagataattctgggccaggcacagtggctcatgcctgtaaacccagcactctgggaggccgagatgggaagactgattaggccaggagtttgaaacaagcctaggcgacatagtgagactccatctctacaaaaaatttacaaattagcccagtgtggtggcgcatgcctgtagttctagctactcaggagacaggcagaagaactgcttaagcccaggagtttgaggctgctgtgagccgtgattgtgtcgctgcactccagcctgggtgacattgtaagatcttgtccaaaaaaaaaaaaaaaaaaaaaaatcttattctaattctgagaagaaatgacatttaataagagctcatgtcttagcaaatcaaaatgtttgtcctgctggggaaaaaaaaaaaacaacaacggttatccaggtataaaaagcaattaccaggacatttaacattaagatgaactaaaattgtgcacaaaataattgtccacatttactacagcactcatagtgggagtaaataaaatgcaattacttttgctaaagcaacctactttttctggtaacagaccgtctctcactatacctctaatagtagatctacacacaacttagcatggtgtaggaacttgagtgcatgctcctacagcacacaacagatgcactgaaaggctcccacctcttaactaacagcttatgctgcaaggcatcagccaggataacggcagagcccttctgtgtatgtgttctttcacaggcggcactgttaccggaagaagcgaagagcagcgatttccttccaaaaggtcagctgcctcagacagaccaaacagaaagcagcgaattcttgccaacttcccctcctgcttctgcagctagtacgcaatagcatttagtttccagtaaagctccagataaaaacaaagcaaatgtgagacccagaatctacacaatgtcagtgtctcgcttgactgaacgaagggcagtaagatcatatggagctacgctttttcaacgtggtggaagtgttaggaaggtgagattaaacatgaagaaaaggtcaggactggaaccatccagattttataccaatgtccagaagtctccatctaaaaataagatggtaggctgggtgaggtggctcaggcctgtaatcccagcactttgggaggccaaggccagtggatcacttgaggtcaggagtttgagaccagtctggctagcatggtgaaaccccgtctctaccaaaaatatacaaaattagctgggtgtggtggcgcgtgactgtaatcccagctactcgggaggctgaggcaggagaattgcttgaacctgggaggtggaggtagcagagagccaagattgcaccactgcactccagcctgggcaacagagtgagactctatctcaaaaaaaataaaaagaaaaagaagatggtattttagagataataaatgcaacaacagataaggtccctagtcaactgataaaaaaagaataaattttgaacttattctcaaaataaagtcaagtcagtcattctgcaacatgctagggcacaggcaaggttcaatgctgacaaccagtagatatatatacaatgaatatataagtttcttagattagacatggagaaaagactgtaaaacacataacaaaaaggggaagaggatagaaaatataatttttttttttgagacagggtctcaccctgtcacccatgctggagtgcagtggcgtgatctcagctccctgcaacctctgcctcccaggctctagcaatcctcttgtctcagtctcctgagtagctgggaccacaggtgtgtgccactatgcctggctcattttttgtatttttagtagaaacggggcttcattatgttgcccaggctggtctcgaactcttgaactcaagcgctccacccacctcggccctccaaagtgctgggatgacaggcgtgagccactgcaccaaacccagacttctttaaattaagagagtgttaaactacatgaaagcctacgcattcaatcttcccagaggagcaaaattagacccttttgagtataaaagtgaaggagaaggaagggaaaatgatgattttaaacatttttctcaaccagatcggttcccggcttaactatctacacaaaacttgcgagaaaatgttacgagctcctaccccatgtcgttggctctatgtggtttctaactcgttagtttcaggttgtggtggcaacagagacaccaggctttttgtgagacaagctcttgttctaaaatgtctgggctttgatgatggagagtattttaaccccactctgagaatacctagtttgaaatgaagatagtatggagttcaaggaaaaacgtattagtttgttatgttaaattaagccacccacacacccacactagaaactgttttgtgttggaaacaaaataaatgacttcatttccaagcccttcctatacttcatcaccaaaccttaaataatagcaaaggaataagcatgggaaatgagaaaaataaagtactagcagcagtagtaatagaattataataacagtagtagtaataaatattcaaggagttttgtccaccttcggagctcaggctgtgaaccacagtggtttacttattgaaaatcatcacgaggccgggcgcggtggctcatgcctgtaatcccagcactttaggaggccaaggcgggcggatcatgaggtcaggagatcgagaccatcctggctagcatggtgaaaccccatctctactaaaaatacaaaaaattagccaggcgtggtggcaggcacctgtagtcccagctactcgggaggctgaggcaggagaatcacttgaacctaggaggcggaggatgcagtgagtggagatcatgccactgcactccagcctgggtgatagagggaaactctgtctcaaaaaaaaaaaaaaaaaaatcatcagctagtcaaatgagtttctcctgacagtgatacctgcagtttaactcctttataacacgagccacaaaatgaattatcataaaatgcaattcacaaatgaatacaaaaagattatttgacaatccaaaaaaaaaggctttaaataagactcccttccctgagggttagcactaagaagacaaaccttcaagcacaaccaaaggatgccatatttggggggtgggggttcaccttcattcttttaaatcaatcagaaattagccaaaagctttagattgtaaaagtgagtgggaggagaataacgagaactgtcctgggcttgggtaactttcccataaggccaaaacctagatcctgaccacttgtggtcagaattagcaatgcaacatttcctataagaagctgagttgttaactttgttaaacttgttcgcaaattccttaaggggcttccattagttacattattatccatcaccaatatttatcacagaacatctgaaacttaggctttctaatggcagaaaacattttacatacagggggaaatgtcattaatagaaatgagaaagcaacttgtaaaacaccccagtgtgtaagacaggataacaaaggatactgaagttagctgccatctggatacctgttcacatgatacctataactaaacagcaacttacctgatgctactgtgcattgggttggagacaaggtatacatgataaattcctactataattaataaatgttcaaatgaaaatatacaaatagattgggtgcggtggctcacacctgtaatctcagcactttgggaggccaaggtaggcgaatcacaaggtcaggagctcaagaccagactggccagcatggtgaaaccccgtctctactaaaaatacaaaaaattagctgggcgtggtgatgcgtgcctgtaatcccagctactggggaggctgaggcaggagaatggctcgaacccaggaggtggaggttgcagtgagccgagatcgtgccactgcattccagcctgggtgacagagcaaggctccgtctcaaaaaaaaaaaaaaagaaaaaaagaaaagaaaatatacaaataactatgttactgttgatgtacattaagtatgagttgaatgctagaagatcatctgggttctccaagctatgccatcaagaaatagacactctgatacagaaggcaacttctgaatttaacagtgctgtgcgatatatcaaggggaaatttgggacaaggatgcctggcagttccacaagcctaggaaaagtgcctcaaacaatctttaacacctttaggtagaaatagaatcagtacaatatttgtatccaatgtctttgatcattttgataatcttatttttaaaagatgggatgttttcctcctctagaattagaatttaccctacactctggacataagaaccaaggcaactaagttatctgctggccaactaatagactgtaagccatcctggagcaaggaccatgtctctctgattcattttgatttccccaatatagtacttgatatacatggttggtatttagtaattgtgtattgaatacaatttttatagacctccatgttacaaaaaggacctaaattgggggaaatggatggtaggtcagttatttccttcaggatatttttaacactgtggaggtcattaatctgaatccttattacaggaataatgggagtgaatcacactttatagaaaccatgacggaggttttgactcatcattggtgctaatcaaggtaaacataatagcaagttgtgccaccctcataaacatcgtgacaagtttgtaaaatagagctaacactttattgcagcaatttcaaagagaagaattacatgaaatatgatgatgctaagatgagctaaaattccaaagaaaggatcttctctaagcaaactaacctttcttttaattatatctcaagaaagaagctgagtataaacgaaaagcacatttgtcaacaattcactcattcagttaccatgtatgccactaactacaatccagaaagatttatgattgtgccaaaacaagatgatgaggttctatacccagaatgtagattaatgttagaaggatgactcaggacttatggcatcagtctgatagacgttgaacctttctttctttctttctttctttctttctttttttcatctctgtgagttcttcaactacaggacagaatgccaactcaggaagataattcagtaaacacagccacctttgactacagactattttttatccaagatgtatttccatgtagcaaagtaaatttagcaaatgaaaatatagtcttgacttgctatggatgtcccctatctctgccaaaaatgacaagctgcttgctcaaaagctgtcactaattagcagctgctgctgtaaagaaaaccaaagtaagtgccaataaaagcatattgaactcaaagagggccctatgacaagagatgggaaatgcaagaatctatttgtgactagtaaacttacataaatactagcaatctaaatttgggagatgtaggggcagggcaataatggcaatacatatccattcatatttaaacaggaaggactgaaagagtctcctaacatcctgaaagtcagaaataccaaggtattggtgttgctgaattccatcacaaccatttccacctttccaataggagccagtcttggttttggatgatgatgattatttttagagacagggtcttgttctgtggcccagactggagagcagtggcatgaacacaactcattgcagcctgtgactcctggcctcaagtcatcttgccacctttgcctcccaaagtgctgggattacaggcgtgagtcaccgcgcctggcctggttttggataatttctcattgtcaatacttctgtctctggcactttaacaactgcatttgtagacattgtaaaaataaattttaaaaataactttcatattctatgggcttcggcctaaactctgatggttccgaatctacctgttgacccctcatgttataggttgaaactatgaagtcaagcagaagtgatctgcccaatgtaaatgagcacagatacagtggtagaaaatcactttactagccctatttcaagaggctctaaaggagtccacaacatcccagcactttgggatgctgaggcaggaggatcacttgaggccaggagttcaagaccagcctgggcaacacagcaagacctcatctctacaaaataaaaattaaaaaattagccaggcgtgctggtatgtacctgtaatcctagctactcagaaggctgaggtgggaggatggcttgagcccaggagtttgaggctacagtgagccatgactgcaccactgcactctgtctcttaaaaaataataataataaagtagtctacagcccaagatcctgctttaaagctaaattccatagattacttttcaaatcatccttcgaagctgtcctctctttgttcctatcagtcagaactcccagtatatttctctttttcctcaacaagttagtttctgtccttaaaaaaaaaaaaattaagaatatttccccttcattttggttctcttactctctttttctctctccctccaggtgaactgctagagagctatgattgtttcatctatatttggacccctagggtcaggctgtgtcttcagcaactactcagaaaaatgagaatgaaaaagaaagaaaaaaggaagaaagagagagagggaaggacaaactggaagggaagggaaggaaaagtagggagaaaggaagatgtaatgagaatagaaaatttttaaaaatggaaaaaaaaagaaggtcggtgcggtggctcatgcctgtaatcccaacactttgggaggcctaggcaggcggatcacgaggtcaggagattgagaccatcctggccaacatggtgaaaccctgtctctacaaaaaatacaaaaattagctgggtgtggtggcatgcgcctgtagtcccagctacttgggaggctgaggcaggagaaccacttgaacccaggaggcagaggttgcagggagccgagatcgtgccactgcactccagcctggcaatggagcgagactccgtctaaaaaaaaaaaagtttcttaactgtcgtttcttaatgacacgcaatcagaacctcccctgcagctgaggtcccctgtggagagtatgtctcattgtctgtataaacaattacaacaatgtacctgtaattttccagttcataatcaggctgtaagaatgagaacaatttgttttatgaaacatggagaaagactaatctttgctattactctcagtgcaggtttatcagcaagacttggagtagataagccacaggcatacagatgaggaatcacattttgaaagctttaataactccctagtggtatgcaacaagctgctgaattaacttgtctttgcatactcattgcacatgcatcactggccaggtctaggtacaaagcaaaaactaaacaatcaaaggaaagaaaaactgtgaagtctccaaccaaaagaattatgttgcaaaaaaaggaataaacacaaaggggcagatagtgtatgattccactgatataagatgcctggagtagtcaaactcatagagacagaaagaatgaatggcggttgtcagagcctgcggggaggggcaaatggagagttttattctcattactgtttaatgaatacaggattttagtttaggatgaaaaaattctggagatggaccaggtgctgacggtcacacaacaatgtgaatgtgcttaatgccacggaactgtactttaaaacagtgaaaatggccgggcacagcggctcgcgcctgtaatcccagcactttgggaggccgagggcggttcacctaaggtcaggagttccagaccaccctggttaacatggtgaaaccccacctctactaaaaataccaaaattagccaggcatggtggcgtgcacctgtaatcccagctactcaggaggctgaggcaggagaattgcttgaatccaggaggtgaaggttgcaatgagctaacctccagcctgggtgacacagagaaactccatctcaaaataaaaggttaaaaatggtaaattttatgatatatatacgtaactccacaatctttaaaatggggttaaaaaaccagtttttgcctaataaactcacattttttctatctttaatgctgaaatccaaaggaaacaaagagatatttgctgtctcctctctcttctcccccatccccccaactttttttgagacagcgtctcactctgtggcccaggctggtctctaactcatgggctcaagtgaccctcctggctcagcctcccatagtactgggattataggcatgagccactgcacccagccccctctcttttctttcttccacagtaaaaggcacactttcagtccttctgagggttgaagttctctggatacacctgctgtattgagattaaaggggaatacaatagtctttccttatctgagattttgttttctatggtttctgttacccacagtacagcatagtaagatacagtattttaagatagactacattcggccaggcacagtggctcacgcctgtaatcccagcattttgggaggctgaggcgagcaggtcacgaggttaggagatcgagaccatcctggctaacatggtgaaaccccgtctctactaaacaaaatacaaaaaattagccgggtgtggtggcagatgcctgtagtcccagctactggggaggctgaggcaggagaatggcatgaacccaggaagcagagcgtgcagtgaacggagattgcgccactgcactccagcctgggtgacagagcgagactctgtctcaaaaaaaaaaaaaaaaaaaaaaaaaaagactacatacttgttctattttattatcattgttcttaatctcttactgtgcctaatttataaattgaactttatcataattatatatgcataggaaaaaacaatatatatatgtagggttcagtattacctgaggtttcaggcatcccttgggataaggcaggactactatacttatttaacagatacttattgagtaactattacatgttgggctctgttctaggtactaagaatgtggcagtgaacaaaacagacatgctttatgtaacttagattctggtatgtaatattaaatactttaaagtttaaataaataattgtgcccctgctacactttctagtttttgtttttattcttcttctctttatttctgttgggagaaaacagataccacctgacaattgaatcttacaggtcaatgacaaagtctgtgtgttcaaaccagtatctgggaagaagttttaaaagcacctccacaacatcaaacagggggattactggcttttgtgaagtcttggtgatgcaaaagcaatttctgataaaaccagaacatctgttcatccctgctgaaagcctatcatctttatggagctattgtatgtgcaaaacaaatcgggtccaatcaaggattccacagttaagatcatttcagtgtggcattattccagctttggtccaggacatacagttttatttacaggataactttcatgattgccacaatcaaatcaaatcctttgtctttcaaaggtgatttgcagattcaatcttcacaaagcactaaaaatatagagcatggagttaaaaattcacaatgggaccacacacaaatagcagtacagggtggtagatagctagccaatgtttactttcttctttttcccatagaataaaatataggtcaaattctactaaaacaacaaataccaccacagtgaaaacctaggtataacaaaaatattttgaaacacttaaaaatgtccatgtgtttcttaatccaacacaatatacttttatagaatcaatataatgaattttatgagagtgctgaatcctaaccactagacaaccagggaattataatgaattttaaatcaaaagaatgactccttagagcataacaactttgtgtccgctctttaattttcatctttagggacatattttaaatatttcaaaataggctgtcacagtatatttggaagaaaggaatttgtttccctttatggaaatcatcctcaaatgtattgaggaataattttacattcaataaattacatcaggatgtttccaatgttataatgaacctacttttggcaacatagtaaaataaaggggttcctaaagcccacccattagtaaaagttattgaatattttatttaacattaaaaggtcaactaatttggcttagatgtcaggcaatatccaaagaaacacagaagttctagccatttcttcaaaggttccttctgaaatcaggtatcctttaaaaagaccattaaggctgggcacggtagcttatgcctgtaatcccagcactttgggaggctgaagcggaaggatcacctgaggtcaggagtttgagaccagcctgacgaacatggtgaaaccctgtctctactaaaaatacaaaaattagctgggcatggtggaacttgcctgtaatcccagctatctgggaggctgaggcacgagaatcacttgaacctgggagacggaggttgcagtgatctgagatcacgccattgcactccagcctgggaaacagagcgagactccgtctcaaaacaaacaaacaaacaaaaccattaagataaactaagtaggaagtggcattacctagattccagaatctctgcaagtctcccttctgaagctccgtttgttcagtattcctcacacagtggtgttaccagtcatggtgtgaacttggcagtttagggaggctaccacctcacctagggggaactaaaaatgattcccctcccttaagtatctcctaagactacagcaaaactggggggaactctcttttgaaaggaaaaatttcatctgtaactagatccccaattttaagcatcaacttgatgtattttataaaaatgaagagtagctaagaccaaaaggtgaatatgattcttttctagacaaattcagtttcaaaaataaagttaaacaacactctgaaacaaaacaaaaataacaaaacaccctgcctaaaagtgatttgacagttgaggtatacctgaaacagggtgggctgtttatttttattcagaattttgttttcagagatgggatctcactatgttgcccaggctgacttgaaactcttgggctcaagcgatcctcccaccttggcctcccaaagtgttgggattacaggcgtgagccactgcacctggccagagagggcttttctactcccaagaaatgagaggtcctctgaaagcaggagcttcaaggacatgggtaatgcttcagccatgcaaggatgcagcagttttcaaacaagagggtgcatctgtgggtgtctgggtgtgtcttgggggtgagggaatggtaggaagctttaagggcatcactttctttaggtaagagacacttttgtgctgggcgcggtggctcacgcctgtaatcctaacagtttggaaggccaaggtgggtggatcacctgaggtcaggagtttgagaccagcctggccaacacagcgaaaccccgtatctactaaaaatacaaaaattagccgggcgtggtggcaggtgcctgtaatcccagctacttgggaggctgaggcaggagaattgcttgaacctgtcggggggaggcttcagtgagccaagatcatgccacttcactcggcaaaatagcgagattctgtctcaaaaaaaaaacaaaaaagaaagacacttttatttcctacagagcagtggcttcagttcccacagggcaagagaccctatttgttttgttttattttaagttccaggatacatgtgcaggatgtgcagatttgttacacaggtaaacatgtgccatggtggtttgctgcaccaagcgaccctatttgtatttgttgattgtaagccagatgttataaagcaggagacagccctatatttcatttcccttcgttagaaggcctatagccacactgtttattatggtagcctctagcagcatgtgctacctaagcacttgaaatgtagctagtgcgactggggaactgaattgcaaattttatctcatttgaattaacttaaatgtaaacctggaaactggtgttcaatttaatacttggaaaacctttcagtacgtttggaacaccttcagtatgtgaatctactttatcaactgaaagttttatgaaatctgaacacagttcatgcatttctggtgaaaatttggtggctaaattgagagattttataactgtaagatacacaccagattttgaagcattcgtacaaaaaaaggaatgtaaaatatctcagtgtttttgtgggcttttgggttcgtttgtttttttttgagacagggtctcactctgttgcccaggctggaatgcagtagcacgaacacgactcactgcagccttaacctcctcggctcaagtgatcctcccaccttggcctcccaagtagctgggactataggtgcacatcaccatgcctagctaattttgttgttgttgttgttagagactgggtctcactatgttgcccaggctggtctcgaactcctggactcaagtgatcctcctgctttggctccccaaactggcccaaaatacctcattaatcaataatttttatattgatcaaatgttgaaatgataatttttatatattaaagtatattgttaaaattaattttatttttactttttattgtgatacagactaagaaaattacaattggagctcacattatatttgtattgaacagtgctggtctagaacataaatattccacatactgtacacaattattgcttagtttcctagtttatatgtcttaccttttttttttttttcttgagacagagtctcattttgtcgccgaggctgaagtgcagtggtgcaatctcagctcactgcaacatctgccacctgtgttcaaatgattctcctgcctcagcctcctgagactacagacatgtgccaccacgcccggctaatttttgtatttttagtagagacagggtctcaccaagcgggccaggctggtctcgacctcctgactcaagtggtccgcccacctcagcctcccaaagtgttaggattacaggcataatccaccatgtatggccagaaaacataattttgaattaaacgagattatcatgtttttaggaagtagaggaggtaagaggtgataagcaaaaaataaccaaaaagaagagaatgatttatttatgtaggcatattgaacaatatatgtttatagttttatctttaatacagaaaaacacttatttacttcatgcattttaattaactactttatggatttaggttttaaaagcactaaaaagtactacgtgatttttaaaaatgttttggtattccccaaactggcttaaaataaaattctgttatagcaatttcactataataaattacaatgcacaatccaagttaagatagattttttattttttatttttatttatttatttttgagacagggtctcactctgtcacccaggctggagtgcagtggtgcaatctcagctcactgtaacctctgcctcctgggctcaagccatcctcccacctcaggctcccaagtagctgggactacaggcacacaccaccacgtctagctaatttttgtatttttatagagatgaggtttcaccatgttgcccaggatacttttgaacccctgggctcaagtgatgagcccacctcagccttccaaagtgctgggattaaaggcatgggccaccatgcccagccagatttttttctaatataaaaataaagatgggatctcattacgttgtccaggctagtctcgaactcccggcctcaagcaatccttccccctcagcctcccaaagtgctaggattacagatgtgagtcatctcacctggcctaaaatagatttttacttaattaaattttacatgaaataagtaagtctactgggctcaaaattgtctatttttaaggttgtaattttatttaaattctcttaaagtatcaactcataatttactttcattcctcttctttaaactctgtcaagtgttaaaattcttttatttttattctgagacagggtctttctctgtcacccaggctagagtacagtggagcgatcacagctcactgtatcctccacctcccaggctcaagcaatcctccgacctcagcctcctgagtagctggactataggcatacaccagcaccccgtgctaatatttttatttttcgtagagatggggtcttgctatgttgtccatgcaggaaaattcttttaaacactaattctagttacaaagaaactatttaatgtaaatttaattaaggcagaacataaatctctggtattaggaatgacttatacccaagagaaaatatctttcactagagatttcctttaccagatattcccaaatgagtaccataataaacatttagagaagtcattaagtgtgactaatggaattataagaaaaagaaatccatagcctagcagccttcataggtatcaccatgaaggggaaaagccaatgcagaaaatatattgaaataatacaaagttcagggttaaaacaaactcaaccatttttttcaaaacatcttcaatatgaaatgaataacttagcagagtgtgtatatatatgtgtgtatatatatacatatatgtatatatatacacatatatatgtgtgtatatatacacacatatatatgtgtatatatacacacatatatatgtatatacacacatatatgtgtgtgtatatatacacatatatatgtgtgtatatatatgtgtatatatatgtgtgtatatatatatgtatatatatgtgtgtgtgtgtgtgtgtgtgtgtgtgtatatatatatatatatatatatatatatatatatatatatatataaaaaaacaaaaacaatttttttttttttttaaagagagacagggtctctgtccattgcccgggcttgggagtgcaatggcaccattatagctcactgcagcctccacttcccaggttcaagcaatcctttcacctctgtctccctaacaatttattatattatataacaatataattctccataagcttctgtgtaaaaatatacaggctaccacgaagcacaggaaataacacagtcctgaagttcaaattatttaaactctaaaaatgttaaatgaaattatgatgattttaacatagttcaacaaaagatgtcaaaaaacaggatactataccaaaaaattaacaaaaacatcacaaactcttttttctgcttctaaaaagaaaacactgataacaaaaaacaaattctacgttctaagacatatcaatacacacagccattttaaagataacttttttttcctgattacaaaaggattccctgtattatcatctgtttttttgtttgtttttatttgttgtttttgagacaaggtctcactctgtcacccaggacgaatgcagtggctcaatcacagctcattgcagcctcgaactcccaggctcaagtgatcctcctacttcatcttcccaagtagttgagaccacaggcatgtgccaccaggcccagctaattttttaattttttgtagagatagggtcttgctatgttgcccaggctgatcttgaactcctggactcaagtgatcctcccacctcagcctcccaaagtgctggaaatataggcatgagtcactgtgcccagccataatctgtttattatagaaaaatggaaagatactagaaagcgcgcacacacacacacacacacacacacacacacacacacacagggaactccacgacccagaagaaatcttttttcagcgcctgttcttttttccaggcacaattgtatatgattgtttgtaatttcatttttcatttagtaatatatagtgaattttgtgtaggtcattaaatattgttttataacataatttaaatagctggacagtattctattggacagctatacacaggtgtaataaatgatttagtttattaaacctctaatggaaataccaagatttttccaatttattgctattttaagtaacactccttttgtacaaatcttttttttttaatttatttattattatactttaagttttagggtacatgtgcacattgtgcaggttagttacatacgtatacatgtgccatgctggtgtgctgcacccactaactcgtcatctggcattaggtatatctcccaatgctatccctcccccctccccccaccccacaacagtccccagagtgtgatgttccccttcctgtgtccatgtgttcccattattcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtgtatgtgccacattttcttaatccagtctatcgttgttggacatctgggttggttccaagtctttgctattgtgaatactgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtctaattagatcccatttgtcaattttgtcttttgttgccatcgcttttggtgttttagacatgaagtccttgcccatgcctatttgtacaaatctttaaacatatttcagatgtcctagaatgaaattcatctaaatgaaactgctaagtcaaagggtatgtactcttcttttttttttttgagacgaagtctcgctctgtcaccaggctggagtgcagtagtgtgatctcggctcacagcaacctctgactccctgcctcagcctcccgagtagctgggattacaggcacgtgccaccatgcccagctaatttttgtatttttagtagagacggggtttcaccatgttggccgggatggtcttgaactcctgacctcgtgatccgactgccttagcttcccaaagtgctgggattacaggcctgagctcccatgcccagcttgagtatgcactcttttaagctctcaatacatgtatcaaactgccatccaaaaaaagcacccatttacatttcaaccaatgagtatgaaagtgccagtttcccacattcccaagcaacactgctcttatttttcaatatttttagtcttcataaatctgttaactgaaaaaacttgtcatttttatttgcatttcttgatttccagtatgggtgaacactgtttcatatgattatcggctatttgtagttcttcttttgttcattttctattatgggaatcatctttttcttactacttatatagattacttatatattacgaatatttacccataatgctttgtcatatatattagaaatatttttcttattttgtcacttagctttggtttctggcattttttggcataaagaagttttaaatatttatgtatacatataaaaagacatatgtgtatctataagatgtatcttcttttattagttattaaagccacttatatcctgttcaaatttaccaataaaactggaatgtaatgttaagttctgtgcaaactagacctcttcacatttgggtaataaaaattcaaaactagccaggctcaggggctcacacctgcagtcccatctactctggaggctgaggtgggaggatcacttgagctcaggactttgagaccagcccgggcaacatagtgagaccccactctttaaaaaataataataataaattaaaataataaataaaattcaaaaccataaattttgagaatatcacatttttggacaaaattttaaatgtgtgtctaaagtaatacgttttcttacttaaggacccactcctggcacacttcactcatcctgggcaacagagcaagacactgtctcaaaaaataaaaaaaaaaaaaaaaaaatcattcccttaaaattatatgctttttggcccggtgcagtgactcattcctgtaatcccaatactgtggaaggttgaggtgggaggtgtggaggtggaggtgggagggatcacctggagacatagcaagacccctgtctctatttttttttaactatgtgcatttttctggtattgcaaagtcaagggatcttgcctcatcaccaactcagcatgtgaattgtagccatgccactcaggaagccaaatattttctattttgttttgataccttcaacatgaggagaaaggccaatctcttcatacattacaatgaaattagtatttttacttgatatttaaactcactgcaagataaactcatttgtaaaacatgactacactcagagtttccatatatgtagtcaggcaccacataatgacgtttcagtcaatgacagaccacatatatcactgtggtcccataagataataaaacgtagctgaaaaattcctatcctctagtgacgctgtagccatcataatgttgtaatgcaatgcatgactcacatgtttgtggcaatgctggtgtaaacaaacccactgcactgccagtcatgtgaaagtctagcacatacaattgcgtgcagtacatacttgataatgataataaatgcctatgttactggtttatgtatttaccatactttttatcgttattttagagtgtactccttctacttaaaaaaaaaagttaactgtaaaacagcctcaggcaggtccttcaggaggcattgttatcacaagagatgacagctccatatgtgttactgcccctgaagacctttcagtggaacaagatgtggaggtgcaagacagtgatactgatgaccctgaccctgtgtaggcctagactaatgtgtgtgtttatgccttcacttttaagaaaaagtttttaaagttttgaaaaattaaaaagtttttaaagttttgaaaaattaaaaattatttaaaaagagaaaaagtaaaagaataaaaacataaagaaaatattgttgcacagctgtacatgtttatgtgttaagctaagtgttactacaaaagagtttaaaagtgtaaaaaagtaaacagttggccgggcacggcggctcacacctataatccgagcactttgggaggtcaaagtgggtggatcacctgaggtcagaagtttgagaccagcctggccaacatggtgaaaccccgtctctactaaaaatacaaaaattagccaggcgtggtggcacacgcctgtaatcccagctattcgggaggctgaggaaggagaattgcttgaaccgggaggtagaggttgcagtgatccgagatcacgccactgcactccagcctgggccacaagagcaagactccatctcaaaaaaaaaaaaaaaaagtaaaaagtttacaaagtaaaagtattacagtaggctaaggttattattgaagaaagaaacaattttcaaaatacatttaatgtagcctaaccagacagtatttttaaaatctacagtaatgtacagtaatgtcctaggccttcacattcactcaccattcacccactgagttgcccagagcaacttccagtcctgcaagctccattcctgttaagtaccctatatagatgtaccattttttatcctttatgccatgtttttactgtaacttttctatatttagatatgtttagatacacaaatacttacccttgtgttacaattgtctacagtactcaatacagtatacatgttccacaggtttgtagtctaggagcaataggctttatcatacagcctaggtgtgcagtagggctcaccatctacgtttgtgtaagtaccctctatgatggtaccacaatgacaaaatcgcctaatgcatttcttagaactttgtcaccatgtatcattaagtgacaaacgactatagttacgtaacaataaccaaagaaaaatacaaaaagagggactatttacattgtatccttacatattaaaccttccatgccttcggaataagaatctagtatccagttctcactatacatagctttccctcactttctatcagaaatgagataggagtcccaccttcctggcatcagaaacagatcaccaatcctgcaaacaaattcacagggtgaactgtttcatttttaaagagctgtagatttctgtagatctctaatttgctacttttcctaaacctaaaagatgaccaaaagatttttagaaacattaaacaaaaaaacagaattagcattatttctaacagaacattttacctatttaaatatactgtagaatgaatgctatattacaaagctgatgaattccaatttttagtactttaagagatcaagtgttcaagtttctttttatataggctacaatgacatgtatgaatgtaacttaacatttagcccaggttagattttttaaaatcccactccttcaaaaacagtgacttgccaccagctataggctctgaatttatttaatttatttatttttttgagatggagtctcgctccgtctcccaggctggagcacagtagtgcgatctcggctcactgtaacctctgcctcctgggttcaagtgattcttctgcctcagcctcctgagtagctgggattacaggcgtgcaccaccacacctggctaatttttgtatttttagtagagacagggtttcaccatgttggccaggctggtctccaactcctgacctcacgtgatccgcttgcctcggcctcccaaattgttaggattacaggcgtgagccactgggcccgacctaggctctgaattttagacaacaaaaaatagtttctcacaaactttttaacttactctcacctaaaggctggaaaaccccagtgaaggcttttaaaactcatcagacatagaaaaaaagaagcagctttaattgtaggatctcactgacacaaacataaggaaattctgagttatagatacctcacattaagctttttccactgacattgtaacttctgtcaacattcaaagaaaattcaaccctggtcaaaggtgacagttgacaatcctggaagctaacatcctctgtttatttgaacaagtttatactctgcacagggaattgaagttcttcttgtctgtgacttgatctcccaaagttaaagcactacgctttagggttgtgaattctgtttccaagacttaacttcacaatccactcccaaggaaaagtgctgagagaaagtaagcatcataaatgaaaaaaaaaaaaaaatctgagactattttctaatggcctttgcagagctctagacatacaatagttcagttgccttaaaaattcgcccaaataggctgggcatggtggcttatgcctgtaatcccagcacttcggaaggccaaggcaggaggatcacctgaggtcaggagttcgagaccagcctggccaacatgtcaaaaccccgtctctactaaaaatacaaaaattagctgggcatggtggcacatgcctgtagtcctagctactccggaggctgggcaggagaatctcttgaacccaggagacggaggttgcagtgagccaagatcgcgccactgcattccagcctgggtgacagagcgaggctctgtctcaagaaataataataataaattagcccaaataagtaaaattcttaaatctgtctcagaaatcatgactaatgctctaaaaagctttaatgcaacaagaataggacagaaatccccgcaaaataaagttgtaaataaaatgagtgggattgttgagttctcagtacagacgtgcatgtcaacacaaacccactacattggcacaaatgatccctttgtttgtaaacagaggccaaggagacagcttatagctcttcttctatgatgtacacggtaatgctaggggaagaagaatgaaagacaacttataataaaaattaagactttctcttctttaatataatttccaccagaagtatatactttaattggaaaaatatttatcaccatcttcatcaacatttaaaaaaatcctaaacatataaaaatattttctattcaaaaaccaacgagactccatttgggaacacaaagaaatacaagcctcaaagaaacaaaatgtcttataacaaagtggcagtggccagctcgcttttgctgtacactagttagggatgcagtctctggaatcagccccgccaagaacagtaatgtgaccttggacaaattacttaacttctctgtggccatttcttcatcttccatctgggaataatacccactcctctgagaatcacgagttaacacaaggccagagctgaaaacaatgtctgcccagcacactgtcagtgaacggtaagcattaggtaatgtttttattatcttcacacttgaaggcgttggaacattttctcaaactctgggttttgaacataatttgaaggacttgttaattgtctgctcacctctcgaaaggtggcatcataatgattagatacataatcagaatatcttcccaggtgagccatggtaagcagagctctagcccagaatgatgaatagttatttttaatacaaatcatggatgtggctgttactggcaacttcggcctgatttcccatatgcaaagaaatcccctaccaggggaaaacaagcaatgttagaaacccgttgggtttgtcctgttatcattacagggtaaagccaaattcacatttagtagcctgatgggcattaaaaatattagtcaccaaattaatcccaacaaataacaataattgattggctcattgatgtatttccccttgtcttccccaacctttctctaactagtcagaaaggaaagttttcatattttctgagaatctcattactgctctcaaaccatgctctatatcttagtataatttaaaaaatgagtcagcacaagcacctcagaaaactagcatagaatatgaagctacttctcttcatattagaaaagtacaaaaatttttaaaaggttattcagggtaccaaaggtaatagaaggatacatgaagagtgaatgttgcagtagattttgcaagctagcttccaaaagtaggtagaaaaagataaatgttcttcatcaatcaatcaatacaggtattcatcatctcagtggtgtcatccatgtgaaaatggacatagttattaagaataaacctaaagaagaaaccatcttgtatgtgacaaattataacttctcctttcttgaatattggggcagcaggggaataggaagtcaagatactccaagtattaacttcatttgcaaattgaattgtacataattgtgcaccatgctaatgcaatactgcttttagtaatgggatccaaatgaaaatttagaagaggtaaactccccctaaactgcaaacacatctgaatgtcaattcaattaggagtctatttagttattacacttcttagcataaagcgagttaaaggccaggaaaagaacacttgctttaatcactgaaacaatctacacatatttctcaaggctccacttaactcatcctgcaacatttatattaaaagtgacctatcacttaagtgatccaggagagtaaaggaagagttttaaggctgaaggtgattcctcctgagctctaataccataccctgaatttcaccttgttcttaactcttttccatgacactgtgtatggcttttaagcgagtccagaaaaacggctatcattactacttaatataaaccatggggttctgtatcatgtaaacccagagcaactcctctttgaagcaccgacattcaaggctctacataacatgtttcaactctatcttagtgctatacattttccaagtacctgcgaggaaacagatagcagcacctccatttttctgtaaattgtgcttttgttgctgttctaagactccttccaaggctgttaaactttgaagagagttgggaaaagacaagaacatcttgccttcccgattgggtattcaggcttcactcagtaaagctgtcatgaagtagcgcaaagggtcagagacaaaccacatggcatctgatgtttgtctgtataagtttaaaataaaaatgtgacactacaagaaggttaacatgtggacctaattttgaaaatacaaacaggaagcacccccaccccaatattaccatttaaaaaaaaaggaaaccaaacctcaaagataccttccaaggaagtgatgggtgtgacccaaactaacaaaagtaataaaacgtcacttcaactctgaaaccatcaaaagtgagggtctcattcaaccaactaaaaatctaacacctgtaaattgctcttctcttttgattagtaaaaacagcatagatttagatgtgcaaaatcttctccaaactgacataggcttttcagtagcagaggatcatcattaataaaacacccaatgtcaagattttacttcaaataaggccactataattaacagtgaatacaattttaaaaagtatttatcactctgatgcttagaacttaaatttaagtacaaaaactgtctgatcaatggaaactagattgttaagtttgactttcttattcccagaaataagcataaaactgttgtgtttccaacactgcaggagaaaaaaaaaaacttctgattttagaagagttctattcacaaagctcagaattaaaaacattttcttcctttaaataccacacatttgaggacagcgatagtgcagagctaactttgaagcattatttttattaagttgcacagttaaagtattttgatactttgatattttatagtatcaaaataaaaggatattcttctcaagagtccagtaacctggaattgccagatagctttttaaacgaataagtttcaaattatcagaaaaatcatacaaactagggttattttgcttccttttgtaggaataatgcagtaatctgcactcttaacagaaagggaaaaaatgtgtcacagatagaatgtccagaaatctgtgaataactttatgagatacagacatttttgtagggcacgaaaatagttaggcttccttcgattccacctgtaacctgcatctaatcttgagcatgttatttacctatctataacgtcttccttttacaataagactacctgtgtcacctacctacataacaacaagccaaataaaccacaacaaatggattcataatatataagcctaacaaaaattacagacaatttgaatactaacaatactatgatttgaaaaaactcgacttaagtatcaaaaagtaataaatggcaactttagtcttgatgtggcttttacatatgtaaatgacataaaaacaatcaagagaggaagaaaatggagatgagatgaaaagtcagagcaggataggaagtgttgaccaaaatatttatgttgtaacactccaaacgatgatagcacatttttctcctacaatcatacatactatgaagtacacaccttaaatttctgaacacaatccatattaatatcccgtgggcaaaaaatacaagcaccgaaaaggtgagaactgatgagaaggtgggatagtttacctagttgggtatatagcaaagattattttgtgcagagtttagcttcaagttatgcaataaccaaactactggtgatagaaatcaactttttttttctgatggtttgctttacaaaaaaaaaaaaaaaaaaaaaaaaaacctctccattccttccctgtgtctcaatctggagcttgaaatttcatcttccagaggctacagtagcaaacaagtcatctcctagataacgcgcttacctgacccaaggtgtggacttgtttgaattaaacgtaacagataccacaaattgtcacataggaagtttttcttaaaatcagcagccccttctcttatttagccatgtccattctaacaactgtgatcttccatgagatggaaactggtacccaaatgaataaacaaaacaacccaaagccttaaaataaaatcaatcaataagattctccccatttgaagtgatcagaaccactccaatatttacagtgttacaaaatgaaattttaaaacatgaaaggcacactcaataaaatacatcctcacctaggaactcacaggcaatgaacataacgcaatataacataagcaaatggacaacaatagaatgttggggagagaggcacagttctattaccttaattgaaagataacaaaattatttgaaataatgtagacccaacagctgaaagcttattatggcccaggcggctatccaacagctttggaaacctaagatccaagcagaccataaacaccacttgaagactgaaaaaaatgacataagcccaagtatgatattcagtgtcacgctggccctttcaaagggcattccctgaggacactgcagagaaaatgtatggaattgtatctaggcaaagatctgtatactgcacgatgctttgggaagagcacgaatctcagagtccttgaagtttcaatccctggatactcaacaaacagccgtgtcacctgagcaggccacttactccacctatctgggcctcagtttcctcatttgtacaataaaagaatggcatcatcgctgggttcctttccagctctaacattctttgacccacttttggcactatttatttgatacgaggtatggcgggatcacagggaccaagaagaaaagaactgactctggctctttggcaaagagagaatcggtatctcttttagtctttaaaattcttgtgcttttcattaatcccgtctttctaaaagctgacacttggttttcttctttggcttttccatcactgctggctacaagtgtttgcaaccgcctcttgctccgtgtgagttctttcctctttgttcaccccgaccatcttgccagattcctttagcctcagaccagcttttgtgatacaactccccttccgactctccatatctaccccccgacaccaggagcacttttaaccctttatccctgactagaaagaaaaagcacactgcatcccacggccacacgcacgagcccaggcctggcgggtcctgatgtgggatcccgccccccagagtcttatcgaaacgttcgtatttgttgtcttgattccttataaggccctgtttcttgaagctttgctaataccccccaccgcaccaggcacccccgcaggctcatcccatccccggagtcccgggaacctcttttgaaagaaagaagttaaagcaaggaagacggctggggatattcggaattgcaacgtgaaggtgtgaggcggctgacagcagccccctgagctcctatggggtcggcgcggggtccccacacacccactcagcacacgcgcacgcagcctttaaagcgcacgccccccgcggcgccgcggcgttcgcaagtccccctcgcgcaccccgcattgccctcagcctccccggcagccaacccggaccccctctccccgcgcgcgcccctcgcccagcgcgcaaccaccgcggcccgggagtgatggcggcggcgcggccctgacgggcggctgagcggctggagcgcgggccccgcccgggctggctccccggcctggctcccccggccccgggcccagggctcgccccgcagctcctacctcgctcggcccctcgggcgcccgcggctgctccggcccagctgtctggcttgcccgcccgcccgctcgctccctccctcggccgggccgccgcgcggagttgcctgcgctgggtccccgcccggggtgacggctccggccgccgactctcctcccgcc

SEQ ID NO: 2055 - DNA, 237508 bp, Homo sapiens
ctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgccgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcaggtaaggccttgctgcgggctggactgggctggaggctttggctcaggactgagtggcccgaagtgggcaagttgaaatctaggtttgtacatgtgaggttcatggaggattcacacatggcactgcctgttccaagtagttcaagaagttctttctggtcagtagtcatggcaaatgcctgtatctttcctgaacaactttcctcatcccccgcactcaggattttttttgttggcagtaagaagaagcctttggggcaacttgaccttttagatcagcaaggaaagaccccatcttaggcctacttgtctggaagaatggcctggtgagatgataagttcattgctcctattcggttttagtactgagcagcatgggggaggttggggccacttatgttggaaagggaaagttaaggctgggccacctctgttgcctgaaagcctggtgttcaggtgtgcctattccaacaaccgtgggaaccctagtcccacccttcccttaggtagtcttgtctctttgctgtgcgcatttgaaatatccaggcggtttcttagatggaatcctatttacaactagggtgttaaatggccttttcttgacatagacatgatataattcctgggaccacttgttgacttattctgtttcttctgactgatgagggtgggaattccatgctacaggtttttttttttgtttttttttttttttccctgagtctgcttgctagggaaaccatgctacttttgatctgtcatggtttttcctatgcagttgtgaaggcttatcaggcagcaggagccctggtatacttttgcagtagaaaggaacacttttatgttttgttttgtttttttgagacagggtcttgatctgtcgtccaagctggaatgcagtagtgtgatcacagctcactacagcctcaaactcctgggttcaagtgatcctcctgcctcagcctcccggtagctgggactaaacacaagagccactgggcctggctaactttttttttctttctatttttaattttttgaacagacactgtctctctgtgttgtgcagggatccctcccaaagtgctgggattacaggtgtgagccactgtacccatcaaggaactctattaaaatccagtcattttacataaggcttacgagatcagttctcttttcccatttctctcaccctttggctgtgatctgcccaaagctgtgacctgcagtgtggggagagtttatagatgagttgtttctgagcataagcaagttcaaatgagggaatggctcagtgggcacctgctgatacaagtcagaaaaggaaatataggtcatggtggctggggagtttcatggatggatccagaagctggctttggtggtagaccctttattgggcaatacccttttaagttccagatgttccaagaggtctggtttccaaatgaggccagggttgcccatgtgtaagtaggatacctggctgttgctttctagatagatcctttttgcctattaatcctgtctctccatagagagtctccttgacctttgagacctggctgaaagcttggttcttattgggctatgaagggaaagactagtgggcaaatgtagattgaactgtgaagtagacctaattatcatctcttcctgtccctgtgacattcctatttataactgataatatgtcttttttcactccaaaatatgagtgcctgacataagatgaatattttttggagagtgggtgttctatattttagacataagctaaagggatgaaattttgaatgtagacattggctggctattaggaaggtttttttttttttgttttttgtttttcgcctgaagtaaaaggcattctagccttcctcaggaccaccccatgacttgagcttttggagacaattcttcacacaacatatatttcagaggcctggctatgctgattataccacttaggcctactcatgctcagtttagaaactggtttctgttgtcacaataatagtgaattccagggaggaaagtctcagagagaccctaggtgctgtgaatgcctaaggtttgtggaaacctggaggttctagcactattgttgtggtaggttttccccttgggtctacctggggttttgtctttgactcagtcagggacttgtttttgcaaagaggtggttcatatagactgggatctgcaaaagagtttggagagaaactttctatgcaactaggaactcttgcatcctttccagcctctctgtatccccagaacacaggaggagctttacttgctcttaaaactactacttttaaaaatcagattcaacatacccagtcaatttgtgtgttctctgcagtttgtattttacaattacatagctgtttttccaacagagtctcacaatagccctgttacaatgcagggcaagtggtattgtccccatttttatgggtgaagaaacctggtcctgtgcttggtctttcttataggcaggtcttctgatgcttaagtcttggatttcttccatcttctcaggtcctgccctgttaaaggagtgctaggcagggctggagaatgttgctttccttctgacaattaggcaggccttggtgactctgtagctgagagccaagaaaagggctgtactttttttctgctctggagagtcttttgcaggggcccagagaatttgattttttctcttttggatgtatatacccatctgtctctttttagttagttaaaatatttgatcctaagattgatttagttaaaatgcttatggctttagcatgcatacaataaacactatgaaagcctgatcctgcagtgaaggcaggtgctctacaaggaggatctctcactgggccgtggagaggccattcctgtcaccctttggctctttaatacctgtacacccagccatgctaggtcactttctcagtaaagatctgtgcctgcctgtgctactctggggcttgcgtttctgaagctggcctgatacggatgcttggaaccgtccttagactctagaaaacaacaatggtttctgtagaatgtgcatgagggacctcaggtggagtctggagttatggctgccagtgttggaggtattgagggcctctaatcaggaactgtggtttagttcagtgtagctaggacagggccttggaggataggcatctaggcagtgtgcagagtgcaggctggcttctcaatcaacctctgatggagtggcaggccagaaccctgcctccctcccccagctagttgctgctgcctccaaggctataaatggcctggccatcttggtagctatgctaattttagctgagggtggctcccggaactgggctggggccaagagcaggtaggtggggcttggctgaagctaatactggggcctggggagagggacacactaagcctggggtagccaggatataatctgctcccaggcctcagctttgacaatcacccttagctaggttaattgattcagcaaacattgaacaatgccagctcatgtggtatttattaaacaagtattaatatttgagtgccttctctgggctaggtcatatgttcctgtggggatttaaggatgaacaaaacagacatgttccttccctcatggaagttacagtcttgttgatgagacagataataaacacataaataaatatattatcttgtggaaaatgtcatggaagaaataaacaggatgctatcatggagaatgagaggggaacagagatctagttaaagcctgaacctaattgtaggacagattaatacaataacatcaatgataataatagcaactaacttttttagagcttactatatgtcaggcactatttaaacattttgttttattaaattcttattaccatcctgtgttatattgtccccattttatagatgagaaaattaaatcatagagaggttaaataacttgcccatgtttacacagataacaaggaagccagagtttgaatccaggcagtctgattcttctctctacctctactttagccactctcaaaactttgtgataaatctgcaatagaggtattatatatacatgcagaaagctgtgggaagcccagaggagtaagtgactaaccctgcctgggagagctgggggaggccttacagtttctttgtaatttttctcagatcttgagatgaaaagcggctgcctaattcaaaggttacgagatagaaacatcagttagttcatcccacctatttttacatatgaggaaactggcatccagagaggcattagaggtttcatggtgggttattagtagaactagactaggaaatttgagtcagggaccttaacttaaatcagtttttcattttataagtgaaaataatgggtgctcactgcttgcttttcactgtggaaggaacttagggctactgaagaagtctacgttttgtagggccacatgtatttagggaatattaaatacaacataatgtacaggcttaatgatgtgcaaaatcaggcagtatagacattgtaggctaagggttaaaagcgatctgtgtgggctgggctagactaggtggctgcagagggcttcctggaaaggaggggttgggtggaggcagaagagaacaggagagagtagtctgacttggggaggttggaggaaaggaggcattgtaaatatctggtttcactgtttggtagctggatgatcattaggcagagttgcttcattgttggctagctacctcacatgagcacccataggtaggaagattgcagtcatgtgtgatctagtagtggttctattttttttttttttttgagatggagtcttgctctgttgcccaggctggagtgcagtggcccgatctcagctcactgcaagctccacctcccaggttcatgccattctcctgcctcagcctcccaagtggctgggactacaggcatccgccaccacgcctggctaattgttttgtatttttagtagagacagggtttcaccttgttagccaggatggtcttgatctcctgacttcgtgatctgcctgcctcggcctcccaaagtgtgggattacaggcgtgagccaccgcgcctggcctctattttttaccgtaatttagaagtaatgatgagtgtaaataatactttgagatatctgtagcaatgtaatgtgatatgaaaacatctgttgatttctattgatgacaaaatcacagttattgctaatattattgtggttggttgctccatatgtaattgaaggaaatgctaactttcagtaagagaatattgaaaacaaagatgtaatttcattcccatccaaattcacaggcctcctgaattctatctatgggccccttagggatatggggccttcgtgttaagaacagctctttggcaaggaagtgatgagatcttgtggaggggagtagtttcctaggtctctacaggacttgagtttcagacccaaggggcccctctggtttcctgctgggtaacctttgatatacattgctgagtggctttgtgggcatgctgtggtacatttccctttgtggaaaatgattctttgggaaactcagcaggtttggttgttgtcaggcttttagggagaaaaaaagagaccaaactgggcctccagagctttgttgttgctgttgttgttactgttgattaaaaaaatcatgaaatattaagatatacaacaaagtataaataataataaattgaataccctgaaatgactttgaaaaaaattgtggactaaaagcaggaaatcatcccaagaccttgtcttaccctaaattccccctaaaaagtaagacctgggataggaacttgcagagagtttatttcggagaagtgacttcaagaaatgaggggtgggagttgtgaagaatgaaacagggaatggacaggtgtactatggagctaacaccactgtgagcatctgaggctcagtgtcacttagagaccctctgagaagccttgtagaatgctctgtagaattgcattctacaggtgatagaggaggggagtatttatccaccacctcaccttcactcgccaagggttatcccaggaggtgctacctcttctgtactccagagttgcatatgcatcagaatgaccgagcaggttcctttaagtactgcatattggccatcacacccggctaattttttgtatttttagtagaggcagggtttcactgtgttagccaggatggtctcgatctcctgacctcgtgatctgtccgccttggcctcccaaagtgtttggattacagacgtgagccaccgtgcccagccaagtagtcccctcttatctgtggtttcagttacctgaggtcaactgaggtctgggggtaaaaaaagtatatatgtgtgtataagatacatacttatacatatataagtatatctgtaagtacacacacacacacgcacacacacacacacacacatatttttttgaggtagagtttcgctcttgtcacccaggctggagtgcaatggcgccatctcggctcactgcaaactccacctcctgggtttaagcaattcttctgtctcagcctcccaagtagctgggattacaggtgcccgccaccacacctggctaatttttgtattttttagtagaaacagggtttcactgtgttggccaggctggtcctgaactcctgacctcagataatccacctgtctcagcctcccaaagtgttgggattacaggcgtgagccaccacgcctggccacacacgtatatatttgagacaatgcatgtgtgtgtgtgtgtgtgtgtgtgtgtgtgtgtgtgtgtgtgtgtgtatgtatttgagacagggtctctctgtcacctaggctggattgcagtggtgtgatcatggctcactgttgcctcgaccttcctgggctcaggtgatcctcccacctcagcctcccaagtagctgggactgcaggcatgtgccaccatgcctggctactttttctatttttttgaagagacgaggtttttccgtgttgcccaggctggtcttgaactgttggactcaagggatcttcccagcttggcttcccaaagtgctgggattacaggcatgagccactgtgccccagccaaatctgaaaatattaagtggaaaattccagaaataattcataagttttaaattgcacaccattttgagtagcatgatgaaatctcatgctgtcctgctctgtcctgcccaggatgttaatcaacccctttgtccagcgtattcgtgtaccataggctacctgtgctttagtcacttagtagccatcttagggatcagatcgactgtcttggtgtcacagtgcttgcgttcaagtaatccttattttacttcataatggccccaaagtgcaagagtgattgctgacatattgttacaattattccgctttattaatagttattgttgttaacatcttactaatttatgagttaaactgtatcataggtacgtatgtgtaggaaaaaacatagtgggtataggtttggtgctatccgctgggagtcttagcatgcatcccccgagaataaaggagggctgctgtagtttcattgtctcacttcggctatacccagccatcatgcgtaactctggtgtggccaaaccaggcttttattcaaggcttactgtgggccatggggagactgttaataaagtctgggtgctaatatttgacctcagctccagctgtactctcttattgagtataaccacctccctagcttcacctgcagtcttgaaatggctgagcaaatgggcctggtccccactgtattggttacttattggtgtataacaaattatgccaaaacagagagggctaaaataataagtatttattatctcatagattctgtgcatcgggagtctggatatagcttgactgggtacctctggctcagagtctctcatgagatggcagtcaaactgttggctggggctgaagactctatttggggggagagtgtttgcttttaagctaattcacatggttgttggcaggccttggttccttgccatatgggcctctacactgggctatactggacatgatgattggtttcccctagaacaagtggtccaagagagcgcaagagagagtgcctaagatagatacctccatctttttatcatctaatcttggaattgataggccatcacttcttctatattgtgtttgttagtaagtccagcccatcctcaaggtgagggaattacataagggcatgaacactaggagggcaaggaccgctagggatcatcttaaaggatgcctctgagattgcccaagggccatgctctggggaacaatcacttctaggttctgtggccttttagtttttctttgacttcctttgcttatgacctagagtcttgtggagtctttttatactcccttttatgttgtgtctcttggttcatgcattacttcattgctttgacatgacctatccttttttccttctccccggactcctgggctccaattagaaactagctttttatcctaggctgcagtcctgcctaccaactttttttgtttcataccttctattctggagcccattgtacagccactgactttggagcctttactactccaacttggcttctgagagttagatttgtagatggcattgaattgggactcacaatgacagatgaaaaacttcattctgactttttaggccattggtgttaggtgctaggactgaaatcctagtatgtgaaagctggaaggggttttagagaccatctctcccaaacttcttatttacatatcagaagaacaaacttacccaaggttttggtaagccagggctagaatataattttctctgattctcattcatatgttgttctcactctgttgtggagcctgtctaccctaatggagcctgtttgggttgttaggaggtctgggacctacacagaggagaaccaggaagcagttcacaatattatattatgttcaccgaaattggtctgggtacaattagggatatacaaagtcaaatgtcaagtgctgcttctttggacctatccagctagaaagcttttttattaggcacagaaaaagaagcccagcaatatctgtttcctatggtgcctaatatatgcaccctataccactctcttgacaatatctgttcagagcaatgaggaatctgtttgctgggatgtacagtataggcatctgaaggagacaggtcagagccttatgttgtatgtctcaccactgagctgttcagctggctccattatggatttggggcctccacaggcagggtaaatgtattaaaaactttgtggggttactcgtggccacctggaaagtgccaaggggaggttctctgggcattgagaatttgacaactttgcctgtgttgatacaacttgctagagcaggcaagacttgaagagggatggctgtggtcctgtcatgtttatcagagtggagcagatttcttttgtgtgagaagtcatgcaagaaaaatccggaaatgagccaacagcacttaaacttttgttttctgctggggagcatggaatagagaaggtgcaggttctaaaatttctgtatgggtggtggttgctttcctgacacagagttccagccccagaccactttactcacttcatctccctctgttccccttgctgcattcttggcaagccaagcatttttctttgttctgatctgcagaacaaacttttatttatactgcttcacttttgtttttacttatgtcatttaacttccttcagaatgtctttattacctgtccttctttatttctacttccagtcctctatgaagtctttcctgacactaattctagctgtgagatactgctgacctgtgaacaaactctggtagcacttactatctgcagtgctctctgtgcacttcacaccctgcttacgccacaagaggcagcttgctatgtcttttttttttttttttgtgacagagtcttgctctgtcccctggctggagtgcagtggcgtaatcttggctcactgcaacttccgcctcctgggttccggtgattctcctgcatcagcctcctgagtagctgggattacaggtgcgtgccaccatgcccagctaatttttgtatatttagtagagacggggtttcaccatgttgatcaggctggtcttgaactcctgaccttgcgatccgcctgcctcggcctctcaagatatgtcttttacagcaagccagtacctaagagcactgggcattggtttgagttcttggtgacagtatgacagtgtgatccaaactgtcaaatgacagtttcctcacttgaaaaatggagttatcagcaccataagagagggtaaagaaagaaagaaaagaaaagtaaaaaagaaattaaaactgtgctttatttattattattattatttttgaatatttccttgtctcttaagggcaagagccatgtctggtttgttggctgtagtacatatcctcagtacctatgagagtgctggtcagagagtatgtgcccagtagatatttgttgaccaaatgaataacaatgaattgatctttggattgagtaggtggggagggagaataccaagtacttgacatcagttcctgtaaaactgttagatgagcatgccctgggattgggatagaattcacatggtgagttttctgaggagttctgtagggattatttttctgcctgacctagtacttcatccctatttactaagcacctactgaagctgtgctcagtgacagttatcagtcataatgagggatggtttggctattgactttggttggcagtttttgtttgccacagcaatgactaccctgagcaggtggctgcagtaggagtggagaactgtgcttgaagaggacatgaaacctgtaggcaaggccttcttgggtcttcctgctccctgtctttggttccatggcccacatgggtttacctcaggtcaaatttgaggcagctgaatgaacagaatgaactttcactactttgctgagactagcttgtggaacggaggaggaaacctttcatggttcccactcctgggcttgttgtgcagcagagagataggatagtcctgtgaagattgctggctttttaaatgttatctctgatgctgagaactccagcctgagcaggcatcacatcagctttccttcaagacgctggggaggggcctcttgggagatgtgatggaggagacaaaagaataaaagtaactgtgctgtcagcacggcccagtaagggcttatctgaccctttcctcggttggccatatacacagagcccctggctgccttgtgttgatctctggcctaggtaatgaccagaaatctcactggcaggcaggcaggcaggcaggcaggcaagcaggcaggctttcaaatctcatgtgcctctaattttctcagtgtgattcagtagctctgctcctgtttggcctctctgggttatctcaggcctctcaggaagctctcagaactctcgtcactacagtgtatgttcgaacaaatgtgtctgtgcttgccaagttcccagagctggcttctgaaatacagcagccaggggagatgggtggccttcaggtgtaacacacacacacaggttagaaagcagtgtgtgtctgtgtgtgtatttgttgctgggtggtcgaatttgtggaggtcttgtttcaagaaacttttgctgacaagagcaaaggtcactggaactcacacttcatatctctgaagagataaatatgtaattaagacaactgaaataacttcgatggtaagaatgatgatgacagctactatttattgagcacctttgtaggtgttttacatctgcaaaacaactcttaagggtggatatagctctcattttactgatgaagaaattgtaactgagaacttaaggttattttcccaaggtggcggagccaggatttgaaattagctttatctgatcccaagaccaaaattgtttctatttttgtttaataacttggtgtggggtggggtggcggggaagaaacagctatctgagtttagaatttaggtggagataggcattttgattaaaaattatacaatttataggactgttaagtggtgttagtttattctatcacccaagtggcctgggaaactaggattagaggtgggatgggagatggaaagagaggctgtattttacttatgaattctgagtaggtagtacctagctacagagtggtgtatattcagtttatattttccaaaactatcaccctggttcaactgttctgaatttaagccttggggtaggggctgtgtctttgtagttagtgttctttatctcttcagtcaacatttagcatgtttattatgtgttataagacaatccctgcccagtagaaggactcaatatagcaggagaattaagatgtatggtcacattttatattataataagagcttctatttattgagtacctattcttttctctctctttttttttttgaccgagtctcactctgtcgcccaggctggagtgcagtggcgccatcttggctcattgcaagccctgcctcccgggttcatgccattctcctgcctcagcctcccgagtagcggggactacaggcgccagccaccatgctcggttaatttttttgtatttttagtagagatgggttttcaccgtgttagccagaatggtcttgatctcctgacctcgtgatccgcccgcctccacttcccaaagtgctaggtttataggcgtgagccaccgcacctggcctgagtactattctttatcaggactgggctaggtactttcacatgcattattttagttaatcctcacatcgggtctctcactttatagctttttgtacaaggcaatcttggttcagtgccctgtgattgatactgatagtcttgttggcagttgtgatcttctctgctgagggagatcagagaagctttgtagaggaggtagcagcttagtgggtcttcagatacttcaggtagaaatataagggaatttgtgggaagtattccagtcataggaaatgttatgagtaaaggtctggagtgggaaaaagtaaagagtctttggggggcagtagtttagattggctggagagtggtagctgtgccagagagtaccataaaaagatcaaggagggcctaaattgtcaggctacttgattccatagggaataaatagtccttgcacgttttgacaaggggagagacctgacctgagttttgctttagcaaggttaatctcacagaatatgcacagtacattggtaaaggtgagattggaggcaatgagcctagataggagactttgcaactgttcatgagcagaagacatcagggtctgcattgtggaggtaaaatcagtaggactcagagtttaaatgtaggaagggaaggaaagaaagaaaagagtcaaagatacaccagtgttttgagtgtgggtcatgaagagactggtggtgccattagcagaaaatatatggcagtcagaaggagggtcagtgctaggggatgattagtggtggggtagctgaacttatttgaagtgctgggcaaggggctacactccacaggacttcaggaaccaaataattctttctatgcttatttcacattgctacattttacaaatgagttttctggggtccaaagaaatgaaatgatttgcctaaagtcatacagtaactccatggtggaatctaagtctgagaacccaagtctctttgctttttagctattaaacttcctaacaaagctgagccttgactctaggaaaatcagagacagtcttggagacagacaaacctgacttcaattccagatcttgccagttttctgtttgtaagatcgtaacaagattgcttttcctctctgagcctcatattcccttttgtccacatttgcaaaaaagggaatattaatttttacctcatggaggcattggaagtaaatatgctttctataatactctttttacttttttttggttttgttctgagacagggtctcattctgtcgcccacactggagtgcagtggcaccatcacagcccactgcagcctccacctcccaggctcaggcgatcctcccatctcggcccaacaagtagctggtactacaggtgtgtaccaccatgcctggctagtttttatattttttgtagagatgggggtctcaccatgttgcccaggctggtctggaactcctgagctcaagcaatccacccacctcagcctcccaaagtgctgggattataggcatcagccactgtgcctggctacatctccgattttctagtgggatatggagtggctgacagaacaccgagtgaccatatcctatcagctactcttttttttttttttttttttttgagatgaagtcttgctctgtcgccaggctggagtgcagtggtgcgatctcggctcactgcaacctctgcctcctgggttcaagcgattctcccacctcagcctcccaagtagctgggattacaggcgcctgccaccactcccaactaatttttgtatttttagtagagacggggtttcaccatgttagctaggatggtatctcttgacctcatgatctgcttgcttcggcctcccaaagtgttgggattacaggcgtgagccacgacgcccggcctcctatcagctactcctgaccagagagaagatgattaatatccccttccctcagggtcttctgccaaccttcatgtgggctcaaagtggaggcaaagtgatagctgaatttaggctatgcttggtgagaacttcctctagactagggtaagtcctggcttgggacagaggaaccagggtggacttgctgatcagagtgcttggagtccttatctggtcgtctctttggtttagtacacaagttcctaagttcttctcagaggggaagtcagctgctctagtaggggtattgttaggtagtagggctgtggttatgtcagctctgtgtcatgggggcaggcctgaaactagctgttttgtccaatatctagtcacatactctgagtgagtggaggaggaatacaagattttctaattttaaaaaacaactggttactattttgtagcttctgtcttaatgccttttctttccattgttttcttgaaacttttttcattttcttccctcttcctaggttggttctcttgagtgttcacagctttctttagggaaaatctggtttaataaaaagaccatgagactaagaattaggtaggcttagtttagcctgggttctgttactcttgacttttctgggcttaaatttcctcatcccaggtattgtggggataacagaatctatcttacaaggttgatgtgtgcagatcttatgaaataatgtgataggcatttattcatacacaaatttgagtaatttatcattactgtattggtttttctcctctgaattgtctgatgatctgttctttgcaattctttggtttatccctctctctttagtaccctgttctcctaggttctcactcttccttataatcttgttttctaactctcgtttttttttgaaacagagtctacctctgtcgcccaggctgaagcacagtggtgtgatctcggcccattgcaacctccgcctcctgggttcaagcgattcctgtacctcagcctcccaagtagctgggactataggcgtgtgccaccacgcccggctaagttttgtatttttagtagagacagggtttcaccatgttggccaggctcatgttgaactcctgacctcaggtgatctgcccgccttggcctcccaaagtgctgggattacagacgtgatccactgcacccggccttgttttctaactcttaatgacaacaggaaaagtgtggctacactggcattacaccagttggaagggagtgggtctgagctcttggggaaatgtaaaagttcattggcttttgagtacaatatgttgtcattaacttgaacaagtctctttgcctccattttctttttttcttttttttttttttttgagatggagtctcactctgttgcccaggctggagtgcagtggcgcaatctcggctcactgcaagctccggctcccgggttcatgccattctcctgcctcagcctcccgagtagctgggactataggcgcccaccaccacgcccggctaattttttgtatttttagtagagacagtgtttcactgtgttagccaggatggtctctatctcctgacctcatgatcctcccacctcagcctctcaaagtgctaggattacaggcgtgagccaccgtgtctggctctttacctccattttcatatgtgccatctggtttaccattatagctcaattcttttgattctcaaagtcacttccatttctgaaaactcccctttaatgcacaagtattactgtgtttatgttactcccactttttttttttttttgagacagaatctcactgtgttgcccaggcaggagtgcagtggcatgatcatagttcactgtaacctccaactcctgggcgtaaatgatcctcctacctcagccttccaagctgggactatacgcaggtgccaccacactccactgatttttaaaaattaaaaaacttggccgggtgcggtggctcacgtctgtaatcccggcactttgggaggccaaggcgggtggatcacctgaggtagggagttcgagagcagcctgaccaacatggagaaaccccgtctttactaaaaatacaaaaaaattagctgagcgtggtggcgcatgtctgtaatcccagctacttgggaggctgaggcaggagaatcgcttgaacccgggaggcgtaggttgcagtgagccgagattgcgccattgcactccagcctgggcaacaagagcaaagctccatttcaaaaaaaaaaaaaaaaaaattaaaaacttttttttttttgtggagatggatttgcccaggctgttcttgaactcttggcctgaagcgatcctcgcacctcggcctcccaaagtgctaggattacaggtgtgagctactgtgtctggccatgtgtttacctctgaactgaggaccaaaactagctttttagtatggattaggttcagtatagccactggggaatggattgcattctggagtgaggggtggagcctggcaagagggcagttctgttagctcagtttacctacgcaggaagggtgttagggcctccaggcatacttatgctgcttctgttatagctgacacctaactgctcctcctgagctgagcgtatgcttgtactcttagccagaagtcagagcttggtgaggcctgattccccaaagaattcagtgataaaaattagggcacttgagcatatctaattggctgaactgtgtgaagggcagaggctttccctgggggctccttttaatctctgtggttatagtcttttaaggttggactaattaaaatgtgttgacagttggactcactactttccttgcactaggtcctgctccggcctcctagagtaccagaagttggcacagagctatttttcctggggagctgaggagtgggtttccatttcctaatctactaaatctacagtgatgtaatgtttgtccaaaatggactgccaaacattttatggtggggagaaatttaggctgggacttggatgtggcctgggtttctgcacttcttaaggtgtcttttcaggttgattgtctgttctagtagccctcaaatggccttgctctgtgagctggcaagtcatttctattgccctggagtatccttctctggtatgtgttcctcttctaaccagaaaaagggataaggaaaagatatttaagtcccaccatttgccagatcagggctagtgttttacacacctatcttttgaggtatgcttcataatgcccattttgcaggtgaagaaatagattcagaaaaggaaaataatttgcttgattgtcattacaggctgtaagcaactaaatcagtattcaaatccaggtctctccctagcttcaggttactttcctaaggtagcacaaatgatttcatgtcctcttatccttttaagccgctaagttctcatatccagagagtcttcttcggttcctttagccagaatgacttcttgccctgctttttcagactactctgcctctcgctaatctgtctgatatttaagtcactgaggcatgaatctacctccctcatctgactattcccgctcctgcaagatttggtactcagggtgtatttgttaaagaacagaatgaagttatagtgctggaatttcaggtgttatgatagactggcaagggtaagggttttgggcaaagccttggctagtttttcaaataaggccccctgtgtctttctgatttgcccagaatgtgctgttattttcctggacatctggctttagagtttgtatctttttttttttttaatttttattttctcctcctcttcctcttcttttattgtttgtttgtttgtttgtgtttttcttgtagttggtttgcaacctacagagctaggcttaatgctccctggactggagtgatatgacaaaccctcagcttcgtcttggttgctggaatatgcctgttgaccatggtgcttggattttgtttgtttggttggttttttgcaaagagcatgccaagatactaaccttgcatttggggcttatactttctgcaacctctgcctaccagtgtatgtcacttcacaggataaaggctttcctggcaaaggcaaacacatgtaaaggcatccctataagttgaattatttttctcactgacttgaaaacaattgaaaaactatctcagacctttttctgtgcatatagtgtatacttcgtgtttaacataaaaagttaaacttcaatggcaaattggaacataacaaaatataggccaggcacagtggctcatgcttgtaatcccagcactttgggaggccgaggcaggcagatcgcttgagctcaggagcttgagaccagcctgggcaacatggtgaaaccctgtctctacaaaaaatacaaaaaattagccaggagtggtagtgtgtgcttgtaatcccagctacttgggggtagaggcaggaggattgcttgagcctgggaggccgaggctaaattgagccaagatcatgccactgcactccagcctgggtgacaaagtgagaccctgtctcaaaaaaaaaaaaacccctaaaaacaacaacaaaaaaatcaaaccaacaacaaaatatagttaaaacgcctttagtggaagaactcataaaatattaataatcaaaataaatactgcaataggatgaaacatgcatttttgctttgtattgttttgataacataggcaacctgaaatagcttagtcaaatatattgaactaaataaggacgcaacattccttttggtttctgtgctatggagaatagatatgaaatgttcttaggagaaggggcaaataatgcattctgggactaggaagaactgtgctgtggctcagttcctctactcagtggtgaaactaagctttctggttgtctgttcccctatgtgttaaagggaataatacctatcttgtttaattttatgagggttaagtaagataatgtatgtgaaagtcttttgtaaactatgaaatactattattgtcatacttagtgggtggctggagccaatttgctagcactgtaaggaagcttttggtttaagatatggctagacctaggtaggaagaaggatgcaaaattaatggataaacagacctaggtaggaagaaggatgcaaaattaatggataaacagttgaatgctgtttgggtagcagctgagaggaattcctgtgagttgagggaaaggactacattcatttcttttgtttttgggagacagggtctcactctgttactccagctagagtgctatggtatgatcgtggttcactgcaaccttgagctcttgggctcaagcaatcctcctgcttcagcctcctgattagttgggactacaggcacatgccactacacctgactgattttatttttattttttgtagaggcagggtttcactgtgttgcccaggctggtctcgaactcctgggctcaagtgatcctcctgcctccatctcccaaagtgatggaattatgggccactgggtctggccttcaatacatgtttattgagtcctgcctggttgaagataaagaaatactgatatctacctactaaatacatgatgtggtaaaatatggaggcagtttggtttagaatgaaaaccccataaagatagggttcttgtctgtctcatgcactgttatgtattcaccaggagtagtgcctggcatgtagtaggctctcaaaaaatatttgttgaaagaaagtttacgatttggaatcagacagaccaggttcatatttgggttctgcccagcccctttactgagtgcgttgctcagtttcttcatttataaataaaataggactaggattagctggttattgggagagttgtttaaaaaaaagattaaaaccttttctataaggctttacagtaagcgcttaaggaaagatagtttctttcatttccccttgatggtttgcaaagtgtgatgggagtgcaggggaaaaagcagttagagctacctgggggagtctagacaatggcttcacaggcttgatctgttagtgtcttcctacagaacaacattattattattattattattatttcctcacaaaaggaactccctgggattaagcaagcatcttggaattggtatgccttgcttctctacatttcccatggtcttcatgggagggctggctcttgtctttctagcaaggtcacatttacactgtaggtttgttcagaggttgttgttccagaagaagcagctttcagtggagactctggacttagctgatttgcatgggcttttgtagccagccgtcaatcccctatccccaccctgccaaatacctcaataattgttagttatagctttgaaaacgtgtactcagcttgacttctgttccggatcagttgtaaattctcacataaggtagagcagagtgtgtttgcttgggttaatcaggtatttataagttgacctttactagtgaatacctaatttttccctcatgcctaagtaactctagcaggccgagggccttgttctcaggcattcccagaactgttgggagttgcagcaggtttgcctgcccttgtcatatatgcacaagggccagtaggatttatctgtctcccagcaagggtgcccaggacctctccttttatcctatcattctaaagcactgggaataccagtctcctctctctgatcagcattttagacactgatgctttctcttctagttagtttcttgggagaatgagtaagcagggaggaattgtttggctttcaggtaaaaaggacttcttgcttgtgaattgaagtcactaggcgagaagtgagtaaagaacatgttcctggataggagtggtcaagcgttggtaagttagacttggtttggggttaaatgggcctggtgctctctaggagtggaatcagtaagggtcctggctgtgtcctcattgccctccttcgggagctgagcattgctgtaggggagatctcacatatggtctggggagaagggaaaggaggagggttaaggaacgaagagacagagggaagaaaagggaacttttgctgagctgtttctctaggctaggtgctttacaccaataattttctttaatcttcacaacaactttgtgaggtagctataattagtcttgttttacatatgatgaaactgaggcccagagaggttaagcaacttacccaaggtcacaaagctagttaatgataataagttattatttatcatgtgcctgaaaagcacatatgaagtttctttttttttttgatcctatgaaagataattattacttcttcaatgcaaatgaggaaactgggaattaaagagctttggttacttgtggaaggtcactcatctggcagtgtcagtgcagggatttgaaaccaggtctgtctcattacagaatgtgttcccttgatgtccatgttgctctgcaaatggaagagctgggattcaaatgcagagtcatgagagcagggcttatgtcttacctatctttgtgtcaccattccctatgacagtgcttaccatgttgttagtgcccaataaatgcttgctgtaaaatctagctctgccctccccatagctcatgttagctgcagtgggttcctattgctagctgcgtcctgccccagctgctcggctgcctatcttcccccgacagtttggccttatcgtgcctacccattgtggcctccttgacatcccaacacacagcatctcctctagtactgttgctttcctcttcttcatacctctttttttttttgagacggagtctcgccctgtcacccaggctggagtgcagtggcgtgatcttggctcactgcaacctccgcctcccgggttcaagcaattctcctgcctcagcctcccgagtagctgggactacaggtgcacaccgccacacccagctaatttttgtatttttagtagagacggggtttcaccatgttggccaggctggtctcgaactcctgacctcaggtgatccacatgcctcagcctcccaaagtgctgggattacaggaatgagccactgcgtccagcgtttcatacctcttttccctagctatacattttcctctggctatggctttccaaaaccctccaatcctgttcattcttttctctgtagtttttctgacttattccagggacttccctttctagattataatcttcttagtctgtaccatataatttgtcacctaattatctactgtttcactttctgttggtttcgtggacattaatcttctccccagccaactgatggtagtcatattataataactccccagattggtttgtgctctgcactttacaaatcactccactgtttaagacctgtctttttgcttatcatgcccacagctgctctgtgaggtgggacaggaggggattgttatctccatattattgtaaacaaattcaaagaaagcaggtgacttcccaatgtcatatatgtaattaggggcagaacagaaactatatctcaggtttactaatttctggcttagaattttatctgcaggctcttctacatttgtttttttccttaccatttcccctcttgccttcaagggtcactcaaggcagaacatctaccttgtgggtttttaggaggtttggttggtgacccagtgaatggtaaagtagcccagatatcaatcttaggtacttctcagtggcatcagtgttctgggttgctattgccgagagaattctctttctgtggctattaggattaatgttgaactaagaagcattagattattatgaatggtcagaacacactctcatggagatccaggaagcaggacaggatgtgtggtgctgggcacttttgtgttgtggcaatggcatgagtttgcaagcagtcaggccagagtttgaaatctggctttgctgttgtttgctggcctcatgacccttagtaaatcattaatctctctgagccttagggccactgagagaatgtatttaagggccacataatggcctgtgaaaacagtatttgttgttggtttttattgccaatactactttaagtttaaggtgcctgaagggcattagaagcctgctagcacctgtgacccttgcaggttacttctcgtgtcttgatttccaagcattagtgatgactaccttggaagctattggctgatagaggatgagcttgaatgctgttcccaaagtctcccgtctcccaagtttccagtgccttctcagggcaatgaaaatagtttgtggacagctgggggatggtttcagtgtcaaactttgggagtaaaatctttcatgtttttctgaagaactttggcattagaattgttggttctggaaagtcaagaacacagttgttattgagagattttagttatttctgaaaccagatattgctccaaagctgtttgttaaatacttccctactcttcctaaacccctgcccctccccaaaagaaaaataaatcatattcagaccatcgtgcgatggttatatctctggcctccctggtcacccagcctctagctctctgctagcaccactccaaattgctgcttcaaaagaggtcagtcagcccctttcccttactcctcaaccatgacctggtctgtctggaaagaggatgagatacatggaccaatacatcctatttaaaagggagcttgctttctcactagggactttagactgcctgacacacaggaaatgactagaaaatctgaccagtggagcataactcattgctaaaatggcaggtttggacggctgcaggatgggagagcaggcttcctgaagaggcaggaaggggcagctggatgggaaaacagtgacttttgagtttttccttttagagtatggtgacgtaggccgtttattaaaaaaaaaaaaaaaaaggaaaatcacataacataaaattaatcattttaaagtgtacaattcagtgggatttagtactatcataaatgtagttcaaaactatttcatcaaccctaaggaaatccatacctgttaagcagttgttcctaattccccctctccctttcccctggcagccatcaatctgtgtatctgtgttttgtctgtatagatttacctattctggatatttcatataaatggaatcatatgatctattgatcatatgattattttattttatttatttattttttcaagatggagtctctctctgttgcccaggctggagtgcagtggcatgatctcggctcactgccagctccgcctcccgggttcatgccattctcctgcctgagcctcccgattagctgggactacaggtgcccgccacagcacccggctaatttttttgtatttttagtggagatggggtttcaccctgttagccaggatggtctccatctcctgacctcatgatctgcccatctcagcctcccaaagtgctgggattacaggcgtgagccaccgtgcccggccgattattttatttttatttatttatttttttgagatggaatctcgctctgtagcccaggctggagtgcagtggtgtgctttctgctcactgcagcctccgactcctgggttgaagtgattctcctgcctgtagctgggattgcaggcatgtactaccacacctggctaatttttgtatttttactagagacggggttcgccatgttggccaagctggtctcgaactcctgacctcaggtgatccacctgccttagcctcccaaagtgctgggattacagatgtgagccacggcgcccggccttgatcatatgattataatgggatcatatgatgtattgtgtctggcttctttcacttagcataagggaaagtaagttttagaggttcatctatattgtagcatgtatcagcacttcattccttttttttttttttttttttttttgagacagagtttcgctcttgttgcccaggctggagtgcaatggtgcgatcttggctcaccgcaacctctgtctcctgggttcaagcgattctcctacctcagcctcccgagtagctgggattacaggcgtgcgccaccacgcccagctaattttgcagttttagtagagacggggtttctccatgttggccaggctggtcttgaactcccgacctcaggtgattcgcccacctcagcctcccaaagtgctgggattacaggtgtgagccaccatgcctggccactccattcctttttatggctgtgtaatatttcattgtatgtttatacaataatttgtttatctattcatccacacgtgggcaatttgggctgtttccaccttttggctcttgtggatagtgctgttaagaatttgtgtgcaccgtttacctatgtaccaaacctacacatcctgcatatgtaccccggaacttaaaataaaaagaaaaaagaatatgtgtgtacatgtacctgtttgagtacctgtttccagttcttttgggtacatacctaggagtggaattgctaggttatatggtaattctgtttagtttttgaggaaccaacaaactctttttcacagcagctgaaccactttttacttataccagcaatggactaaagttctagtttctctacatcttcaccaaagtttgttattttttttattataaccattcttgtggatatgaaatagtgcctcactgtggttatgaaatagtacctcattgtggttttgacatgcatttctctaatctctaatgatattgatcatcttttcatgtacttgttggttagttgtatatcttctttggagaaatgtctaagttctttgtctattttttaaaactaagttgtttgtttttttgttattgtaagagttctttatatattctggatactagacatttatcttttttaaaaacattttggggcaaacctttcttgacttaaaaatcacccactagcctttaaatatacctagctctttcatgtctcagcctgtgctcatgcttttctctttgtctagaatatccttcttttctctggtggttgaaattataattgttcctcaagactcagctcaaatgtcacttcctccgagaagctctcttaattggtttctcctccttcttccactagttaggtgctcccttctatgaacatctctataatgggacaccattttttttgtttgtttgtttttgttttttgagacagagtttcactcttgttgcccaggctggagtgcaatggcatgatcttggctcactgcaacctctgccttccgttcaagcagttctcctgcctcagcctcccgagtagctgggattacaggcatgcgccaccacgcccagctaattttgtatttttagtagcgatggggttttaccatgttggtcaggctggtctcgaactcctgacctcaggtgatccacctgcctcagcctcccaaagtgttgggattacaggcatgaggcaccacacccagccaatgggacaattttttattgtctgcttcaaaccactaagttatattttctagagtcagggattatatttgattcatttctgtctttagcatttagcatatgacctgacatttagtggatgttaataaatgctaaatgaaacttgagtatagactgaagacttacttgatagtaatgacaccagacaccatcactgtaggagggatcagttgcgggctgtactagatgtattcatataataaatatttaagaccctactgtgtgccagaaactctgcttggtatgcagtaaagaataatagtccctattgttttatattcaggtaggaagataggcaataaacaaggagataagtaatataatgcttggtaatcataagtgctaaaaaacaaagtaagcagggcaaaggattagagagtgatgggggtgctattttaggtagaggggtggggaaggcctctcattggatggcccttaaaatcacctcacaagggtctggatcaggaatcagaagtcttgggttcttcttctatctctgtgctttgttacttagcaaaattacttaacatttcaaggttggagtttctttgtctataaaatgggtacaagagtccctgccctggtattgtgggagtgttgtaaggattcagtgagttaatggacattgaaagtgctttgttgtatggtgaacagcatgatgtttggctttccctttcccaagttgagaggatgagtgagcagtgtgggagccagccagatgtttccagcactttgaagacaaaaggaactggtttctgctgggagctgtcatgctagcttgcctgggacactgacttatgcagtcctgatccaggggctgagagtgaaacccatgccccaagtggttctccatgtacactggcaaaagggaatagccttgggaacttggggcctgttctgtttagccctccaggaggtagactgtggagaccactctttctctcagttcagccttatttcttgctatgtctgaacctaacccaagggagtaataattagcagtccccaagaagcttgggaggtggaggttgtggtgagctgagattgcgccactgcactccaccatgggtgacagagccagaccccatctcaaaaaaaaaaaaaggggtatgtttgtataatggaatcttatttagccattaaatggagttaagtgttgatagatgccacaacatggataaaccttgaaaacattatgctaagtgaaaaggctacatattgtatgattccatttacatgaaatgtccagaataggcaaatctatagagacagaaagtagattagtggttgccagggtgtggggggagagggtaatgagaagttacttctaatggatatggggtttctttttggggtaatgaaaatattctgaaaaattagattgtggtgatgatgggacaaccttatagatatattaaaaatcactgaattataaaatctaagaggattaattatatgtcatgtgaattatatttcaatataaacatagataatttttttttttttgagacagtatctcactctgtcatctagactggagtgcagtggtgcagtcatggctcactgcagccttgacctcccgggctcaaccaatccttccacttcagcctcccaagtagctggggctatagacgtgtgctagcctggccaatttttgtattattattattattttttgtagagacagggttttgccatgttgcctaggctggtcttgaacccctgggctcaagtgatctgcctgccttggcctcccaaagtttgggattacaggcatgacccatagtgctctgccaaacatacataatttgagtttgctgagaactattggtttaacacaattgtagataattataattttcttttctgattggaagtcttctcccggtacttcagctcacaaaggtggacacattccagttttattttattttattttatttattttatcattttatttttgagacagggactcgctctgttgtataggaggctgaaatatggtggcacaatcatggctcactgtagccttgacctccttggctcaagtgattctctcacgtcagcctgctgagtagctgggactgcaggcatgagcaaccacacctggctaatttctctattttttgtgtagacaaagtcttactgtgttgcccacgctggtgtcaaactcctgggctcaagcagtcctcccgcctcagcctctgtaagtgttgggattacaggcgtgagccactgtgcgtggccccattccagttttcgatgtgagtttgagcatgatcgtaggcaagggcccatcaatgaaggtgttgaggatatagcattgtcctgctttggctcaaggggacttttcctgcctttgattaaggattggcatgggtgagtcatttcccatagtctgagggatgtgggatataaagaatgaattgttatctccgatgatatcttgaatatcacacattataggccaaatataggtgctaaaccatttggcttgaattctttatagaaaattcactgggaacccaatgataaaatagagaaagacggataacctaagagggaggagcaatctggtgagacattcttttcaccttttcacacatgagcaattaaaaacttgagggaagttgattttttttttaactctgtaaatagctactggtataattccttgaggctggtattgtattttgtgctataagaagagagacttggctgggcgcggtggctcacgcctgtcatcccagcactttgggaggccaaggcaggcagatcacgaggtcaggagatcgagaccaccctggataacatggtgaaaccctgtctctactaaaaatacaagaaattagccgggtgtggtggcaggcacctgtagtcccagctactcgggaggctgaggcaggagaatggcgtgaacctgggaagtggagcttgcagtgagcagacatcacgccacctcactccagcctgggtgacagagcgagactctgtgtcaaaaaaaaaaaaaaaaaaaaaaaaggtcttatttggccgggtgcggtggctcatgcctgtaattccagcactttgggaggccgaggcgggcggattacgaggtcaggagatcgagatcatcctggataacatggtgaaaccccgtctttactaaaatacaaaaaattagccaggtgtggtggcgggtgcctgtaatcctagctactcaggaggctgaggcagtagaatcacttttcactcaggaggcggaggttgcagtgagccgagatcgcaccactgcactccagcctggcgacagagcaagactctgtctcaaagaaaaaaaaaaagaagagagacgggccatatactcaaggagtttccaaatatatccagaggtgaaacaaacatctaggatgaaaagggtccagggactagtattgtacacagtcagaggaggtagagggctgtgagtttggtaataagagaggaggcttgggaaacccagcctgagtctaggtccagagggcagcatgcactgggtgagggcctctagggagagtaaagcaggatacattcttgtccttatacttccttccctgtttctgtacctgctcacttttgccctgcaacaaataaacctttaagcatctgttctcagcctggccttgcactgggcaaaactggaaacatgggcattatgaaacctgggccatacatctagaagtgcttaatatattgtgagaggtgaacctggaaacaatggactgtaatggcatgggtcaaggtatgtaatagacagagatggatttgatatatcagagtgccgacctactgactctgtcttgggattaggtaaacctacctttaaaaaggcattgagacagggcctggttagagaaacctgttaaggttattgccagaagatgaagcggaggtacagaatgctacttttggggtatggctgctttagggcctttcatttcgttttcagatttgatgaaagaatagggcatctgtggccaggcgcaatggctcacaccagtaatcctagcactttgggaggccgagacgggcggatcacgaggtcaggagattgagaccatcctggctaacatggtgaaaccctgcctctactaaaaatacaaaaaattagccggacgtggtggcatgcacctgtagtcccagctacttgagaggctgaggcaggagaatcgcttcaacccgggaggcacggaggttgcaatgagtggagatcgcaccactgcactccagcctgggtgacagagtgagactctgtctcaaaaaaaaaaaaaaaaaataggacatctgtgtccaggaatctttttatctccccaccacccctcaagcagtgctgggctgactgcagaaggctcttccctgttctgcacttgttccatttctgtttttgaaagatgaagcctgggaggtgccagagctatgccagctgctatggggccagaaacaggtgaggcttttaggtctgcttgagttaaggagtgaggggtttgtcctcttcagctagcttaaggtctctgctatgaaactagataagtattcacatagcttgtttttcatttggggctattttcagccttggaggccagcaaggtgaatgattgagatgcttttatggggttcaagcttttgctagatcctatttgccaggataggtgctcagccattttccaggacatcagcttttctgaacaagcagcactgaaaggaagaagcacttcccttttctttcagggggcagtataggaaatgtgagggtgggtggtcagtttaatattataacccaggttttaagtagagaggctgtatagtttggaacattgccatatagtctttttttttgaatttttgagacagagtctccctctgttgcccaggctagtgtgcagtggtgtgctttctgctcactgcagcctccacctcccagattcaagggattttcctgcctaagcctggagattacaggtgcacaccacctgggattacaggtgtgcaccaccatacccagctgactttttgtatttttagtagagacggggtttcaccatgttggccaggctggtcttgaactcctgacctcaagtgatccgcccgtgtcggcttcccaaagtgctgggattacaggtgttagccaccatgcccggccgccgtgtagtctttaatgcagttttgagggactcatctgaattgttcttgtgtttttcttgtcatcttgactgccaggctttactatgggggtggagctctgtaaatgtatagatctgctgctgtccagagacttgatctcttttgtgcttgcacacctctagggctaacaaagcagatggagtggcctgtacaaagaggtgatgcatcagtggtctgtatccaggagtgttcttgggagttccctgtttagtgagtgcttactatgtgccaggcagctgtggcaacagcagtcatcatactagatgctgaggttttatcagagatacctaaggcaagatcattatcttatccctgaggcccaacaaataaatatttgttgtttaataaatgttgatccaaggaataaactatattttaaaggaacccagacacagggggtgtgagaaggaagctagcagtcattgaatgcctactatgtgccaagtactgtgttaagtgctttcacagatatttaatttttttttttttttttgagatagagtctcgctttgtcgcccaggctggagagcaatggcacgattttggctcactgcaaccttcacctcctgggtccaagcgattctcttacctcagcctccagagtagctgggattacaggcacacgccaccgcatctggctaatttttttatttttattttttagtagagatggagtttcaccgtggatacttaatttttaatacggtcttctgagattgttaatgttattgatatctttgagatggacaaaataagaggttaaattacttgttaaagtcactttctattagccgtatctaggcgcttttttgagggtctggcctctaggtttggtagatgcctaacagggtaaccttgtttttagtattgttgggtgagtggggctagtctgagtcttttcaaagttgcaggagatgcagttttctaggcttggtgctgaaaatatagataaggataatataaggtacataaactggaagaattactattgagtggggagacaggtaaataggcattacagggtagtaaatattaagcaaagacgggcctttttactttgtgagaggtacattgggcagggacttttactctgagacttcaactcttgtccttctttccatacctgtagctcctcattgggatctcccttattccctgaccatgtgtttcgacagtttcatgagtgttactttttcatcaagattgcttactccttgagactagatattctttttttctttcttactgcctcttagatatctgacctaggccatcacgcttaccctctctggaccttagtggcattatctgtaaaacaagcctaatgataggtgttttgcaatctgagagcaggggccagtccaagtggtgatctctggaggttcatctagtttttccaaatctgtgatttctgtgatcatcctcttttggtccttatatagagctggatatccaagaggctttaagtttgtcacagagattgctgaaggtaatttatggtacctcagaagtcttaagaacttttctgtatcacccctgttagagctacatacccagtagcactgacagagactcatggcttctcctggccagtcccttggactgaaccagttttctcagcctggtatggaagatttgactgaagttttaagctcaaaaggatattgtggccgggcatggtggcacacgcctgtaatcccagctactcaggaggctgaggcaggagaatcgcttgaacctgggaggtggaggttgcagtgagccgagatcacgccactgcactccagcctgggtgatggagcaagactctattgcaaaaaaaaagaaaagcatattgtatttaagtgtattttctagtatggcttatctcattatcagctaggtcaactagaggtagtgctttcctgattttgcttctagaaggcattctttgagcagtgggataggaccccatccttaggactttcacctctccaggtattgggccagaagtctaaagctccatgaaatactgtttatgtacaataccagcttgagctctaaacttgtaaaagaatcaactttgatatgacttagggtcccatgggacctaccaggaagtcacaggaactctgagccacagcgaagtccaccactaattagacagttaataataatgctaattgttatgataagaaatgtatgttgaatacttatatgtcaggtacaattacatatttatttaattctcacagcagtcaatgacatagatattgttattattctcattttgtagatgaagaatctaaagtcatgtgtctagtaattggtgcaagtaggacttaaacctaattagaaatttcatgttctaattccaaactctattttttttattgttttaaataaaaaaaattttatttttcatgttttttttttgagacagagtctcgctgtgttgcccaggctggagtgcagtggcacgatctcggctcactgcaacctctgcctcctgggttcaagtgattctcctgcctcagcctcctcagtaactgggactactacaggcacatgccaccatatccggctaatttttagtggagacagggtttcaacatgttggccaggctggtctcaaactcctgacttcaggcgatcttctcacctcagccacccaaagtgctaggattacaggtgtgagccactgtgcaggctcactattgtattttaattatttactttgatatcctcctaccagattttaaattgccagaaggcaggggctgttactcttcatttcattaaaaaaagaagtattgagttatggcttacatacaataaaatgaattaaatgcttgatgaatttttaccaatgtgtttatctatgtaaccaccacctagatcaagatacatttctgcatctttctagagtgtagcatagagatgagcaaacattttctgtggagggccagagagtgaatattttaggcttgatgggctataccgcaagttgtagcaggaaaacagccatagataatatttaaatggacatgtgtagctgtgtctaagaaaactttgtttacaaaaacaaggtgtttgggctagatttggcctgagggcctcagtttgctgatcccttgtctagcagagtgtctaaggacaaaatagaaatttggtaaatgtttgttgaattgtagacaaagaccttgatttcagaaatctcttcttgattttctagcagtggggcagcttgtatctccatggtagggctgtactttgtttttatttattttttatgttttatttatttatttttgttatttagtgtttatttcataatcataaacttaactctgcaatccagctagtcatggaagaaaacagagaaaacatggagcccaaagggaactgcagcaagagcacaaagattcaaggatactgcgagcaaatggggtggaggggtgctctcctgacctacagaaggaatggtctggtggctaagataaaacacaagtcaaacttattaagagttgtccacagtcagcagtggtgatcttcttgctggtcttgccattcctggacccaaagtgctctatggcctccacaatattcatgccttctttcgccttgccaaagaccacatgcttgccatccaaccactcagtcttggcagtgcagatgaaaaactgggaactgtttgtgttgggtccagcatttgccatggacaagatgccaggacctgtatgctttaggatgaagttctcatcatcaaatttctccccgtagatggacttgctgctagtgccattatggtgtgtgaagtcaccaccctgacacataaaccctggaataattctgtgaaagcaggaacccttataaccaaatcctttctctccagtgctcagagcacgaaagttttctgctgtctttggaaccttgtctgcaaatagcttgaaggagacatggcccaagggctcgctgttgacagcaatgtcgaagaacacggtggggttaaccacggctgatagtacggggctcccggcagcagcagcatctgcaaagacttttatgttttatttttaatagagatggggttttgccatgttgcccaggctggtcttgaactcctgagctcaagcaatccacccacttcgtcctcccaaaatgctagggctataatgttgagaggttctttgtggaacaggctgccttttgataagttgtttgtgttcataagggaataaaaatgtcatcccttccagtactctcccaattttgttggtgcaaggtcttcagaatatttgggatccatgaaaacaatatagagggatgtttgtatgaatcccctaaggctattatgtgttatttattttgtccttggtgcctagccagcatagatggacagggatgctcagtaaatatttgtttttgaatgaataaatgaatttaaattgctttcagtattttaacaagcctaatggaaattgtacatttacctacaataaaagtgtctttgattttggtttcaattatacaagttttgtgtgaacactagtttgctcatgccgattagttctttgactggcagttgatggcatcataggacataaacctacccagtgagtgaatgaccttggacacaagtacacagccaaaataaccaactggtagcagagcctggtgcatgaatatctacatgtttacttccactttcttgctcattagcaatattatttgtatatggttgataattgtatatggttggttaaaatctgggtcaacatttttttttttttttgagacagagtctcgctctgtagcccagtcacccaggctggagtgcagtggcgcaatcgcagctcactgcaacctctgcctcccgggttcaagtgattctcctgcctcagcctcccaagtagctgggattacaggcatgtgccaccatgcctggctaatatttttattttttgtagagatggggtcaatatcaatatccaaataaggtctacatcatgttgattgatctaaaccttcagtctcttctgggactacaggcacgtaccaccatgcctagctaacttttgtattttttgtagagatggggttttgccatgttgcctaggatggtcttgaactccggagctcaagcgatctgcccacctcccgaaatgttgggactagaggtgtgagccaccacgccaggccaatttgaactatatttgaaaaagagggttccattgtttaaaaataagtcttggaaactatagtattgtagctgttctctaacagcaccaattatgacaggaaccaggaactatgaagtggggacagtgactgtgactaacttgtaatatgttttaaacttttttttacttcctcatatttgttgtttttggcttacattctttctcaacccaacagttaaactcttacaacaaaaagggccccgtatgttttcacttttgaagggagagattggtggactgtcttaccctagagccaggcttcaggcttgggggcgggagtcccaaggggtggagtggggggttctgctttgatgagcaaaggaagtggttaagtccctggggcctgtgcagcctgaacaagagcccaaaagtgaccttgggagcatctaagactagacgctcttagcagagcatgggtcccttttccttaccccttattccatagcctacaggttctctttcagttgtccaaagggcctggctggtcaggctttagttgagtcacatccgacatgttccagacccagggtcctggtagctgtgtttagggctgattcctaggaatcatgagctgataacctcaggacaaagaatgaagggtatcttgtttttaaccgtgttcttttttcttttcttttttttgagacagggtctcgatttgttgcccaggctggagtacagtggcacagtctcagctcactgcaacctccgccttccgggttcaagcaattctcctgcctcagcctcccaagtatctggcattacaggcatgtgccaccacgcctggctaatttttttttttttttttttttttagtagagacagggttttgccatgttggccaggctggtctcaaactcctgacctcaggtgatccacccgcttcggcctcccaaagtgctgggattacaggcgtgagccaccgcgcccggccgaccctgttctaaggaaggccaagggcaggaacctcttagcaatagctttggctgatccttggccagcaatacatttgtcactctggccaagagaagagctgctgtggagcacttggtgttctctagcctttgtggaggtcacaggcaaacagggcaggggagcaaggccttaattacttagggactcctggagcaaagccacttggcagtgtctcagcttcttggtgggactggctccttctcctagtgacagtgcaaatactccttccctttatagcttttaaacctccaagagattggtcttcttccttgagcttcaagacatttctatgcagtgtggttcagggctgattttaaaagccggataggtggaatgacaaaaattccttccatctgtgtagcactttttggtcacttacccacattttatttagtttcaaaccaacggtcctgtgagttgtaaatgaagagattaaagcccagaaaggagatgcacttaaccaagtttatatagctaattcggctctgggttccgggaatagtgttctttctttctctctctttctttctttctttctttctttctttctttctttctttctttctttctttctttctttctttccttccttccttctttctttctttctttctttctttctttctttctttctttctttctttctttttctttcttccttccttccttccttccttccttccttccttccttccttccttccttccttccttcctttctttccttccttctttcttttctttctttctttctctttctttctttctctctctctctctttcttttcttttctttcttttctttctttctttctttcttctttctttttttttgagatggagtcttgctctgttgcccaggctggagtgtagtggcgcgatctcggctcactgcaagctccgcctcccgggttcacgccattctcctgcctcagcctcccgagtacctgggactacaggcgcccaccaccacacccggctaattttttgtatttttagtagagacggggtttcaccatgttagccaggacggtcttgatctcctgatctcgtgatccgcccacctcggccttccaaagtgctgggattacaggcgtgagccactgcacctggccggaatagtgctctctctctaccattatatgtgggacaaggggaaaggagaatggtaaatacagttattttatgtactaggcaatgggtaaggtgcttagtttagttttctcacattttgtggtaatttattttttaatctctattttaatgttagggaagctgagcttcagagtagttgacttactcacgatcatagagctaagtggctgagcctggattcagatctaagtctatttgacttcagaacccatgtcttttcatcattatactatattcctcgatagttgtttattctgaaacatcttgattgagctgccgatgcaacactaggtagtgtcacaagggatgcaaggaagcataagatttagtaatttcttccctcatggaatacgtaatttggtgatactgctatggcagagacaatggtgcatagggatagatagagacatggggcagtgggagtttagggagccccccaaataattggtggtgggggaaattgtcagagaaggctttccagaaaagttggtaccttagcttctctagcgataaagagcatgggtccttggggtcagcttgcctgggtctcatcactatagtactatatgctagctatagtgctttggggaagttacttaatgtctctgagcctgcttcctcatctataacatggaaattattataaaatcaatctcatagagctgtgcgaagattaagatgagataatctatgttgaataattagcagccagcttgacacataataagctctcattaagtgttaaccattataattatcactgtctaatctgtttttctcccatatcctgctcaagtggggacaaatgtaggctctcttagggcctgttattgtcaataaagtagaggttttgtctagagtgatttcaaaatatttctttcaggcccaagattctgtcaaagtaaaaactactaagttaattgtttccaggagggcagctgtcaagttactttgtatcttgtggcaaccaaatctggcttgagttccataaagccagctctggtgagttgctggaaatgctacctgataaaggctcttctttcctctgctgcctcttcattggattgactgaaagctggcctcttggaatactggtctatttctcttctcttcctccaagcttattgcgatggagaagatgatgtaattttagtagtccaggtattctctactacttttgggtcctgtctattctgggtaactgtggaatagcagtacctttatatatttgtacagtgctttttgtttgtttgtttgtttttatttttttattttattattattatactttaagttttagggtacatgtgtacaatgtgcaggttagttacatatgtatacctgtgccatgctggtgtgctgcacccattaactcgtcatttagcattaggtatatctcctaaagctatccctccccccgccacgcccaccccacaacagtccccagagtgtgatgttccccttcctgtgtccatgtgttctcattgttcaattcccacctatgagtgagaatatgtggtgtttggttttttgttcttgcgatagtttactgagaatgatgatttccaatttcatccatgtccctacaaaggacacgaactcatcattttttatggctgcatagtattccatggtgtatatgtgccacattttcttagtccagtctaccattgttggacatttgggttggttccaagtctttgctgttgtgaataatgccgcaataaacatacgtgtgcatgtgtctttatagcagcatgatttatagtcctttgggttatacccagtaatgggatggctgggtcaaatggtatttctagttctagatccttgaggaatcgccacactgacttccacaatggttgaactagtttatagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtcctttgcccactttttgatgggggttgtttgtttttttcttgtaaatttgtttgagttcattgtagattctggatattagccctttgtcagatgagtaggttgtgaaaattttctcccattttgtcagttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatgattttaggtctaacgtttaagtctttaatccatgttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagctttgtagtatagtttgaagtcaggtagcgtgatgcctccagctttgttcttttggcttaggactgacttggcgatgtgggctcttttttggttccacatgaactttaaagtagttttttccaattctgtgaagaaagtcattggtagtttgatggggatggcattgaatctataaattaccttgggcagcatggccattttcacgatattgattcttcctacccatgagcatggaatgttcttccatttgtttgtatcctcttttatttcactgagcagtggtttgtagttctccttgaagaggtccttcacatcccttgtaagttggattcctaggtattttactctctttgaagcaattgtgaatgggagttcactcatgatttggctctctgtttgtctgttattggtgtataagaatgcttgtgatttttgtacattgattttgtatcctgagagtttgctgaagttgcttatcagcttaaggagattttgggctgagacaatggggttttctagatatacaatcatgtcatctgcaaacagggacaatttgacttcctcttttcctaatcgaataccctttatttccttctcctgcctaattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggctctgtttatatgctggattacatttattgatttgtgtatattgaaccagccttgcatcccagggatgaagcccacttgatcatggtggataagctttttgatgtgctactggattcggtttgccagtattttattgaggatttttgcatcaatgttcatcaaggatattggtctaaaattctcttttttggttgtgtctctgcccagctttggtatcaggatgatgctggcctcataaattgagttagggaggattccctctttttctattgattggaatagtttcagaaggaatggtaccagttcctccttgtacctctgcctaagcaagcctgggcaatggcagacgaccctcccccagcctcactgctgccttgcagtttgatctcagactgctgtgctagcaatcagcaagactccctgggcgtatgaccctccgagccaggtgcgggatacaatctcctggtgcgctgttttttaagcccgtgggaaaagcgcagtattggggtgggagtgacccgattttccaggtgccgtctgtcgtccctttctttgactaggaaagggaactccctgaccccttgcacttcccgagtgaggcaatgcctcgccctgcttcggctcgtgcacggtgcgccgcacccactgtcctgcacccactgtctggcactccccagtgagatgaacccggtacctcacatggaaatgcagaaatcaccatcttctgcagcgctcatgctgggagctgtaggccagagctgttcctattcggccatcttggctcccgacctgtttgtttgttttttgagacagagtctttccctctattgcccaggctagagtgcaggtttgcgatcacagctcactgcagccttctgggcacaaatgatcctcccacctcagcctcccaagtatctgggactacaggcacaccccgccatgcctggctaatatattttttgtagagatgggttctcactctgttgcctaagctggtcttgaactcctggactcaagcagtcttcccaccttggcttcccaaagtgttgggattacaggcatgagccactgtggctggcccaatgcattgttttaagatataatgagtgtagtggctaggcacggtggctcacacctgtaatcccagcactttgggaggctgaggcagtcggatcacttgaggtcaggagttcaagactagcctggccaacatggcgaaaccctgtctctattaaaaatacaaaaattagccgggcatggtggtgtgcgcttgtagtcccatctgctctggaggttgaggcaggagaattgcttgaacccaggaggcggaggctgcagtcacaccactgcactccagcctgggcgacagagagagactcagcctcaaaaaaataaataaaataagtgttcttcagaatgtcagtatcaggtgaaatggcattattattattactcagtaaaagacctttgagattaagttaggaaaagctaggaggctttaatatgataaggaaaggtatacagggttttctatgtttttctgaacatgtaatctttttttatcctcaaaaaccacctattgacattttgttagataccagtgttccacagaacaccattaggtaaatgaacacagtgtggtcccctgcttttctattagtatgacttggagaagtagtatggccagctgtcctttagttgacaaggtacctccatggctccttttcaaagagaaaatgagatacttaatgacagcttatgtgtcagaaaatctcctaagtgtttaacatagattacatctttgtgttcacaatagctctatgagattgctgatatagttttctccatgttgttgttgtagaaaggtatagatcttggttaatccaccagtccctggttatgtctcagactcagtggtaggagatttagctaactgagcttttattgtttgcctaagccttcttcatttttttcttttgagatagcatctcgctctgttgcccaggctggagtacactccagcagtgcagccacagctcactgcacccttgacttcctgggctcaggtgatcctcctgccccaggctccagtctcctgagtagctgaaactacaggcacgtgccacgatgcccagctaatttttgtattttttgtagagacggggttttgccatattgcccaggctggtctcgaactcgtgagctcaagcaatcttcctgccttggtcccccaaagtgctgggattacaggcatgagccaatgtggctggcccccaacatttcttaaacatttattgttcttgggtaatggagatgtagtgatggaaaaccagacactgcctcatggaacttaatctaatagagatgattagatatgagtgtggaagtataagttacacattgggactttagaggttaagggaaggcagatatttttatgagttactgtagcttcctgggatggtgtgacttaactaatccctaaaactctgtttaagtttatatactgcagaagcttgggaggcatttagattggaaaatgacctgagtgaaaataggagtgagcagagagcagcgatccccaatctttttggcaccagggatcggtttcatgcaagataatttttccacagaccagggtgcggggtggggatgattttgggatgaaactgtttcacttcagatcatcaggcattagattctcataaggagcacgcaacctagattcctcgcatgtgcagttcacaataggctttgcactcctgtgagaacctaatgctgccactgatatgacaggaggcggagctcaggcagtaatgctcgcttgcctgccgctcacctcctgctgtgtggcctggttcctaacaaggcacggactggtacagtctgcagcctgagggttggggacccttggcatagggaatagaatgctcaggagaaggtggtatcctgtactgctcttaggcatgacaccacctgtgagactgctgaaggcgttaatttctggccagctgaaggtagcattgccagaaggaggagctgggcagattgcaattggtgttgtggatagaggcaaaggatcataaatgatcgtcagaagggagctggtggattatggaatgtgaaatgggacagggcaacatttcatatctcaggctatgaatgacagagggacttggaacctgaacatgtttatatataatttattaagttcttaccatgtgccaggtactattctttgcatttttaatgctaagcttatttaatttttattagtagtttattcagattagcttatttaatctttgtaccaaccctatgaaagtaggtactattattttactgttttaaagatgggaaaactgaggcctagagaactgaaataatttgcccaaactcacatggctaataagtggtagaggtgggattcgggcccaggtaatatgttttcagtgtgcttgttcctaatcactctggtttacagttttaagcaatgagaagtcattatagatttctgcctagtgaagcaacttgtttgtaagtattgtgatgcagggcaatttcccaagccttgatggaaggcaagaagaccagccacagggtgttgtagcaaccatcccagttgctttggaagatgtataaaggtcttggagttatttcacaaattacttcctgagatggctctgtcagttggcagtcctacctgtcagctcagcccattttagaaatcattttccaaagaattttaaccttaaggaagctctcctctttctattgaacaggctgtaccaggcataggggccccaggaaccaggtaggaaatagctcttgtggggtcagtccatctggaagcatttgcaagaggggaagttgaaactattgagacttcctgttgtcattagaatttgctctcctgctatagggggagtatcccctgttaggactgatagtctggttgcttatcttgagaggctgggcaagtgggttggggtgcagagatgtgaaagacatagtctgtgtccatgaacaacctgcaggttactgagacacccataaacaagtgcactctgtacagtgtcacaagtgctacaatagaggtacatagaaaatgtcctgggaaaggctgggcttggtggctcacgcctgtaatcccagcactttgggaggctgaggcgggtagatcacgaggtcagcagttcgagaccagcctgaccaatatggtgaaaccccatctctactaaaaatacaaaaattagctgggtgtggtggtatgtgcctgtaatctcagctagacaggaggctgaggcaggagaattgcttgaacccgggaggcagaggttgcagtgagccgagatcgctccactgtactccagcctgggtgacagagtgagactctgtctcaaaaaaaaaaaaaaaaaaaaaaagaaaatatactgggagagaaaggaaggagggtctaaatacttagcaatatcaaagatgccaccctgtaaggatgaccagggttgtgccagacagagtgccctggagcatattctgggcagtgtgactgtggaagtgcatggcatattcagtgaatgacgagttgttccctgaactggagtgttggactacttggagggagtggcacgagatgaagctgggtgtgtgtgaagggccagatcccgaatgaccttgtattttatggtaaagagcttaaatcctattggagttaagctttaccgtcgatatttaagatgggtgtgacatgaccagagtgttttttttaggaagacctcttatatgcctgtgcttagaatgtatagattataactagaggcagggaaggcagccagaagatttgcagtagcagatgatgaggctggaacaagggtagtggtcatgggggttgatttaaattgtgtgacggaaggatgaaggaggcagtgttaggtgactgggcattactgtgatgctgttaacacatggaatacaagagagagagccggggaagttaatgctgctcttgagatggttatgggtgatatccatgagaaaatatctggtagttgggggagaagacatgagttttggagttcctgagagaggtaggaatagacatgagagaatcatgaactctaagaaatagtagagactgtagaagtagatgagatcacctgagtaaaatttataaaatggggaaagaaagggggttaaggatagagcagagaggaactctgatatgtgtggacagaaaagttagggagggagcctgaggaggggcaatcagagaggcaagagaaagtactgtctgggaagccaggaatgagaaaagtttctaaaagaaagcaatagtgtctgttgcagcagagaacaggtagggtgagcctgaaatgaggctactgagtcattggtgaccatggtgacagcagtttcagtggaggggtggggacagaagctagactgctgtggcttagggagtcagtatgaggcaaagatgtagaacaaaagacttttttgagaaatatagttgcgagggaaggaaggaaagagggtggtattttgaagaggcagcagaggaggcaggttcaaagatttttttttttttttaaaggtggaggggtggagtggagacctgagctggtataggttgtggggagaagagattgagaaatgtagccagtgaaggtgccacatctccctgaatacttcatactattgtgggagtcttaaactgtgctgctctgctgaagcctgcggtcactagagcatggggcagacaagggagaccttgtcattcataagtaatcattgcaccatttattgagtaaccgctgcatgccaggcatttttctagatacattagacacatctctgatgctcaccacagttcccagaagtgagtattgtccctattttccaaatgcagaaacagatgagttaagaaacattcagctagttagtggtggagccagtttcagccaggtttctggaactgcatgatgtattctttctgcttcccagtgctattttttttccattaaatggagcttaatgttgaaactctaaagagggcccttgcagggggcagggtgggtggcctagagggacaaaggtagagttctggggctagtgctagcctggagggaacatgacttaatatctgggatgagggaggagggtcttggtctggccttgctctaccttttctttacttaccagtggctctggtggtttcaggcttttactctatttttctgcatctttctgtaacttcttaccagggcccctgaggccctagctgctgtgtgctatggactgttacagaggaaaaaaagaatcagcttccaggcccagaggggcttatcctttttgacaaactactcgtgaggaattgctgagctgtaggatgcactctctttggcacagtggtaggcttcttcctaagtatttttatttgagttgaataattttgattcagtggaaagagcaaaacactgagaattagaagacatgatttccagtctaagagatgaactaggttacctcaggcgagtcattctccctttgcatatttacttgatgtaaggtagggactgtgttttactcatccttgtatcctgagcagctagcatatgccctgactgaataggtgtcctgaataagtttattatggagctagttaatctgctcttctattaaatgagaaaattggaccttttgatttccaaagatttgccaattctaaagcgtattgttctgtgagggcttatgatgttttaattataaaataatatatactgtcacttagcacctactatttgctaggcattgtgtgaggttctttacatatttattttatttaggtgatttaaaaaaatttaaattttgtctaggtgctttagaaatactatggtcccttaggctataagctccatgaggatagtaccagtgcctgttcactgctgtaaccctaatgctgagcacagtgctaggcatgtaatggatgctcagtaagtttttgttgaataaagcaataagtagatgtcttaccatcgataagataacaatcttttaagataggtactattagtaccatcgtatagataagaaaattgagggtaaaaggtcacagaactagtaaatggctgagagagagaagattcaaacctaaatccaactctaaaattggtacctttactacttaacaccagcgtgccttcacttatctgatgttttaattgcaaatttgaaaagaaggacaacagtaaagaaggatacaagatcagaaaatcaaatttttcttgaggggtggggacagggttagaggttgggcactgaagtttagaagttggcaattatctccaataccttaagaataaaaaggggtttataagcttgggaagctgggggaaaaaacgaacaaaacggggttataatggcagttactattcactgggagctttgtttattgaatatctcatggcattaaaagtccacttacataattttaactatcatctatttattgacaactcaaatttgtgtttccagcttagatttctccctgaattttagacttgcatatctaacctcttaattaacattttagatatctaataggcattttaaatttaacaagtttcacttacatggaatctgtcagcatatcctgtcggttctacctttaaaacaaatccaacattcagatacttttcattacctctgcacctaccaccctgatccacgttaccatcgtctcttgcctggtgagataatagcctaactgattgccctgcttttgcccttgcctgtctacagtttattctaaacaggaagccggagtgatcctttcaaaacgtaaatccaaattatataactcttctgttcaaaattgttcagtggctttacatatctctcagggaaaaagccaaagcccttagagtggcccacaagatcacatatgacttggctcccagttactgtcttagcctcatttcctctccacctgctcaccctgccccactggctttcttaccattctttgaacaatagagacagacatactcttgcctcagggcctttgcattggttcttccttcttactctaactttctgcatggctcatgccttatttccttcagatcttttggtcaaatttcaactcagtgaggccttatccaatcattctatttaaaaatagcaatccctcccccaccacacactgcaacccctttctctatttttcattacagcatttatcaccatctggcatatttattggtcaggcctttcaccttgcacccccactccctgttagttccataagagcaggggtttttgttaatggctaaatcctcagtgctagaatactgactggtgcatatagcatatacttagtaaatatttgttgactgaatgaacaaatgattgaataacctttttgggcctggtatatttcttgatgctttatatatatttgtttacttttctgcacaacagtcttgcaggatactactattattcccattttatgaatggggaaagttatttgctggccaggcacggcggctcacgcctgtaatcccagcactttgggaggccaaggcaggtgaatcacgaggtcaggagattgagaccatcctggctaacccggtgaaaccctgtctctactaaaaacacaaaaaattagctgggcgtggtggcgggcgcctgtagtcccagctacctgggaggctgagacaggagaatggcatgaacctgggaggtggagcttgcagtaagctgagatcgagccactgcactccaggctgggtgacagagcgagactccatctcaaaaaaaaaaaaagttatttgccaagattgcatggctagaaagtttaaagcctaggtttattctgcttaatacattgtcaagctcaaataaaatgttatagaaagatggcttatggcttataaatattgttgctttgctgctgaatggagtttataaaccacaagcctagaaaccagaagaaagccgaagtctgaatttcctgaactggacattgctcattcactcacttgggagcaagctgatatttgtgactgtgacatacctggaagcctaaaatacacctggaaaaaggcctttgtgtgagttcttcctgtgcaccatttgacccatatttggcttgcatacacagaaagtgaggggggttttatgatgatttggaagtttttctcccctaccaccccagagaaagaccttctttccctagttggggatagtactagtgttactttgggccagttgcttcatgtcacttttctttcctgagttgagtgccagccaaggccagagtgcaaatcattcccaaggtatactggggtatgactttctctttggtatggtgactggggaggccaaggccagagctgatctcaaagtaagatgaaactggggtcagtgatgtctccagggtaaaatgagggtgggttcaagtgccgtcctaatagagctttgtcatttcaaggattctgtcagaaagaaggtgagagagaataaggtctggatccaactccccagctgattgggggtatgggtataacatatctccctcctaagtcccaggtaccagtaactttggggtgagggtcctggtgaagtcctgggcttatgagagacccaggcagaggaagcagaagcagatatattcagtaaggctattctcagtaatatgacagaagtagaatagtaggaggtggaaaaaaagtcatcttatggggctgggcgcagtggctcacgcctgtaatcccagcactttgagaggctgaggcgggcggatcacgaggtcaggagattgagaccatcctggctaacacggtgaaactccgtctctactaaaaatacaaaaaattagcctggtgcggtggtgggcgcctgtgatcccagctacttgggaggctgaggcaggagaatggcatgatcctggcactgcactccagcctgggtgacagagcgagactccatctcaaagaaaaaaaaaaaagaaaaaaaaagtcatcttgtggtattatatggtcaataacatatgtaaagaagagtgaataatgaggtatggattagaatggcacccagagggaaatgagactggaatcagagccgttccgaggaaataatgaaaatatgagaactttccctagggtgagataagtctgtgggaaatgtgtatgaggtgacaaaatcattcccagggtgaaagaaaaaaatatgtttgagcagccatgagtaggaagggaagcataatgagagggaagaattttagggcaagatgtttaggagataaggctagggaaacaagcagatgccagattatagagagccttgtctatctgttaaggatttgcgactatattctttgggcaatgcagaaccactgaaaaatttaaaataagggatagacatggtcaaatttcctcctggtcataatgacctgtgttcctaggggagctgaggtcaggaaaggttagaaaagagtatggcagtttagggactctaggcagatgtttattgaaagccaaaagtatctggcgtatccatctgagcagagatgccagaggactggatgaaacctgacctgagtgaagtaagcagaggctttcctggacctcatcaaaaactaaggtccagctgggcatggtggcacctgcttgcagtcccagctactcaggagctgaggtgggaagattgcttgagtttaggagttcaagaccagcctaggcaacatacgacaccctgtctcttaaaacaaaaaaatttagaactaaaaacctctgtggatgcacaacactataaatgtactaaataccactgaattgttcacttaaaaatggtgaatgttatatgaatttcacctcaataaaagattaaaactaaaaacaggccgggcgaggtggctcatgcctgtaatgccagtactttgggaggccgaagtgggcggattacaagatcaggagttcgagaccagcctgaccaacatggtgaaacccctgtctctactaaaaaaaaaaaaaaaaaaatatccgggcgtggtggtgcctgcctataatcccagctactcaggaggctgaggcaggagaatcgcttgaatccaggaggcgaaggttgcaatgagctgaaatcgcaccaccgcactccagcctgggcaacagagcgagacaaacagacaaacaaacaaacaagaaaactgaaaacaaactaacaaatctacaagtctcatcctgctggagtctgtgggatttggcctggatttgccttccttctgtaagggcttggtttatcagtggtagcattggggagataaggataggactaggcatagcagcaaggatgagactccaaagcatgtgtccttgtccatccttccagttggctgccagaatcttctaacaagtcaatctaactgtggcccacctctgctcagaagtctattgctttcctatttctcagagattctaaaatccaagcttctcaatctggtgttcctggcattctatgatctgggttctgcatattgtcttttcagcaaacatttttctatgctattattcatgttttccattttgcttggaatgtctccttaccatctttttaaaattgtttttgtttttttgagacagggtctcactctgttgcccaggctgcagagctcaacctcctgagctcaagtgatcctcccacctaaccctcttgagtagctcggactacaggcatataccaccatgcccggctaactttaaaattttttttgtagagacggggtctccttctgttgctcaagctgctctcaaactcctgggttcaagtgatcctcctgtcttggcctcccacagtgttgggtgtgagccaccacccctggcttgcttactcttttctatctagtaaactcctcatcttttagtacatagctccagtgtcaccactttttaagctttctctgtcctccttgcctgtaggcaggcagtctattctactgttactctcctatcatactttatatgtctcagttatcttgctgcattgtggttgctttgtatgtgattgccacacaagattggaagttttttaaagacagaaacactgctttgctgttgttgttgttgttgttttctataccacttggcctagtattgcacagagatagcacttactgattttttagagcaacttttatttccaccataaatactggtcacagaagttaaataagtaggctttgttggtattgttcagtctagtgaggctaatagggggcatctatccataactgtccttccattcccttctcctttcccttctccctaaccttctcccctcccatcccctctcctcccctcccttctcccctcccctctcctcctttctcccctcccctcccttctcccctaccttctcccctcccttctcccctcccctcccttatcccctcccttctctccttccctcccctcccctctcttcccctctcttctctctttctttttttccaagctagccatcaggtttcactgaacaataactgcaaacttcagtatagctgggtttgggaataaatttttttttttgagacggagtttcactttggtgcccaggctgtagtgcaatggtgcgatctcagctcactgcaacctccgcctcccagattcaagtgattctcctacctcagcctcccaagtagctgggattacaggtacccaccatgatgtccaactaattttttgtatttttagtagagatggggtttcgccatgttggccaggctgttcttgaactcctgacctcaagtgatccacccgccttggcctcccaaagtgttgggattacaggtgtgagccaccgtgtgcagccaaatcatttgtttaataagacaaaatataaaaaaaactgaggtaatatgaaagagattcttagatgcctttgccaatgtgggctctctcattctttatttaatgatagaacacctgagttttagcaggatgcatagctgctcagcttcctttgcaactaagtgtggccacatgtgtcagttctatctggggggtgaggatccaagtggaaatcttatgtgtaccacttctatatcatgtacttaaaaacagtatgtggtgcttctctttccctttttcccttcctgctagctggaatatggtgagatctacagcaccttttttggtcccagagatggaagcctcattttgagtgagaatggcaaagtcccactctcatttgagactgctcactgcttaactattatgagagagaaataaactttttgtttaatccactgtatttgagggtctcttagttacagcagctttatctgtatcctgaccagtacagtgaggcatcaaattgctgcagtatcaagttgcttttttttttcttttcttaggacagggtcttgctgtcgcccaggctgcaatgcagtggtgtcatcaccactcactgcagccttgatccctgggactcaagtgatcctcctacctcagcctcctgagtagctgggaccacagatgggcactaccatgcctggctatttttttttttctttctagaaatgaggtctcacgatgttacccaggccagtcttgaacacttgggctcaagtgatcctcccgcttcagccttccaaagtgctggagttacagggatcaaccactgtgcccagtttaagttgcttcttgctgctgttcatgggtatctcttagtcacactatgcaccgggttcctgactgtttcttgccatgccttgcttctaagccttaattcctgatgcctggatgattccctgaactctctcatatacttaaagacattttattgaggtgaaattcatagaacattaaccatttcgaattaaacaattcagtagcatttagtacattcacaatgttgtacagccaccacttctatctagcaccaaaacatttctgtcattccaaaggaaaaccccttacctattaagcagtttctccctattttccgctcccgctggcagccaccaataggatttacctattttggatatttcatatcaatgaaatcatataatatgtgaccttttgtatctggcttcttagaataatattttggagcttaatctacgttgtaacgtgtcggtactttctttttttattattttttttggtggtaaaatatatataaccaaattttgtcattttattcattgataagtatacaatttaattacagtaattacactcacagtattgtgcaactttcaccactattttaaaacatttttcatcatcccaaacagaaactttgtacttattaagcaataactccccattcctccctcctgctagcctttgttaacttccagtctactttttgtcttcgtgaatttgcctattctagatatttaattaagtggaatcatataatgtttgtctttttacgtcttgcttatttcacttagcataatgttttcaaggtccatctatgttgcaacatgcatcagaaaacttcattttttttttttactggctgaattatgtgtatatatacataccacaatttgtttattcatctgttgatgaatatttagactgctatgctatggacatgctagttacatgtacttgttccagtacctgttttcaatttttttatattttttgagacggagtctcactctgtcgccaggctggagtacagtggcgcagtctcagctcactgcaatctctgcctcttgggttcaaacaattctcctgtctcagcctcccgagtagctggaattacaggtgtgcaccgccacgcccggctgatttttgtatttttagtggagatggggtttcaccatattggccaggatggtctcaatctcctgacctcgtgatccgcccgcctcggcctcccaaagtgctgggactacaggcgtgagctaccgcccctggcctgttttcaatttttgggagtgtatcataggagtggaattgtagaattgtatggtagctttatgtttaagtttttgaggaaccaccaaactgttttccatagcagctataccattttacattcccatcagcagtgtataaggggttccaatttttccacatctttgccagtacttcttttttttttcctttttggttttgtttttaattacaaccatcctagtgggtgtgacatgttatctcgttgtggtttgatttgtgtttccctagtgactaatgatgttgatcatcttctcatgtgcttattggccatttgtatgtcttctttggagaatgtgtatttaagtcctttgtccatttaaaattaggttgttttttgttgttgagttatgaaaattccttatatattctgaatactagacccttaatgagatgtatgatttgcaaatattttctcccattctataggttgatttttcactttcttgataatgtcttttgatacactgtagctttaaatttatttttattttttagagacgagattttgctatgttgcccaggtgcatctcgaattcccgggctcaagcaatacacctgcctcagccttgcagagtgttgggattaataggcctgagccactgtatccagtctagtttttaatttttttttttttttgagacggagccttgctctgtcgcccaggctggagtgcagtggtgccatctcggctcactgcaagctccgcctcccgggttcacgccattctcctgcctcagactcccgagtagctgggactacaggcgcccaccaacacgcctggctaattttttgtatttttagtagagacggggtttcacggtgttagccaggatggtctcgatctcctgaccttgtgatccacatgcctcagcctcccaaagtgctgggattataggcatgagccaccgtgcccggcctagtttttaatttttataggttttaatttatcttttgttgttgttgtttgtgcttttgtgttgtatctaaaaaagtttgaccagcatggtggctcacatgtgtaatcccagaactttgggaggctgaggtgggcagatcacttcaggtcaggagtttgggaccagcctggccaacatggcaaaactctgtctctactaaaaatacaaaaagaattagccaggtttcgtgctgcatgcctgtaatcccagctacttgggagctgaggcaggagagtcactttaacccaggaagcagaggttgcagtgagctgagattgtgccactgcactccagcctgggcccacagggtgatacatctcaaaataaataagtaaataaataagattaaaaaataaaaaatctgttttcaaagccaaggttatgaagatttactcctcagttttatgggtttgctcctatgttttacctcaaagagttttatggtttagcacttatatttaggtcattgatccactttgagttaacttttgggtgtagtgtgaatttcttgaactttaaacccttgaatgtgtgccaatccagtcagtaatgtttttttttttttaattgagacagagtctcgctttgttgcccaggctggagtgcagtggcgtgatcttggctcactgccaacctctgccacctgggttcaagcgattctcctgtctcagcctcctgagtagctaggactacaagcatgtgccaccacacccaatttttttttttttttttttgacgaagtctcactcttgtcccccagggtggagtgtaaatggggtgatctcggctcactgcaacctctgcctcctgggttcaagtgattctcctgcctcagcctcccgagtagctgggattacaggtgcctgccaccacacccagctaatttttgtatttttagtagagatggggtttcactgtgttgaccaggctggtctggaactcttgacctcaggtgatctgcctgcctcagcctcccaaagtgctgggattacaggtgtgagccactgcgcccggccatttttttgtatttttagtagagacggggtttcgccatgttggccaggctgttctcgaactcctgacctcaggtgatctgtccaccttggcctcccaaagtgctgggattacaggcgtgagccaccactcccagccagtaatgatttttaaatctttaaatcccaatagctatggaaaggtggtttggcaatgttttagtggctgttggctgaagcttctttcaataggggcattttagaagacatttcctcctcctcggatctgatccactgatgtgcatttgataggtttaggggcaactttgagagtaaggccagtgactttcagggatgccagtcagttgagtgacacacccttatgtacgcgtagtgagatgctctgctattggcttgtctgtatctcagcctgtgaggagcagggtgaggcctaattgaaacaaggcacagctggcaggggtgaggggaacaatgtagtcaggtagcaagtctgtactgagcccaggcaggttcccagccctgggtatggcttcctgagaactgtgcaaaaacagtaatgattagtgagaagatcatatggagacagaggccttgatttcaagttggatgacttaagactcgtcacttctctctgaaccttaatgtctttgattacaaaaggtgaatgctgacttcacagggtttctgtttttttttttttttttgagacagggtctggctctgtcggccaggctggagtgcagtgacacgatcttggttcactgcaacctttacctcctgggttcaaacgatcctcccacctcagcttctcaagtagctgggactacaggcgcatgccaccatgtctggataatttttgcattttttgtagagacaggattttgccatgttgcccaggctggtgttgaactcctggactcaaacgatcacctgccttggcctctcaaagtgttgggactgcaggtgtgagccaccgtacccagccttgttttgtttttgaagatgagctgaggttatcagtggaaaagtgatttggaaaccataaaatgagatttgggaatgtaatagagaatcaaggcgaagactaagttttctgggagtttttaaaaagattctttcgtgactgtgattctcagaaaaggtttgaggcttactgactagatagttgattttcaattttttattcaaataattttgcatttgttgtgactctttcttttgcaggtgacggaaatacaattcagacagacttaaccaagagagggactttattgactgagtaactagaaagcctagaagtagttctacttttagacacagctagacacagggaggtaaattatgtcattaggactcactctctccccctttggctctgcttttctttgtactggtgtcattcttaggcaggctttctcccatgtagtggcaaagaaagatatcagatttgggtatgcatcctaacagcttattgaaagatacaacaggcctggcatgttggttcaagcctataattctagcattttgggaggccaaggcaggtggatcacttgagcccaggagtttgagaccagcctgggtaacatgaggaaatcgcatctctacaaaaaatacaaaaattagctgggcgtggtggcttgtacctgtagtcctagctactcaggagacttgtacctgtagtcctagctactcaggagactgagcttgagcctgggaggtcaaggctgcagtgagccaagatcagaccactgcactccagcctgggagacagtcagacactgtctcaaaaaaaaaaagaaagaaagaaagaaagaaagaaagatacaacataatacctctctttcctgatggtgctggtggtcctgggtatgattttggcttgggtcctatgcccatcctaaagtaatcactgtggccaggagaatactggcctttaattggccaacagagttccattctactcatggaacccaggggtcagggtcagcttccctggaaccatgtggatcgagaacaggaaagaggtggttccttaagggaagaagatcaaggtacatttacagaaaggtaggtttgggaggtagggaaatagttttaagtcaacaaaattcgtagatgtttactacataattaagccatttttgttaaaaaaagtgtgtttccaatatttaaaactcaacaaaagtagaattctacttgaagtagatattgccaggagacttggacaggggagggaaggagaggaggagtctatagagcataatttgaaaactgctagacagtttatccattaaatatttgcttgaggtgggatagtgcttgaatcctttctttgcatctttctgacattttataatagagattgtattttccttctaatcagggagagggaggtaagtagcagagccagtcattgtctggggctgaagatgccaaggacttttcttagccccaacaccaaactgtgtttttttgagatggagtttcgctcttactgcccaggctggagtgcaatggtgcgatctcggcttactgcaacctctgcctcccgggttcaagtgattctcctgcctcagcctcccgagtagctgggattacaggcatgcgccaccatgtccagctaattttgtatttttagtagagacggggtttcaccatcttggccaggctggtctcgaactcctgacctcaggtgatccacctgcctctgcctcccaaagtgctgggattacaggtgtgagccaccatgcccagcctgaaactgagttttttttttagaagccatgagtctttcaaatttaaatagtgactcatagagaacaggaagaagttgctttataatgtgttggttaatgtaagtgatgaaatatattcgtatcctaagcatttggcaggggctctatatggtacggtgtataaagctgtgagctggatggattctgtattataaattgagtgaggatgaaagctgccctcacgtactatccagtttaccaggcagccaacaaccattcgattttttaaaaaattgaagtaaaaatcacataacagtttggtggtggtacaggcctgtaatccctgctacttgggatgctgaagtgggaggatccctttagtccaagggttcaagaccagcctggacaacatagcaagaatcagtctgcacaaaaaattaaaaaattagtctggcatggtggcatgcccctttagccctttctactcaggaggctaaggtgagaggattgcttgaacccaggagtttgaggctgcagtaagctatgattgcgccagtgtactctagcctgagtagcagagcaagacccctgtttcttaaaaaaaaaattcacattccataaaacttattattttgaagtgtacaattttttttttttggtagagatggggtcttgccatattacccagactggtttcaaagtcctgccttcaagcagtctttctgcctcagcctcctaaagtgctgtgattacaggcatgagtcattgtgccccgcccaatttggtggttttcaacaattttgtgtaaccgttaccactatctaatttcagaacattttcatcaccctaaaaagaaacactgcacccattaagcagtcacactccctattctctatcctctggcaatcattagtctactttctgtctccatgaatttgcctattctgaacatttcatataaatggaatcatgtctggtttctttcacttagtatgattttaatatatatatttatcttgttacttttctgtgatactttttttgaagtagaattatcccacagacctaccaactggtcattttctctgtccccaagtgtataattgggattgacaaactcagcagttaaagatagcacccatactggatacttgacctgttgaataagaggtgtcatagtgggaaggctaagtggaagccttggaaactaccttctgctctcctggccaagatagtgaaccaaacccaataacaccttctgggacagatggtggagagtagtgctaccctgaagtatctttttttttttattttttttaattttttttttgagatggagccttgttctgtttcccaggctggagtgaaatggtgcagtcttggctcactacagcctccaccttctgggttcaagtgattctcctgcctcagcctcccaagtagctggcattataggcacccgccactacgcatggctaatttttgtatttttagtagagacggggtttcaccatgttgaccaggctggttttgaactcctgacctcaggtaatctgcccaccttggcttcccaaagtgctgggattacagacgtgagccactgcacccgacctacccttaagtatcttaagatgcaaggtggtggtctctatcctatctatatttaattcattagtctgcccctgtaaaactggattgatcagagaatgactggacttcagtaattttgatttagcatccccaaatgtggctgccatgatggatttgatatctttgctagagcaggttatacttcgatatttggccattgatttggcaaacgcattattttctgtttcagtcagaaaaaaggattaaaaactatttgtattcatggggaacatatcagtattcctttatagttttgcctagggatatgtaaacacttctactcttatactgtttgtcataatatagtcaaaagatacctggaccatctggccatagaacatcaccatgatatattacgttgacaacatcatgctaaccagacagcattagcacactggaggccttggtaagatgtgtgtgctccacagtgggtactgtcacattctttgccaaactggatatacttggttttaaaatatgtccacaaattctttgatactctttccatcaaggggtggagtctaattcctctccccttgagctggacctcactttctattctaacaaatagaataaagtgaacatgatagtgtacaacttcagaaatcaggtcataaaaggcactacagtttcctttttgctttctctctgtctcttaaattattcactctgcggaagtcccatcaatatattgtgaggacactcaagaagcatatggaaaaggccatgtggagaactagtgtttcctgacaacaatcagcatggacttgctgggaatgtgagtgagccaccatgaaagcaaatcctccagccccagtcaaaccatcagatggctattggccttttaaaacctaagagaccagagccatagccactcagttaagccacttccttgattcgtaaccctcagaaactgtatgaaataatgtttattgttttaagcaactaaattttgggggtaatttgttatgcaattatagatattaatatacattcctacaagcagaatatgagaattctagttgtctgaccttcttttcaacatctagtatttcccttttttattttagccattctagtgagtgctaacaccactgttatcacattgtggtttaatttgtttttccccagtgactaatgtatagagcatcttttgacatatgtatgaatatctatatagacatatagatatgtatatgtgtatttaatatctggatttattattttggtgattatctggattttattatttgttcaagcctttttgcccagttttccattgggctatctttttcttactgatttgtaggcgttctttatgtatgctggatataagtcctttgtcttatatgtgtattatgaatatcttttctcagtttatcaaccttttcctccatgtgtccttatccctttttgtgccctgtaagaaatctggcctcctgggatcccatctggaaagtgcttagtattctgcctgcttcacaaagggagggaaagcaaacgtggtgaggcaccctttccattccagcttgctcggtagctggtgattggaagacactctgtgacagcgttcagtccctgggcaggaaaacctcctttaaggattcttcttccttaactgggtctgcttctttcctaaagaaaaaaaaaatgagtaataaaaaaaaaaataactctttgcaggccaggtgcggtggctcatgcctgtattcccagcactttgggaggctgaggcgggcggatcacctgaggtcaggagatcgagaccatcctggttaacatggtgaaaccccatctctactaaaaatacaaaaaattagccaggcatggtagcgggcgcctgtggtcccagctactcgggaggctgaggcaggagaatggtgtgaacccgggaggcggagcttgcagtgagcagagatcggcgccactgcactccagcctgggagacagagcgagactccgtctcaaaaaaaaaaaaaaaacaaacactctttgcctattccaagttcataatgatttccccataattttttttatctaaaagttttattgtttcacctttcccgttagatctgcaatccatctgaaattgatatttttgtgtatggtgtgaagtaatgattctaggtacatttttttccttctgtgtataaccaattgatccaacaccatttattgaaaagatcattcctgggccgagcgcagtggctcatggctgtaatcccagcactatgggaggttgaagcaggtggatcacttgaggccaggagtttgagaccagcctgggcaacatgatgaaactctgtctctactaaaaatacaaaaatcatctgtgcatggtggtgtacgcctgtaatcccagctacttgggaggctgaggcatgagaattgcttgaagctgggaggcggaggttgcagtgggctgagatcgtgccactgtactccagcccaggcgacagagtgagaccctatctcaaaaaaaaaaaaaaaaaggtcattctttcctactgtaccataagtgttacctttctcataaggcagatatttgtgggtctgtttccacactctctattctaattgtcatttttgtatcctgcagtagtaccacactgtgctaatttttattttaattattcttgatatttggaagtttaagtttatcaggttgttgttcttcagcagtgcttggctgtccttggtatttctatgtgaattttagaactggtttgtcaacttctgctaagaaaaacccctgttgggattttgattggctttgcattaaatctatagattgggagaactgacaaactatatgtagtctttcaactcatgaacatgatatgttcttccatttattcagtttatttatttatttatttattttttaaattagagtcagggtctcactatgttgcccaggctggtcttgaacttctgggctcaagtgattttcctgccacaggcttgagccaccatgcctggcctatttagaactttaaaattatttttttttttctgtaagtctgtaagttgtcttgtagtggtcttatatatctttttttttcttttctttttttttttttgagatggagtctccctctgtcacccagtctggagtgcagtggcgcaatctcggctcactgcaagctctgcctcccgggttcacaccattctcctgcctcagccttccaagtagctgggactacaggcgcccaccaccacgcccggctaattttttgtatttttagcagaggcggggtttcaccatgttagctaggatggtctcgatctcctgacctcgtgatccacctgccttggtctcccaaagtgctgagattacaggcgtgagccactgtgcctggctttatatatcttttattagtttttttcccccctaagtatttgatgtatttttgatgcaatagtcaatagtattactgtattttaaaggtcttatttttataaaataaacaatttcaatgaagccttgtagtactcaacacttccagctttaatttctttgctgtaatagcttgcttatgaacaattcaggaaagaatttcatgtgcagtgctatttctttaatcttacccataatccttttaaaattccagttgaagcagctactttttcgtggttacacttaagtatttttaaaataaaactttattttctatcattttaaaaaaatcttatttcaactaagaaagtcttatgctatggaggatatttcttctcttgtacatttttcctttactgtcccttgaaagacagttccttttttatttcagaatttaacagaacatagcaaatacccttaactggcacatgaaagaaaacttgtatcttactttctagaaaatacctcatgctccataatttataataatatttgtttttcaaatcttaaacaatatttaatatatattttctaacagtatttgctgacaaaggaatgcagttttaaaaatattgctttccagctggctgcggtggctcacgcctgtaatcccagcactttgggaggccgatgcaggtggatcacaaggtcaatagatcgaaaccatcctggccaacatggtgacaccctgtctctacaaaaactataaaaattagctgggcatggtggcgcacgcctgtagtcccagctactcaggaggctgatgcaggagaatcgcttaaacctgggaggcggaggtttcagtaagccaagattgtgccactgcactccagcctggcgacagagtgagactccatctcaaaacaaacaaacaaacaatacaaacaaaatattgctttctttgtactatttaatccactttattactgcaataagaaagaataaatgttttaccaataatatgttcctgtttttcattattaagcaggacatgtataaagagacttcttagcactggattgaatatctttggactttaaacactacagaaaaattataaaagtttatcttcagatataatttttagatggtttttaatcatgatagctttattttatcattatttaatataatggtcaacaaattatgcctgcttgtataaataaagttttattggaacaaagccacattcatttgattaatgtaatcaataacaatgtaatgtaattgtggctacttttaaactacagtggcagagttaattagttataatagaggctgtaaaatattaactgtctggccctttacatgaaatgttttgctgacatctgatttaatatatcaggcccggtaaagatttagtttattgttaataataaatttaaatccatacagtattctaagtatcttttgataattttgaatttttttgccaacttattgtttgaaccaattagattgttttcgtcctgtaatatagctctcagagagctcatattaggtatagaagggtcagctttgttacttgctatttatttttgtttgtaattttaatattatctttaacctatgggggttgtttttcatattcatttatttatttgcaaacatcccttaagatcatttgtgtggtaaagtttgatttagttgagaaaaaaatataaaccataatttataagtaccctgaaagcaaatgagtgactgcagatactgatgttcttccttgcacactggggagctcccatctctattctcaggaaaactcatatgtggtaagcgataccgaaatacatgacatacagacccagagagggcaccattgttagtcagtacagttaacattggtaaagcataattcttatattttaagattaaaaacaattataaaataagagttttaatttttctttttgtgcttcactggaaagtcttatgcattccactttggagaccactgtcttaatacatactgtttgtgtaaattctttcaaattctgaatgtaggcataatccctgaatataaataaaagtttgtagtatcataataattgagctttaagtccagcaaatactttgtgtggatagtactgccagcagctgcaattagagaatctgtgggctaagcaaagccttactcagatgctttatctgtttttatcctgtgtggacagtcatctctcttccaatagaattttgtatctgcagctaattaaatcaagaatttaaccttaggatggaggatagaggactatgtcttcctgccaataggtaacccaccagaaccactccagtgaggagagctaccaccttagaggcctcaataggtagggatttactttagggagttgacagatgcttaagtatggagtcatacagtctgggctcaaattctgggctcctcctattataagctgtgtattcctaggcaagttcatttaaccactttgtgtctcagtttcctcttatgttaaatagggagaatggcatctaacttttaaggttgctatgaaaaattagttaatccatattaagtgcttggcatactatctagcacatatgaagagctcaatgaatgttaatttttagttaactttctggcggttcagatttggtcagttcacagttcactgagaatatttatctttgagcagactcatattaacctttatttatctttgagcagacttatattaagttcttataaaactacaatgccaatttttaagtctacctcaggaagtagaactgtcacatatactggatgccctatgttgttaatgacctgtacattttctacctctggatggcaccatggaacacaaacatcctaatcacgaaggttatattgaacatagggtctgaattagggacattcattaggtgaatccagtgttttgtgtataatgccaaagtggctgaagtgaatatttattaccctttcctgtgtttaaggaatttctttacctaaaatgccagctacttacttgtaacctttttcgcagtttgccctaggctcttttggtcttagccactcatcatggactttgactctgaagagctgtgatgcaaagaagcagggtgcagtgatggtggtgcaggtagcaaattgagttcctggggcagcagggccggttatattacagtggctagagatagtggaggttggcagtggaagcagaggcatcctgatcagattagttctgctacttagttttaggcgttgttctcggcatcaatccctggtttttcacttctccttgtaagtctgagttactcttttgataagttctttttctcctcaaactagccaaaatcagctgggttgctaaatttgcaatctaagttgttcttgcaactaagaaccctgtggatatagcagctacaatagcctgatgcatttgtcttgcaatacagatagaaaggtcatgggaaagcaaatgaagtatttaaactttgttggcttcttctccccttgtgggtgttaagatcaccctattcccagggcctagatttgtgcctgaaataaagtaagtgcttagtaaaccttttgtggaatgaaagaatgatgggtactgccaatatgtgtctgttactctgctttttctcagctttcatggttgactgatctccctaaggaaggacatattttttctttcgatatgttaatacagatgtaatcctgcgtaacagtccattttttttttttttttgagacagagtctcactttgtcgcccaggctggagtgcagtggtgcaatctcggctcagtgcaacctctgccactcaggttcacgtgattctcctgcttcagcctcctgagtagctgggactgcaggtgtgtgccaccacacccagttaattttttgtatttttagtggagacgaagtttcaccgtgttggccaggctggtcttgaactcctgacctcaggtgatccacccacctcggcctcccaaagtgctgggattacagatgtgagccacaacgctcggctgctattctgttttttaaactcacttggcgtatctttattctgtggattttgtagtttagcccggggatgtgtgtgtgtgtgcgcgtgtgtgcatgtgtatgcatcttatagagccccagaatgctgacaggaatcccttcctggtgtcacaaggcagtctaacatctttcctgggattctggaaggcatctcttgagtcttcctcaaggggcttgttgatggagtaaagaaaagaccatacacccacagaaaatttcatacattcatacacaaatgtagaactgtatttaaaccttctatctgccacctaacaactttatgattcttgttaaattttcttttctttttctttttcctcgagacagactctcactcactctgtagcccaggctggagcacattggagcaatctcggctcactgcagcctccgcctactgggttcaagcaattctcctgcctcagcctcccaaaaagtagctgggattacaggtgcgtgccacaacgcccaggacagggtttcaccatgttggccaggttggtctcgaactcctgatctcaagtgatctgctcgcctcagcctcccaaagtgctgggattacaggcatacatctggccgatgattcttgttaaattttctacagatgtcctgctttgcttttcctatgatggtatgctaagattgggaaaggcaggagatacaggtccttttttacttcctttttatgttaaagcaggtgaacttctgctctagatttgtgtgttaaggagctgtgggaactggcagttagtaccccacattctggttccatgaagtcatttgcttgcatttacggagccccttgctgtatgctatgagataatggcattctgaggctggaggtgccaggattttgagagattggaatggcttgttgccagtttattattgcctctctcctggtggagtggctgaagctagtgccaagggtagtacacctgggatccctgtctttttgtttctagaacacagtgctttagacttgggcttataaatcagagctgggactttgagaagatttgtgagcaagttcatcaagatattggggtcatctggcctagtcttcttgagtttcacatgtagaaacaagcctagagaatactgtaacacaaagttagaagggttgaggagggcgagggaagggtcaacaccttaccgctgatcgctttgctttactcctgcattttttgttcagagtggaccccgttctgcaatcgttggtctgaaattcaacccagtcctaaattgcatgtctcgggccacaggttaccaagtttacagacaacagtcctgtgcctctctggacacgtgactggtctattaatagatctgaagttctgggagagcctcagctcttcccccacctttctacttccagcagcctgcttgctggtaatttcttcagtgcccggacaactggacagagaatggaaacagggcaatctgcccatccccttttaggaggtaatgcaggcccaggtgtatatatatgagtagcctctggcctcatgggtgtctgtgctgcatcaggtcaagtggaaatgcttagcatttaggaggaagtaattccagtttgccctggatgggattgaaaaaaaacccaaacatgtatttgaccttcactatatgtaaggcactgtactaggcactttgcatgtgtttaccacaatcttccctgaaccttgtgagatagatattctcattttacagaggagatgactaaaactcaggaagattgacttagtaacctaatgttacacagctggcaagactaaaatccaggccttctgactttgtctttcgaaaatgacagcttccctgtttataactttctatagtaaaattgggctaggataatttaaccatgctatctttggggacacttgtattattgaattatctcatatagctcaggaaaatgggggcaaacatgaagggaggggaataaggcctatcaggctgtgggcaacaaagggagctcagtgtagcaggatggtgcctactgtacaggtccatgtgaccttagtgaacccaagtcagatagtggctgtcctgcaggttaatcaaccatatttcttagcttggcgtacaaggcattcagaattagggttcctgcttcatcccattttatctcttcctacttcctatcatacaaattgtttttcattctattgtttgccagatctgctgtcatcttccatgcatgggcatttggaggctctattaaggttctagtaaaaaagtaactgtggctaccttagggccgagcagacagttttgaatctccatttactccagaatcattttgggctggagctctgtcattcattcatgtattcaatcattcttttaacatacaggacactgcctctctgccaggtactgtactaggccctgctaatcagaataatgaacaagatagatatggttcctgctctcctagagcttgcagtgtagtagggaaggcaaaaatgaacaaaataatcataatgaagtctgatgaatgtcatgaagtgcaaataagggatgtgatgggagggtgcatatatcagaggaacttaatattgtttagggtgttaggaaagacctgacattagctgaggaggtgacatttaagttggatctgaaaattgagagaaaataagtaagggttaagaaaggtaatgctaggcagctggaagagtatgcaaaggcttacaggccaggcaataaggataaagccatgtccatgtcagttcatttattcagcaatcatttacaactgctgggttatatcatgcagtgtgctaggttctgggaacataaaaaacaataagacgtggtccttacctgccctggataaactcagtaaggagtagtgatgtcactccttggtaaccagggtgctaagttcaccctagatcttggactcagttttttgggtcccatgtgataggacttaacacctttagaaaaactgcctgcccttgagtgtttggtccatctgtcaagccgacaggacatggacctcagatgaaaacctgcagtgttcttatccctggcttcacacttaccagatccatgataaatggggatctgctatagactgaatgtttgtgtccctctacatttcatacattaaaatcctaacccctaatgtgatggtattaggaggttgtagggtaaatggacctgagagcaataacaagcattcccttagaatgacactgtatggcagacacacctgaatgcatgttccaagctagggaatctgggagtggccaatccagagatttcgttccttttctataagtaatatctgagccctagcctaccctgtggaacacgggccatacaggggattgaggccctgggttttgagttgaatgaaggctgccagatgaggccattaagaggagggtgttaagtgaaaatgctatgtaaattgcacgctgtttacaagcggttgcgattttcctgcccggcctgttgctcctgggctgtgtggttttcctgtccagcctgctgcgactggactgtatgtaaggcagataccttgttcagcccgccactactggaccatatctgtacataaggcagttctcttgtccagcccaccaccactggactctcttccgtgtatgtaagcccctaataaaaccctgtgtcttgtttgctggctctaggtctcttctttggcctcttaaacctgctgccttccctatggaagttaacagggtttggtacaacagacacagggcctttggtgggtgattaggtcattaggacagagccctcttgaatggaattagtgcccttagaaaagagaccccagagggctgggtgtggtggctcacgcctgtaatcccagcactttgggaggctgaggcgggtggatcacgaggtcaggagatcgagaccatcagggttaacagagtgaagccccgtctctattaaaattacaaaaaatcagccgggcgtggtggcgggcacctgtagtcccagctacttgggagtctgaggcaggagaatggcatgaatccaggaggtggagcttgcagtaagccgagatcgctccactgcactccagcctgggcaagagtgcaagactctgtctcaaaggaaaaaaaaaaaaaaaaaaaagaaaagaaaagagaccctagagatctctcttgccccttctgcagtgggaggacacagaaaggagacagccatctatgaaccagtaagcgggccctcgccagacactgaatctgctggcaccttggtcttggacttcctagcctctagaattgtgaaaaatgagtttgttgtttaagctgccctgtctatggtatttttgtcatagcagcttgaatggactaagacaggctcctctacagagttgaggttattggggtccagagattggcttttgtccccagtagaaaacatagaaggagctttttggctgaggtgaagttgcctctgttttcagagctttgtgtccttggtgtctcatatttattacaattgatcatgtgttctcacacccatccattgtcttgagtacacctaaggtggtattttagctgtgtttttctggattctgatactgcttatagacaaaagtcttagcggctggctatcttggactgtaaattgcctaagtcctaggtgtgttgttcacatgggctgtgttgtgaatgggaccacgtttccccaattgtgcaacagtgcaacattgtggccctggttaaagggaagggaagttaggttattgaaacatggactgtgtgcctcaggctgtgtgatttgtattctttatttcatttaatactccctgtaatgctctaaagtaagtacttttattctaatttacagatgaggagactgaagtttagtgaactaagtaaacaagtaagtagtggtttggggttagagtttaggtccaactctaaagtccatgtttccctctctcatccagctgtttcccaatgtagttacagacttcagatcttgcatgtcatcttgtttccatggcctctttggccttgtctaccttgacttatttgccttgcctccctgtgtcagtaatctaaggattctcaacatggctgaggctcaggaatatatcctgtttggtagataacctagagtctctctctcttccccgccgcccgccgtctacaatgtatttttgtgtctaatgtgaggcaacattataactataattggagtcatttttaaagagtaagttagctctaaatttggtgggctgcttttcttaatccagttcccacagcattctcaggaagacggaagatggggatggctcattagaaatgagtttgaatgaaaaaggcattggggcttggcttgagtggtggaaagagcctccctcagcctttctaaattgcgtggctactgaagttggttggatctttgtaagttagtacttaatgtcccttttccagggacctaagattctcttttctctctttcccgtagaagccctgcctcatcatctggagattctggagctactgacattagagtggagagacttttttctttcacagagttgtcagggttgtgtacggggtgggagaggggtctgtgtataaggcagaatccagggaatggtggaagaggaagtgtaacatgtttttgtgtcttcaatagcttttcagcactctttttttttttcctcctcttttcttctggagactttgcagtctcatttgagaagtggggtcccaaataaaacaaggctgctacactcacccatcttgtgttccaactctgcttccttttcctgaaggctgacaggctttttcatatcttgagtctttgtaccttctgttccctcatccttgaaggcccagtttgatctcttctctctggaggttgtcatgcccactttgtgcctccatagcactttgtacagccttttatatagtcttattcacttagctgtctgcttcactctccacatcttgaacctcttaagagcaagaggctgagttagtttcacctctctttagcaagcacagggtatgagggagactagagtctcaaaaattgtagaattgaacaattcaattcattacatcagtaccttggtacactgatgcccaaatcaaaagtagatgattgtgtacaactatcttgtgtacttccataaactaaataagtttctcttccataattcactgttttgtgtatctcccaggcccatagcccttcaaacatgcagtgcagtagctgactttgagagagaacagagcacagatgttatctttgcctgctttgcccttcacctcacagtgctcttctaagtccctgggcttgacccaaggaatgagtagggaggaaatgccagaaatgagccacccttggcatcctaactccttggtttgcaggtttggccctgtggggcagtgcaaggtgagcaaatggaaaagaacctgttccctgtaatagcagctgaaagggatctctacagattattactgtcatcttttcgcagctgcagttgcagcaatgagacactcccctcattgcattctgcatctaagacaaaatcaattcatcttttaaattggctctcttggcttgtcctgagatttctcatagggctgagagcctgaaacaagtcatcttacccgtgtttttctaccattgtaaggccaaagactgtgagattgtgtacccttagcccttcattttatacatggggaaactgaggcccaccatgggcataggactagttcaaggttgggtgactagtgtcaggtgaggctagacactggtcttccaactccctgcaaggtgctctcttcattataccctgctgtctctgatatcagtttatgtttgtaatgcctgtagattgtgaagttggtgaggctgaagtaaccaggaaacctggtttcttttctttctgtcaccttcctagtttctggacatcagggcacagtagacattctgggaagacttagtgaaggagtaaataaaaaacaaagttggcccaggaaaactgcatggtctaagccagaagaagactaacgaaagcagattcctcccagtttcactggacatctttggctttgatgatgattcctgtggttcgattttcccagtgttaaatgcaaccttggctggagcgtggaagaagtatggattgtaactatggtattttatctggtgaaaaccaggtctgtaattaaatgtctgtgaaaataccacacctgggctaactgaggatgcctttgagtcttcagatgcctcccttattccctagcagcaatcacaagacagagattgtgtgcatcattgagaactaactacattatacataggtaacatttattgaatgcttactaagttttctggaactttttgaggtatttacaattcttttaatcttcacaatcatccatgagtagttactataattcttttaacttttcaaatggactttattgagatataatttacatataatatactcattttaagtgctcagttcgagttctgacaaatgtagtatatgcctgcgtaacctctcccctacaatcaagatatagaacattttcatcagtaggtacttttgttatccttattctacaaagaggaaaactgaaagacagagaagttaagtgacttgtgtggggccccatggtaatagaaccagcatttgaatccatgctgtgtgactgcagagtccacattcttctgagctgtgctacctttcatctctcaatttgtggtcaagccattgcctctcttgtcctagtggacaagtgcattaaggactaagatgacatagacttacaatctaagcactaggaggggtgttggggagcaagaggcccagagataggcagtggggaggaatgagatagccatctcagtacccctacagttccaggacccaaagaaggcagaacaacgtgccttttgctcagcctttgcttctccaggcctgcaaagaatagggtagactagagagtcttataataaggttaccagtatgatatagtatctgaaaaaaggacggctcctaggctcacataactggaatagaaacatagaaaatgagaagagatgatagtctcatatgttctgagagtgaccttagtagtggctgcagcccattctggacttggcactatagaggcaacatagatagtctggagatggagagtggccttgaaatccaatcctttgaggagaggttgaaggagccaagactggatgccctgaagtgaaaatgtaatcactggcttcatatccttgaaaggctgttctttggcagagaaaaccaacttgtttttctttgtggcttcagaaggggtaattagaacccaatgggtgggatggtgtagagtattttggaaaaattaaagtacagtgaatatgacatatctcatatctcattagcttggagtacaaataagatcagatcttttttcaatattaaaattaatctctgcagctgggtgcagtggaccacgtctgtaatcccatcactttgggaggccgaggagtccaggagttgaagaccagcctgggtgacatggcaaaaccccatctctacaaaaaatacaaaaattagctgggtgtgatggcatgcatctgtagtcctagctacttggaaggctgaggtgggaggaccacctgagcctaggaggcagaagttgcagtgagccgagatgacaccactgcactccattctgggcaacagagcgagacttcatctcaataataataataataataataataataaaatatctggaatgagtgtgaaattatctggaaatttaatatgtttcccttggggctgttcttcttccctctttctctttatgaagtattcaaaaactctaagggcttattcaatccaaaggggtcaggcttagttccaagtagagaactaaagaatcttattggcctgctagcgggccccatttttagcttctgttggtgttgcacagtatggcttttaaaaatggatctttcacagaatgtggtttctgtatttactgtagccacaagaacctgattctccataagtcacagtggttcattgagggaggatgatggcagtccttcaatgtcactcttagtcccagggttcactctgcttgagctctcaaggtgaatgctcaagtttatatgtatataagctcatccactggaggaggaaacctccacaattttccatttggctaagtctagaagtgtttctagcttccaccacattctagctccagaaccttctctcatgatcacttttgttatagagcttgggacatcccttcagcatgagctcttactgttggctgttggtgtccccccctacctttaacttcacctaggatcttgagtctgttagagaaattctttttttttttttttgagatggagtcttgctttgttgcccaggctgcaatgtagtggggcgatcttggctcactgcaacctccgcctcctgggttcaagcgattctcttgcttcagcctcccgagtagctgggtttacaggtgcccaccaccacacccagctaatttatttttgtatttttagtagagacagggttttgccatgttggtcaggctggtctcgaactactgacctcaagtgatccacctgccttggccccccaaagtgctgggattacaggcatgagccaccgcgcccggcctgttagagaaattctaatagcattgaacttcagaagtaaggggagtcaaagtttcagtctctccctaggagagctttagaccctatgcatatttgttttcattttcttcagctttgcataccaaggggtgttgagaacagtctttgccaagtcacaaaatatcctgttgtatccttttccccaagagcaatgtgtgctcatttgctttatgttttatcattaaaacagggctcctcaagagtgagggtctgtcccagaatgatttaatgtttctaaacattaaaagggactgacaggagggactgacagttttaaaatgacagtttaaggctgggcacatggttcacacctgtaatcccagcactttgggaggctgaggtgggcacatcacctgaggtcaggagtttgagaccagcctggccaacatggagaagccctgtctctactaaaaatataaaaatgagcctggtgtggtggcacatacttgtaatcccagctactcagaaggccgaggcaggagaattgcttgaacccgggaggcagaggttgcagtgagccgaggtagcaccactgcgctccagcctgggtgacagggcacgactgtcccaaaaaaagacagtttaagaccatcatccagaatgagcagggttatcattagaagatgtgagaaggggcaagtggccatgcagtctgaaccagtatcttgaaacccctttctcctaggagggactcttactaattttctccactactgccatactagcttcagcaaggtactgttctccctttatgtttggccccaagttgggcaaagaacttttctgtatgacatataactgagccctatataaaatatttagacaagaattttctaaaaactaagggatagcaatagaattgagactagatagactagcttataaaatgctgcttgatctctggggctatcagaggatatacacttagacagtaccatcatgattatctggttatgatggaagagagaggagagaggtgtgacttctaaagatccttctggctctgagattctgtgattcttctaggcttttccaaactgaaaattctagaactgactttgttctgtgattcttgcaaatcttacaggcccaacagtggggtcaggaaagtaggtgactatgacatagttgaggttaccactgatctcatttctgcatttctcccaaccactgcattccacttaggccagagaaatacagatgtaaaatacagccttttaaatgtatgttttaccacaattaaaaaaatacagcttttttatttgtccacaatgttagtctatcctttctcatttgaccctcccaataccttgtgatataggcaagaaagtacttattaagtcattttagagatgaagaaattgagattcagagaagttaaataatttacctgtccagattacacactagatcaactggtatcctcagtgctcttaataaatatttgttaaataaatgaatgaatcagaacatagaactaggaacaaggaagattctttgtttccttggccagtatttttctttccctattcttctgagctgcctgggggctttctctgagcaccttttgggttggctgtttttggttgaccttctctttgggattcccttgttctgtagctgaagctgtgtgcactcgttagagatcatcattccagttgtgttccctaaggagtgggaagggaaaaaacactccacccactgtaaatctttttttgttacttgttttctgggatcttcatatcattgctgacaagagtgactcatagacttcactatgtgattttcttggttaagagacctttttccttaactccagaagaaattaattcatggttttgtatggttaaagcacagctatttagtagctttacccagaacacaacagttccgtcttctagtgagcccagacttaccaatttggtttggccaaaactcttgaatgcctagctctgttaggtgctacagaggaagccgttggtgtgaggggaggagaggggctcactcagggtccagttggggagataagacacatacataaatgggaaaatagtttgaggcagtttaaataaaatgcaaaatcaaattgtatacatgtaaatatttaaatgtggggaatagatcataaggggctgagaaggtatagcagaaagagtgtatgctttagaactgtaggccattggcaagttaacataattctctgaactactttttccttttctgtaaaatggggataataacagcagactcacagggttgtgaggaataatgaggtgatgtgtgtaaagcaccaacatagtggctgatgcatcatggtaggcatcgaactattgggaagcagcatacccccatgcactgactgcctcccctacgaccctttcaaggagccatcctggaggacctaaactggaaaggttggttagcatttggagaaagagaaaaggggggatggcaagccatgaatgaaggaacaggtcccacagagaatgtcaatctagggggagtggaggatacatggaagaagcagtggagtaaaattaaagaaacagagaagtttggactttatttaaaagagatgtttttataggaagtgtttttatgccatatgcatatatttatatttatagaaaggcctttcttgtactcttcagtgtagtgtagtagctaagagcttggactctagagccagactgcctgtctctatatgccaccacttagtttacttctctgtgcctcagtttcttgagctgagaaatggagatgttgataatgatacctcatagggttgttgtgaggatgaatgaggtaacaaatataaagtgcttagaatagtacctgacacatgtgaggtgctataatttttattgttattatttaaatgaaacaaaacttttacaaaagagtacatgcctctactaatgaactctgataattaaacagaacaaaaatggtccactgactgagggattgatatctacagttcgaagacttctgctgtaggtaatgaagatccatgaaagtggtaagcaaggtgaggcctgcataaagtgatattaaacaaaacagatctgactgggaggtgcaggatgaattagaggaaagagagttggcaatgggctcttgagatagggtgtgtccatgttaaatcacctaacagtacaaaacatttgttatatttgaaagtaattcttggtagggttaagcagtagatgtgtaggacttgggcagccttgtcaaataacgtgagttctggtgaaaggaatgcagcagtgttgtagcaaatagtattgccatagaagaagcatatatatgtgtgtgtgtgtgtgtgtgtgtgtgtgtatacatatatatatatagagagatagtgtgtgtgtatacatatatatatatatatatatagagagagagagagagagagagagtgtgtgtgtgtctcagtgtcactgtgttgcccaggctagagtgcaatggtatgatcatggctcactgcagtcttgacctcctgggctaaagcaatcctcccacctcagcctcctgagtacctgggactacaggtatgaaccatcacacccagctaattttttatttttgtagagagagggtcttatgttgttgtacagactggtcttgaactcctggagtcaagcagccctcctgcctctgcctccgaaagttctgggattatagtcaggagccaccaagtcctgtctgtacatatttttgagtatataaaatgatcaaaaataggctttaattacatctcaattaaaaaatgttcaaataaaaatagagtgatcactgatgactgtaaaaggcaggaagatctcattagaggaggcagtacttggattgggtttgaaggtagggtagaatttgatcattggtgagcactgcatggaggtaagaatggatatggtgtgtgatcgagttagtagccaaaccaggacttcaacctggtctgtctactccaatgagctgtgcagagaagcactaatggccatataatacctagaccacttatagcaggcagtctcactatgcatagcctccatttcctgggcagagtggtctgaggtgcctggatgacacattttcagcttccttgtaaacttgtaagtcccataagggccaggctgatctggcatttggggtagtgttgagggtgggaaggaaccatagacagttgccctcttccatttggatgtgcctcaggagagttcctgagaacctaccctatccttctttgtagtgctgcctgtgctgtgggcctagagtgggcctagctggaacatgggtttggtgatggaccggtaggtggcagggactactggattttggatttcctctcaatgaactgtggtttcgtatgggttgtttgctttgctctctgtttatacagcattaaaggacttttatctttatctttggccagctgaaggttaaaacctccaaagtttgcatttgaactggatcatttctcattttggctggctttaagtctcatgtcttaaggccatttgtggtaccagcagacctctttatgaggtaatgtgttcctggttgctttgggggctagtgtgcaaggcaggaagtaagtgtttgagagcaaggtagagaaacctcttgtagagtctcaagctaatgcttagagctttttgagtgcagagtagttaggttctttacagagttagatggactttgcctggaacagacaccccagaaggatgttatcattgttaaagcaaccagggttatatcatttcttttaccccaaggcaactcttctgctaggagcctgggaccctctagtctgctcttagagagcttgccagctgtgtctgtgcatgctcagccttctgccatctagatgttttgtatttcctaaggccaagctctgagggcatcttctttgggaagcctttccttgactcctaggaaagaattagtcaacttgcttccacagaacctggtatatcctgtgattgtagatatttcctagtagaaaatggggactactcacatgataagattgccacatgctatctaaatattacatggccatttaaggagtgcttttctgcatcgttaactggaatagagaaactgggttgaagtcctggtttggctggtaacttgatgacacaccatacctattcttacctccatgcaatgcctcttaattacctgtcttcttcaccagacaataaagactgtaagctggtaaactttttttgttttttcttctggtaaagctattgtgctttaataaaaaaagattattgctcaatataggtttttccaagagagccacagtccagttcacagttaaaaaaaacatcttctaggtcgggtgcagtggctcacgcctgtaaccccagcatgttgggaggccgaggtgggaggatcacttgagcccaggagtttgaggctagcctgggcaacaggagagactctgtctctgcaaaacacaaaaaccaaccaaacaaaaaattatcctagaatagatggaaaatcatactaaggaacaaagacaactttcctttcatttttcctttgcatatcttacacagtcatatcactatgacttaaagaaaacaaattatcacgtatatacacagattcacataagtgacagaagcaaatgtattagtcaaaggatatcttcatctatattgaagtacaagctagaaagtaaacttcttgaaggcagagattttttttttaagttgtgtggctctaccacctaacataggttatgtacagaatagacatcaatagtgaatgaacagatgaattagttaatgagttaatgatggatttttagcacattttctctcttttttaggaacttaagaccccaactgagttgtttagaggaaggggccttaggctggggccaaattctatgtcttctatgcagacgtgagataatgtgaaatgttttccttttacagggtgtttcccctggcttttcagcattcttctcaattctttaattgccatttaaagatttgtatgctgtggatgagctgatggaggggaatgtttccctgaggacatggcttctcatggcagccaaggttttgtgcctgattaactcgctgattgaatcactggcctctggaggcaccaagggagggagcatgagtatatttaagcagccagaactctctgtgcctgtgtagtgggagtggagggggaagtgggatgggagtgatggtaagttgaaaagagaatggtcagagaaatctacagtttttaactcttcatcaatactatgttttggattttccttttgtgacagagtagtctagtagaaagagcacaatttaagtaagagactttcttctgtcaccaactcactgtgccacctaggacaaatcactgccgccatgtgggcctcatttgtcaagtgggatcaggaatctctgctctgcctgactccttgaattgtagtgagcatcggtgagctgttggatgacagagctctgcacagtagaggtgatggtaccctaatcagagcaggagtgtagtgactctggtcatcatcccatcatttcttgctagggttttcctatctctagaggaatcagctactaaagcctagtcctcaatgctcaatttcatctttctgttctttcctgtctttatctagtgactcctcattatataatacgggtgacccagttgtcccagcaaggcccctccatattctctgacttccctctatcacagtactcaccaggctgtcttaccattgtttgtttggaggtagctattaggagtataggctttggagtcaagctgcctgggtttgaatccttacttttacaacttactggctatgtgctcttgagcaagttacttatctctctgtgccttagtttcctatctataaaatgaagagaataatggcaactgcctcactggcagttattgtgagaatttaaataaggcagtatatatggagagtggagactagtgcctggcatatggtaagcattcaaaaatgttgtgtaggctgggcatggtggctcacgcctgtaatcccagcactttgggaggctgaggcgggtggatcacctgcggtcaagagtttgagatcagcctggccaacatggtgaaacacaatctttactaaaaataaaaaaataaaaaaaaaaagaaaagaaaattagctggacatggtggtgcacacctgtaattccagctactcgggaggctgaggtaggagaatcacttgaacccgggaggcggaggttgcagtgagccgagattgcaccactgcactccagcctgggcgacacagtaagactctgtctcaaaaaaaataatgttgtgtattattataataatcattattgcttaacttcttccctgattgaaactctgttaggccagggaccatgtctattttattattatatctatagttcttagcacaggtgtattagccattcttgcattgttataaagaaatacctgaggctgggtaatttataaagaaaagaggtttaattggctcacagttctgcaggctttacaggaagcatggtgctggcaactgcttagcttctagggaagcctcagaaagcttacagtcatggtgaaaggcaaagatggagcagacacttaacatggtaaaagcaagagcaagatagagagtgggtggggagagatgccatacactctaaaccagatcttgtgagaactatcatgaagacagcatcaagccaggagggatccgcccccatgacccacacacctcccaccaggctccacctccggcataggtgagtacaattcaacatgaaatttgggtagggatgaatatcccaactatatcaatggggttggaacagcaggcgctggataggaatttcttgaataatagtatacatttgaatgctgaattttccttatacaatactaattttatgatcatgagcaagagacttgccctctctacaccccagttttcatatctgttaaatgggaatcaaaatatttgtcctgtaggcctgatgtgagaattaaattaatatgaaatgccaggaagtgtgtaaatgtcattcgtctccatacctgttggctgtgtgcatgtggaacccaagaatctgctggttcctatagtacccctatagtgagctaaacccagagatgcttctgaggtgatgttttctggatatttggcctaggacaaagaaagtagcatactttgagattattcttagcatttctggccttttctatctgcctgccctgcttgttcttcgttggattctaggttcctaaaaataaccagaatatttttctgcctcttagttttccaagtgtcttaagcaatcagaagcattttaattttggctcctttaggctggccctgtttggttctgtcattgttagccattaccatatcctgcttatattatgtttcctgacctgctatactttttccagggccaaaacactacccacatcgctccaggtaaataactttatttggctcactctaaccagttgggaagcacagtggcccatgaggttagaagccttgagttccagtgctggctctgccactgtgtgactgtgtgacattgggcatagccctttccctctctgtgtctcaggctgtcatcattaaaatgaatgatttgaaccaactcagtgctttgtaagagtccttaagttctgtatttgagtttggacaaatcacttctcttttgggggggtcttagtttcctcatctgtaaaactaagtatgttggcttgaataatttacaaaggcatatataaacctgaatattttctcctcattcttagtgtttttttttttttttctttctgccttgtattactttctggaacatttctgtgacagttaacagctgtggacaggaaacccttgaacacttctaacttggcaaatgttgctgctcctctgaacctcatcccagcccatttcctgtgtttacagcttttgggttttgcacttagtgacaggcctgacaggtcatattgtagttttctcttcatagcctggtacagggtagaccaaagtgagcaccaatttgagtgtcagaagacagagtttcagtctctgctcagctgtatgaccttatggaagtgacctcccttctcagggttcaatttcctcctctctggagccagaaagttttaacgagggaggctttctggctctgatgttgaatatatgtctcttgtttattactgctgacgggggccctctgtttcacctgttttttccacatactccatcctacaagagacacagcaggctacctttgcatttcctatattggacaaaataagaggaagaaaggaagccaaacagctctcccaggctcagttggcagcagagaggagttgaggtgagaagctggtgtcaccgaattgcccagtaaatcagctgtgtggttggtaaccaggtaggcacctgtatgcatttattcttatcaaggctctggagacagactgtatcctacttccagacctactttcaccatatatgtgaccttggggaagtcacttattgtatctgggcttcagttttctcattttttattgaggataataaaagtactgactttacaaagtttcaaagagacaacgtatgtagaagtgatcaacatagttcctgacatgttcatcctccctttctcccttagacagttaacagtattcttaattctgttcttgtggagaaagcaaaaagacactcaagttccattctagaggagctaacaggccacatgagaacagaatacagttaggtttagaagagctcttatgaggtggtccgttggccagtgtaggctcaatactctgacctcaaaatgggagacttatagggcgcggagtagttaaagaaggcatcccagggccttccctgggccttgaaggttcagaaagtattagacatgaaaagctagagagagaataattctaggtacctatctaccctttctcaagctctggtgctttgttttgtataggtcagtttcccatatatctccctttctcttcttctaggtggttattatccaaggggcttatcttttctttttttaatatataagagaaaaaaattaagggatgaggagaacctaatatttattaagaacaagctagttttacttgaatctgtaggctatgtagtttgcttgcataatcttacttatttagaaaaatacattattatgccgtattttacagatgaaaaaatagtgcctccaaaaggttagacaacttttctagctctacaataacaaattatgatgacaaatcaaaggagccctacgtgagccagtttagaagacatgtataagcaggtgtcagttgtgcttattcattccaagttctcaatctataatagtctggttctttttacacttatcttctaaatacgtctatcttattcctagttccaacctgtactcacctcctgctcttagcagttattcccaatcctctaaatctccagttctaccattaatttagattgtaccttcctgccccaaccttagatcccttaattctcttctcaaatatttaccaagcatctactatatgccaggctagacacgaatgcaaataccaatttctgcttagatatttcagtgtactagttagacaattacaacaaaaataacatggtaataattgaacacttactatgtgccatgctctatttgaagtactttatatgtattaactcatttaattctcacaaccctatgaggtggatactgttttctccttattttacagatagaaatgtaggcatagagaatttaagtaattggtccaaattgtgatacagagaagcacagggactataagagcacagaagagggactcctaatcaaaccccgggggtcagtatagagaaggctcctagagaaattagaaaaagcctgagtagaatcttgaaacctgagtatgaattagtcaggtgcagaatggggcaaggatattgcgggcagagggaacatcatgtacaaagccacaaagtgagccttgcatatttatggaactgaaagtaatttagtatggtgggagtgtagggtatatgtgagctggtgagtggcaggagataaggctagaaaatgctatagagacagcctcttgaaaaagtcttgcatgcttttctaaattatattcattgcaaaggccaagtattcccagtcttggggatttgaatccctgaaaggggtccttgaggggtgtctcatgaatccatattatttcctcagtcatttttcaaccagtggttagtaaaagcacacctatcattacatggagctctttggaattcctcactgaaaaaagttaggcatcactgttaagggagtttgggaaccctgtgaaggattttttaaattaaaatttttattgagatgattatagatttacatggagtcctaagaaataatatggagagatcactggaaaactttgcagtttcctccatggtaacattttggacaagctgtagtatatcatggccaggatattgacattgacattgataaaatccaccaatcttgttcagatttcccagttttacttgtactcatctatgtgtataaagttctattccaacaccacaaagatccttcctattcttttataaccactcccgtctcctttcaaccccattcctcattcctaatctctctctgccttccatttctagaattttatcctttcaaaaatgttacataaatggaatcacagagtatataaccttttggaattggcttctttcttttttttcttttctcagttcagttccttggaaactcatccaagttgtgtgtatcaataggtcattcatttttttttttttttttgagacagagtcttgctctgttgcccaggctggagtggagtggtgcgatctgggctcactgcaacctccacctcctgggttcaagcgattctcctgcctcagcctcctgagtagctgggattacagacatgcaccaccacgcctggctaatttttgtatttttagcagagacggggtttcaccatgttggtcaggctggtcttgaactcctgacctcaagatctgcccgcctcggcctcccaaagtgctgggattataggcatgagccactgtgcctggctgggcattcctttttattgctgagtcatgtaccattgtacataagtactggagtttaaccattcacttgttgaagaatatatgggctgcttccagttttgggtattacaaataaagcttctgtgagcatttatgtacaggtttttgtgtgggcctgtgaaggattttattcagagggctatctagtcagatttgaattttattttatttttttgagagaaggtctcgctctgtcacctgggctggagtgcagtagtacgatcatagtttactgcaacttcaaactgctgggctcaagggatcttcctgcctcagcctcctgagcagctgggactacaagtgcatgacaccatacccagctaatttttaaatttttattttgtagagacaggatcttgctttgttgcccaggctgatcttgaactcctagctcaagtgatcctccgcctcagtctctcaaagtattgggattacaggcatgagccactgtgcctggcccagatttgaattttagaaaaattgtactcactgcttggtagaggatgagtttgaaagaaactagaacagagacagggcgaatagtgaggaaactgttgtaacccaggcaagagatgtagaagcctgaactgctttggcatagaggtatcgccctcagaaatcagatcaggcttgtgcagaggagggagcagggctatggagcctgggctgccaggaggctcaggtagacttcattctggatagtctcctttcagggaggacactctgctaccccagctgagaaaggcatcctgtaaggaagggctgctcttcagctgcaggaagagagtcagaacctggttcctagaatgatcatcttgactgcaacattgtttagtagatgctgttggttatcttctcccaagaaaagacaaagaggggccagttatctttcttttattgtctgagtggagggttatatggggcagaaagataatgagaagctctctcttagttcatgtctcttttggagcccaggaatgtgttctcttttaaccagccagcaagaggcctgggaggtttcagtctgtcctcttgttactatggaaactggaatccacattgtttttaccccatgcagtggtgtgcctggttcctcagtgtttatattttcaaggcgtttatcattgtgcacttagagccgctgtgattgggactgattgttgggaaccagccttactgattgaacccagaagggtataatcttagagggtccactgataggttggacatgccccctaggtgttgtcctttatctgggtaagtccttgggtgcccactccaacactttcagcaaacttttcccagcagaaagccatttgaggtgtctgtaattatttttttggctatctcagaccctgatgagtgctggctagggcacaagaacgtttgggtcaggcgccagtcagataatttggggtagcttttgaacaagtgtgtgttggtttaattcttctggggccgtctttcttcttggaagctttagtatataaagacctgtggtatgtgggactccaaacctgggatagcaaatcttcaaaatcagtatgcacctttcagttgtctctagaccagatattgtgctgcccagcactgggctagacacaggggaataccagaagaatcaaagactctctttgctattgttgggaaggtaagacttcagggccaggctcagtggctcatgcctgtaatcccagcactttgggaggccgaagtggtggattgcttgagcccaggggttcaagaccagactgggcaacatagtgaaacctcatctctacaaaaaatacaaaaattagccgagcacagtggtgcatgcctgtggtctcagctatttgggaggctgagcctgggaggtggaagctgcagtgagccatgatcttgccactgcagtccagcctgggtgacagagtgagaccctgtctcataaataaataaataaataaaataaagtcttccaggttaagcagagagtagaaaactgatggatgaacaactaacatttgtatagagctttactatttttcaaaagacttgactgattttttcaggtaagaacattaatccttaggagtagtcaatgtataggaaagttggaattcaaagacccatatttgctacctctgcaattcaatacatatttcaataattagggattggggaaaaaggggatcctggaggccagagaaatgtgtgttattgtttgatttcccagtgcctttgcctagttcagctagttcagtcatcagcaaaagctgcttgaaagtgttaaataagtgttgaaatgggtattccagcatgtgaacactgatctgggagtcagtcagacactttcaattcagtcaggaaggtcatagaaacaaaagggcaggcaaataggctgtctaccaggagtctgaagccctatgggaaaccaaggagtgggcaaagggtatcataacagttggacagctcctgcatcagaagcccatgttattgaggtcaaggcctgcttggtggtgactagctgtagggattagccattttcttctggaaggaggcttcttgtgagatcaaaatttgaagaaaagaatgcttagaggaggaggaaggtagaaatgggacacagaaggagtagctgagtgcaccctggaggagagatagccagagacttctcttctagaagatgattaggtttagcagaagcatattctttttccctttttgctcctcccagcatggtgtaccagagactcagttcttctctagtgattcttaaactttatatttaagttctaatgagaaagaggtttttggctagtttgtttcaggaggttgaacactaaagaatttaaggcaaagcaaggatgttctattttaccctgtttggggaatggttcaagcccagatggagtttcttgtatttgtcattaatagacaaaaaacccctgatggaagccctgcttcctcaccccacagcccttgctttgttgccttggaaagtaagagttagtaatgccagggagcccggttgcataggctgatccagatcacccaactatagccttgccataggacgtggtataggaagttagtgtggtttctaatctggttctgccacttctttgctggccaacctagggcaaaacaacccattttatggcctcaattttcttctccaggtgttaaaagagcaacggcctttgaggccctccaaatccccttcaattctgccatttagagtctgagtataatatgtgatctcaacatccattattcccattctatgccaggagtttttgcaagatcggtattgacttcttgatcttcttctttcttttttttttttttttgagacagggtcttgctctgttgctgaggctggagtacagtgacatgctcacagctcactgcagtcttgacctcccaggcccaagaaatcctctcatcccagcctccctaatagctggcaccataggtgtgtgccactactcccagctaatttttgtattttttacagagatggagtttccctatattgcccaggctggtcttgaactcccaggctcaggtgatccttagcctcccaaagtgctgggattacaggcataagccaccatgcctggcctgactttctgatcttttaataagtcaagttgtgtgagatgctgtgctccttgcctttgggctttctttgtttgggttgcccttccttcttctcccattctcttctacctgtttttcagtggtaactcctgcttgtgtggtctcttgccccttgccatattttactttgtaattcatatactgtgctcattctcctagtactttttgtgagcaaaggatggtgtttattcatctctttttgaatttgttcattcaacaagtttttctgtgcatttgtttgttcgttcaacaaatgttcattgaagtctaaccgttgtcctagggactaagctaggtgctagcagccaggattcagccatgagcaagacagccatggttcctgccactatggagctttcaatttagtggagaagatagacattgagcaaattatcacagaaataattactattgtgaaaagtgctgtaaatgaaaaatataggttgttttgagaatgtataatgtgggcctaaaccagtttgggagggagaatgagtcaggatctttgaagaaaagacatttaagtggagatcagcagcatgagtcagaatttgcaggttaagaaagaagtaagagccttccataccgaaagaattctgagtggttcttgacctgggctgcagtctagcgtcaccacgtaaaagggagtatatggagcacctggacatatcatgcatgactggtgggagtataaagtgatatgcctactttagaaaacagtttggcagttacttgaaatgttaaacatacttttattttgtaaatgcatcagttccaccctagatatttgctcaagaaaaatgaaaacatatgttcatacaaagacttgtacatgaatactcataatagctttatttgtaaaatagccaaaaactgatgagtggataaacaagtggtggtatagccattcaatggaatactactcagcagcaaaatggaacaaactactgattcatgtgacaacatggttgaatctcaaatcttgttgagtaacagaagctaggcacaaaagagtacatactgatgattccatttaatttgaaattctagaacaggcaaaactagtttatagtgatagaagttggaacagtggttgtgtggggagggagaatgagggttggcagtgaaggaccaagtaggaatattctggggtgatggaaaggttctgcatcttgattggggtggtggttacacagggatgtatgtttgtccaacacatttaacagtacattaaaaatgagggcattttattatatgtaactgtaccttaaaaatattcatgcctcatttttataagggtcaaaaacaggtaaaactcgtctatgatgatacaagtcagaatgtggttactgtggggtatggttactcatggtagtattgactggaaaggggcaagaagggtggagccttcctggaaatgttctatattttttatttcagtggtagttacatgaacatatagattacataaaaattgaatgtatataatgtaaaaatatatattttaaattgtctatatatttacttatgtactttactgtaagtgtctctattaaagaaaaaataaaaccccaaaaaacccagcttatgcctggccccacccagagagatactgatttaattggtctggtgtggggcctgggcatcagcaatttaagagctccttaagtgattctgctatgcagccagggttgagaactactgctctatgtggaaaggctgaggagggaagaaatggtgtgtaaagaaggatcataaaaagcaggagtttcacttctcttttatttttaaaaattttaattaaaaatttttttattattattttttactgctccctgtgcagcagggctaccccataagcagtatgcccagagtagtcaggagtttcacttctaatatgaagttatagaaaaaaaaaaaaaagcaggagttactggagatgaaatcagaaagatggcaggtgtcagatcattctgggccttgcaggccacattaagaaattttaactttatcttaagaataaggagaaatttttgaaaggttataagcagagagtgactaggttggatattcagctagtatgcactagcaccgcctatagctcgcatttctgctgattggtcattaagtatttagattatctcctctgggagaggcatgctgtgtgcaggataagagttggaatagttaaggaatattgaattaggattggtgattgattaaatgtggagagtgaaggagagtgaggtgtcaaggcttctgacataagcacctggaaaagtaggaaggttagggaaaaaatgaatttagaattggaacttaactagttcaagtgcctgagagacatccatgtgatgtctactaggtagataggttctgtgggtttctgtaggtcctaagtgaaacttgaaccagaaacataattttaggacttggtaatagtaatttctttaaatagtaactgaaggtatgagaagaggtaaaatcactttaggaaagagtgtagtaagaagacagcccagaatttagaaaaaaattctgacatttagaatttatgtagaagtctgggcacagtggctcatgcctgtaattccaacactatgagaggctaaggcaggaggattgcttgaactcaaaaggtagaggctgcagtgaaccatgatcatgcaattgcacttcaatctgggtgacagagcaagaccctgtctccaaaaaaaaaaaaaaaaaaaaaaaaaaaagtcagagaggagaaacctaccttgcaaattagggaaagcgaagatttattcattcattcagcaaattctctattgaatacctagtatgtgtcaggcactgtacgagtcccttgggatactgcagtgagcaaaaaagcgactgctctcgtggaccttacttttagtggagggagataggtgataagcaaaccaaggaataaatatatcatgtgtcaggtggaatcaaatgctatgaaaaatgagaatcacaagctgtgtcctcagatatcttcaaataactatagttataaactgactgaggtaaggccatatgaggtgcaaagtcagaattgctgttggaactcagaagtatatctcattgcattgctcaacatggacctgtatatatagttgatgctgtggattattattattattatttttgagacagattcttgctctgttgcgcaggctggagtgcagtggtgtggtcttggctcactgcagcctctgcctcctggtttcaagccgttctcctgcctcagcctcctgagtagttgggattacaggcgcccgccaccacgcccggctaatttttttgtatttttagtagatatgggctttcaccatgttggccaggctggtctcaaactcctgaccttgcgatccacctgcctcagcctcccaaagtgctgagattactagggtgagccactgcgcctggcctattattattattaatgttgagacaggttcttgctttgtcatcaaggctggagtgcagtgtcatgatcatggctgacacagcctgaaactcctggactcgagcagtcctccatttcagcctcccaagtggctgggactacaggtgcacactagcacactgggctaattaaaaatttttttttcttcctttgtagagatgagatctcactgtgtggaccaggctgattttgaactcttggcctcatgtgatcttcctaccttggcccccaaagtgctgaaattacaggcatgagccatcaagcctggccaatggattaatttttttttttagacgaagtctcactctgtcgccaggctggagtgcagtggcgcagtcttgactcactgcaacctccacctcccgggttcaagcgattctcctgcctcagccttccaagtagctgggactacaggcgcgtgccatcatgcccagctaatttttgtatttttaatagagacagggtgtcaccatgttggccaggatggtctcaatctcttgacctcatgatccgcccatctcggcctcccaagatgctggaattacaggcttgagccaccgctcccagctgattaatttttgatgagcgacctcagggagagaagtgagcttggtcaaaattcagagcttagaagctgagtgcagtggcaaaagcctataatcctagctatttgggaggctgaggcaggaggattgcttgagccaggagtttgaaaccagcctgggcaacataacaagacccccctctcaaaaataaaaaggaagttagagcttagaatctgtagtgatttgtgttagtgttgcttgggcagctgaaaccagtgccagttttgtccagaagaaaagatcttttgaattcctgccccctgctgagaagagctggtcctcttcttggatatgaggacgagtggttctaacagacgcaggaatatctctcagataggctgagttttgcctagcctaggggtatgactcctctttctgtggctaggcctgctgtgtgcctcagctgagatgttatatttcactggggacctttcttggataactccaggtctcaaacctgttccttttttaagacttcacatttccatagtcaggcgcagtggctcacacctgtaattccagcactttgggagactgaggcgggtggatcacctcaggtcaggagtttgagaccagcctggccaacatggtgaaaccccgtctgtactaaaaatacaaaaattagccaggcgtggcagtggaggctgaggcaggagaatcgcttgaacctgggaggcagaggttgcagtgagtcgagatcaagctattgcactccagcctgggcctgggcgacaagagcaaaactctgtctaaaaaaaaaaaaaaaagactttacatttctggccagagcgtccatcccttactcctccctcacctcatccccattctaggccccatgctattttatctcttgaacttcatggtccttgaccaaatttgaaaatcttcccagggctagtactctcaagtcttagtcttttgatccctttccaagaatgagggtggattctaatcccatcaagagtagctgcagaatttgctagtcctggctgagaaataagaggtgaagtgggagaaattcttcttactgatggggcccctgctggtaaaacttggcaatttccaattcgtcctatagggatgaattactgtttagtgacgagaaacagaaagtggttgggaaagtcgaagcattagatggacagtggatattggtggtgggaattggtgggttgtattcaagaattcccttgactttttgggagatatggttttttaattaattaattcacacattcttcattcattcattcatttagccagcacatactgatttcatacttgacagggtagatggtagtggtaatattataatgggccctgggggatagagtgagtcaagcttggttcttaccacttggatgtggtatgtgaacaactcataacatgagaattaatataacagagctatgcacaaagtgctttggagcatagaacagtgaacagtgaatgattagctctgcctggagaaaggtgaggagatttgggcaggagggaaaggactttgtgtttttttctgccaatagctatcaaagtgtagtctttagaccatggcgggtggcagcaaggccttttcaggacatccagaagatcaaagccgtttcataataatatattatttgccttaaaaaaaactatgtatacctttgtactgatgttgcaaaaacagtggtaggtaaaactgctggcaccttaacacaaatcaaaccagtggcactgaactactagtaatgactgtattcctcacctccacacactgtcagttaaaaaaaataaaagttttcaacaaagaagtagaaatcattaattttattgaattgcatcccatgagttcatgccttttagtattctgtgtgatgaaatataagtatgcataaagcatttctgctgcatgtagaagtttgatggttatctcaaggaaagcacttgtgcaattgagttgtaagttgacatacctcttttttttcaggcagcactatcattagttgaaagaatacttgatagataactatggttattcagtatttggcagaattttcttgtaaataaatgaaatgcatcttctgctttaaggaaaacaactggtagtatttgttgccaatgataaaattccagcttttaagtgaaaactggattttagaaaacttgtatctgtcactgtgaaattgacagttttcctggattaaaagcttttctgatgaaatcagtggtgatattaataattgtggctattttgatattgtataaatgaaagtgtcaacatttggaagctctgcactaactcctaaccaatagtttccaaatgacaagtgcatcatgttacaaagtcatgcatgtattaaagatccattcaaagtgtaagatagaccaatggattttaatgttagagggtacaaaaagtttattcatatagtttgggatttcacattgcaactaacctttaagaaacctaccgcttgttgagtttgggtatagtctcgtataaggtatccacaatagtctgactagtaaaatattcctgtcttttccaactgcatatctatgttttgatctttagccaaaacaacacatcacaataggttgaatgtagctataagattatgtctgtcttctattaagccagacatttaaaagatttgcaaaaatgtacaattctacccttctcgagattttttcagaaaacaattattttccataaaaatattatttacattaatatgtaagagatttgttattgttctaaaataaattaaagagagcctggagagcagtagcagcctggctgtcatcaccatgtccctgaaaggtgattttttttttttggagacagggtctcactgttgcccaggctgtagtgcagtggtgcaatcacagctcattgcagcttcaacatcctgcactcaagtgatcctcctacttcagccttctgagtagctgggactacaggcatgcaccaccatgcttggcttttatagagatggggtctcactatgttgcccagacagattttgaactcctgggctcaagcaatgcctcagcctcccaaagtgctgggattataggtagtgagccactgtacctggccctgcaggctgattttgacagtgttgcagaagatgtgaggaagctgaaaacaagaccagatgaggaaggactgaaacaactctatgggctttagaaacaagctataactggggacattaatattgagtgttcaggaatgctagatttaaaaggcaaggccaaatgagaagcattgaatttccaaaatgggatatcaaaggacaatgtgatgagtatatatatatatacatatattttttttttgagacagagtcttgctctgttgcccaggctggagtgcaatggcacgatctccgctcactgcaacctccacctcccgggttcaagcgattatcctgcctcagtctcctgagtagctgggattacaggtgtgccccaccacacctggctaatttttgtattttttagtagagatggggtttctccatgttggtcatgctggtcttgaactcctgaccttgtgatccgcctgcctcggcctcctaagatgctgggattacaggcgtgagccactgcgcccggccaaatacctgtatttctaagcaaaggagctgatagaaaaaggttgaatttaggataaagcataggagaaaattgtcctttggaagccttcatactggtatcatgacctaacatttagtgggggaaatgcacttttaactctatgtatcatctacatttttgctgttagcatgaattgtaataattaggagtaaattgaaactacctagttaactaaactgtggttacttaaactaggtgtctgtaaaagttcttttagaaaagtgtcttatattttatttttatagatttagggggtacaaatgcagttttgttacatgggtatattgtgtattggtgaagcctgggcttttagtgtacctagtgtatccatcacccaaatagggtacattgtacccaaaaggtagtttcttgtcccttaccgtcctcccccactcctggcaacttttcgaagtctccactgcctccagggactctccatgtccccctatacacattgtttggcttctacttgtaggtggcaatatgtgatgtttgattttctgtttctcagttgtttcacttcagatagcggcctccagttccatccacgttgctgcaaaagacatgatttcattcttcttttatggctgagtagtattgtgtgtgtgtgtgtgtgtgtgtgtgtgtgtataaaaataatattttctttatgcagtcatccattgatggacactaaagttgattctatgtcttgctattgtaaatagtgccgcaacagacatgagtggtggctatctctttatataatgatttcttatcctttcttatcctttggctagctgcctaattttggtcctttgggagatctccatactgtttttcatagaggttgtactggtgcattcccctaacagtgtatgagtatttccttttctctgcatcctcaccaacatctgttgtttattgactttttagaaaagtcttgctctgggagtatgtatacaaagactttagcaattgtttgttcttttggcttatctgttctacagtgagtttagtgttactcatttagtgttcatctgttttgattattaagaagaaataaaatgaattaataactaaatataaaaatttgtgttttactttccttttttaattcaaaattttgtggaaattttatttgaaatgctctgatctataccttatgaaacatattatcaatctagaaaaaatcttactgaggcagtttgcaaaagttttatgttgctaaatattcattaacgcaatgtaggtaattaaattttaacttttattttgagtttagggatacaagtataggtttgctacataactaagcttctgacatggggtttgttgcacagattatttcatcacccaggtattaatcctagtacccattagttatttttcctcatcctcttcctcctcccaccctccaccctccgaaaggccccagtgtgtgttgtttccctctgtgtatccatgtgttctcatcatttagctcctacttagaagtgagaacatgtggtatttggttttctgttcctgtgttcttttgctaaggataatgacctccatctccattcatgtccctgcaaaggacatgatctcgttctttttttatggctgcatctgttttactttctaatatggtaaatattaaacagttctttgtaattaaaagatgttatgcatataaaagggtcctgagaccaaaaagtttaaaaacatatgcctatgctattttctttgcctagaactcttctcttttttctctagagaaatcctacacatagttgtagagttaatatttaggtattcattttaaaaaaacatttactgagcatcttatcaagaacctggctttttgttgctgttggggacatggtaccaatcccttatggagatcacagtctggtggggaagacacattaaacccagtatgttgaatgttaccagtgatagcatataaatgttgtgggagtacaggctgctgtcagagtcttgcaaagagccactttcccactcacttggaacatatgactggtcaggttgattggattatacctcctatatttgattcttcatagtcagacagggaaagtggccgaagttaaaagaagatgggaactgtttacttgctgctctgggggtaaagaaggatacttcaaatgtattaaatgtcagcctacaccaggccctatgctggatgttttaacaaatgtgattttatttttaaaaagtctgtgcagcagattattatccttattttgcaaatgagaaattggaggctcaaataaattaacttgtccaatatcttatggtttgtaattggtgaagatgggattttgatagtgttctgactctaagtccaggctttttcactgtagttatgtgttgctaaatgcatggctctttgaaggtatttccagatggttgtgggaaaccttgccagattggaatgcgtaagagaaggtaggaaaggtctcaggaagaacagagagactgcttaggacatgcttggttgaaggaattatttgtgagttttggctgacatggtttttctgtacaggattcaacggccataggagaatcaagcttttgtactccctaaccctcaatccctttaatccttctctatgtcatctgatgctagcagcaaaggtcacctgtctgtctgattaggttacaaaccagagactgggtatttgaagcccaaacttcttggatcttgtaggtttttgggaaaggtgctggttaattgacctcaggccagtggtgcagcctggaggccccaaaccctagagcttggtaaactatttccattattttaaaaagcctattagaagttttgctttacctaggatatgtgtggatacaggctaatgaaaagattggatttctatctttctttaattctttttttttttttttgaggcagggtctcgctctgttgcccaggctggagttcagtggcacaaacatggatcactgcagcctcagcctcgtggcctcaagcgatcctcctacctcagcctcctgagtagctgggaccacaggtgtgtgccatcatgcctggctaattttttaaatttttgtaaagacagggtttcaccatgttgcccaggctagtcttttaactctggggctcaagggaactcccacttcagcctcccaaagtgctgggatcacaggtgtgagccaccacagccagccttggatttctttcttttaggtcaatccaatatgatttaggtatgctacctatgatattctagaacagggttcaacaaactatggcctgtgggccaaatccagtttactgcctgcttttataaataaagttttattagaacacattcaagttcattcacttatattttgtctacggatgcttttgtgctacaatggcagagttaagttgtgcaacagagactatatggctgacaaatcctaagttgtttactatctggccatttacagaaaaatttgctgatacttaattatgatcctttctatcatggcacttagcacatagtgttttaattgcttgtctctcccacttttgtaattagccttctgagagaaaaatgagatatgattcatgtttttatgccccatgctgatcacagggcctgatatatgaagaacattcaataaatgtttaaatgggcatatcatgggctgatcaaaaagctctaatatgcaattatatatgtttttgttggtgaggtagtagagaaacaatgccttaatctttgggtgtattctgctctctccctaagttcccactaccccttcatcccactccccaatttagcagaacaaatgtagagagaaataagtttatgcagagatatttctttttgtatgcatactgtttatcatacttttttcttttatcaaaccattgcaggctgggcgtggtggcccatgcctgtaatcccagcacttcgggaggccgaggtgggcggatcacttgaggtcaggacttcgagactggcctggccaacatgctgaaaccccgtctctactaaaaatacaaaaaattagccgggcgtggtggcgcatgcctgtaatcccagctactcggaaggctgaggcaggagaattgcttgagcccagggaacgaaggttgcagtgagcagagatcatgccactgcactcaaacctgggcaacagggtgagactctgtctcaaaaaacaaacaaacaaacaaacaaaaaaccaaaaaaaaccccatttcttcaatgttcttcttgcccatattatcacctgtggcttctaaaagatgaaagcaacacaaggccagctatctggtcaccctagcaaaaaggcagtggtgaaaatggaattttgaagtgctggcctgggagtcagcagacttgggctctcactgtggctctttagctgcctttgactttggcacatcacttaacattggtgagcttcaatgttcaacatacttctattgaatcacatctggaacactttaaaatttaatatttatactcctcccttattttgaaaaggatttgaataactagcaagaggtagagaggtgacctgtctagtcttatcactgtctttggctgtcagacaagtagatgattaaatggattagggtattttaggtctttgattagtgccttctaaaaggcgtcacaaccacagcctcttcaccctgtccttactttctgtcctgtgacagcttcttctattgcctaggaagttaagatctatcttctttgagggtcatctgaagagtattttgccaaggaagtagttgtcgagatccaggtcaaaaggaaagaggaattttagcatctaggaattggaagaaatactagaaacttcagtcaaaatacctttttcaaatagtgaccttgaggcctggagaagagaaatgacctccctagatcatatggtagagctaagcctagatttcaggctcttcctattgtgtgcatcattcagactaggtgttttccaggcttgtaagagaggactaggtgtcacagaaagagctaaggtggcctaggctcttgtgctggttttactgctacatggacatgtaatggtaggcagaagaaactgtatcccagaccacctaaggtgttgtatcagatgagctcgggaccttcagatatctaaaaaatatttgcctgatataactgtctatgagaaggcatgagatgtgagaggtttccccagtcaatggctgaccttatatgtatcagcactgacaaaatgaacaaaaaggaaaattacacatcatttgggcactgggactaattggctgttgttctgtttccagaaagattatgttgatttacatttgtgtatttggctgattaaaaataatagctcaattgaatatgtatttctttgattactaatgaggccaaattttttcctgtgttcattggctatttatgttttctctcatttgtgagttactgattcacattcttgtctagatcccagtatactcccagtcctatgcaagacttccctgccaagaaactattagggtgataaagcattgtccttgtgggggagctcagcattttcttggggagacagttacagtctagatgaaacacctctgtcactgtacaagtagccagttaagtgcctacatgaggagtcagatgctagaagctaaggatgctgacacaggtgggtgataggttctgggtggcagctctgagtaattttgtctcttgcttttcttacacagagttttgccgaattgacaagcccctgtgtcacagtgaggatgagaaactcagcttcgaggcagtccgtaacatccacaaactgatggacgatgatgccaatggtgatgtggatgtggaagaaagtgatgaggtgagctctcccatcctgctatgtctctcttttcttcctgtgtgaattagtctttgaaagctacttagacagcctcttccctggggagagatgttctctgctggcttgttctttaggaactcatccctatcagggaagatggctcccagaagagcagccctctaggagtcagcctgtcagagtgtaggctttatgcttgtgtctgtgcctgggctggctgccccctgcctactggctagttgtgtaacactgactaagctgtgttgtttgggagggagagagatccctgaggctggtctctatggtttccttgcatccttcttgcaatcctgctatagatggagggcatcagtctgttctcagccctgtgttggcatgagggatagaagataagacacccagatcctgccctctgggagtttatactctatatgggaagaagaaacaaattgttttagaaagatcattctgaattccaggctgaagtttttgggagccagttgagtggtctagatagtaagagttaaaggagtctctaaatggaaaaaagctctattgttgtttcatcttttggcattattgtacctgtggctcagcagatcccagagaataaggtcattatgtgtgaaaagatttaaaagtttgttcatttaaagctcaacatataccagtagtttggtgaagctaccaagttatgccaaatcttcaatagtgatgtagttatatcacgatgggggagatatccccattctctctttcctgccagcctacctttgagttttgagttcaattttggatcccacattgtcagatccaatgtgaggaacaatgagggcctatacagagaggagtgacatgagtgatgaagagtttggaaagtatgaaacaaagagcattcaacacaattatgtttattaagcgtctatgtaccatgcactgtgctaggcatggagatgggactgtaaataaaacagatacagtctgtctttatataacttaaagtctagtgaagagactttagcctggagaagaggagactcaggtaatataatttctatctttaaatacataagaagtaaatcaatcagacttaagtaatgatgatagtaaagtgaaaaccatgatactagctctcattgattgaactcttaccttatgccagtcacagtgttaagctttttgcatagttactcttttaacttcaacagatttatgaagttggtattattactagggtatggagccttagaaaggttaagcattttcttcagggacacagtgaatatcagtgcagatctgatttcaaagcccatgctcttaagtactgctgtattgtttctcctattctaagagcagaaccaggtccaaagtaaagtggggaaagtaaaaagtaggcattttcttttagaataaagaattgactaatagtgagagctatcttgtcatagaagaggcttccttggtagacagtgaactccctatcactgaagatgggcaagtagcatacagaactccactgaatctgggtgtggtggctcatgcctgtaatcccagcacttcgggaggccaaggcaggaggatagcttgaggccaagaatttgagactagcctggacaacacagcgagaccctgtctctacaaaaaaaaaaaattggctgggtgtggtggcatacacctgtagtctcagctactctgaggctgaggctggaggatcacttgaacctaggaggtcgaggctgtggtgcactatgatcatgccattgcactccagcctgggcaacagagcaagaccctgtctctaaaacaaaacaaaacacaaaacaaaacacaaaattcactgattggtcaacagaggggatttgtctgtaaggatgaaccagataatgtttaaggaatttaaaggaagagaaaaaatagacttcctgtataaaaagtaaaatttggatagaatggaaagggttgggcttactgagtagtggagaatcagtgtgagcaaagctgtagaggtagtaagaaatatagtgggttggtttggttagacagggactgtggtagaaaaccacagaacaaaaagttggaaaggaaagtggggcccaggctgagatatgtatacttgttgaaccaggcaactgtaggttcttgagcaaagacaacgaccatgatgtaagtatctgaaatttggttacatccagaagtgtcactgacctgtaaaggatcaaaattttatttgtctaacctgagaatacagccatgttcctgggggtgaatgaggcctagtggcatcctgatcactgtcccagggcctggccagaaaactggggaatggatgaagaaggtgatgtaacccaagatctataaattcttggatatctttgttatatgctcctcatccttttttttttttttttgttacatcctgctgagttgctttgtcaatgaggggaggaataaaatgttctttttagaggaatgttaccacaacaaaaagctcatcagcacaaactgttccgaaataacacaaaaactgttaccctgctcttctctgcgccagtggtgagctgttctttttcagtatagtttttgccttgccttggtttccactgctctccctgcaatctcaggcctcacatggttagagaggcctgctggtctaggtttgcatgatcaatcacaagctaccttcctgagagagaaagtaccaaaatgtgtgtgcctaagtcacttcaaacatgtataagatagccttagagttcaggatctaactagaaagttgggtagatatctcagggtttagaatgttgtgtaatggatggtggggtaccagaaaccctggttcttttggccattgaggacctgaagggttttttttttttcattcataaaacttttattccacttacatgaatttaatacacgtgttcttaacaattatgcttggattattaatgaaaatttcataagatattaaacaaagctagccatcatctcaagttatttccttgttaactatttttacagcacatgcatgttaggcaagtatcaaaaaaaatcacaacagcaaaaaaactaaaaaaaaagaagttaaatacatgggtttttctttttttgttttactgctgtgcttgatatacgtgaagtaatgaatatcaagcaattcatttttactgcatctttacttttacatttgtttttaggttgcctaaaacatttaaatacaaataaaatgagtgtagcaaaaataatgaaagccaacagcaggtaactttacaaataatggaatgtgaactgtttctgcccttatccagagtaaaatgggtcacaactttgtctaaaggaacacttctgcagccgtagtcaaaggtgtgcacagtgagattgaatattccatagatatacaagatgtaacatgtgggccaggtgtggtggctgacacctataatcccagcactttgggaggccaaggcaggaggactgcttgaggccaggagttcaagaccagcctagtcaacatagtgagaccttgtctctataaaaaaataaacaagtatgaaaaaaaaaaaaaaagggccgggcacggtggctcacgcctgtaatcccagcactttggaaggccgaggcgggtggatcacgaggtcaggagattgagaccatcctggctaacacggtgaaaccccgtctctactaaaaatacaaaaaattctccgggcgtggtggcgggcgcctgtagtcctagctactctggaggctgaggcaggagaatggcgtgagcctgggaggcggagcttgcagtgagccgagatcgcaacattgcactccagcctgggtgacagagcaagactctgtctcaaaaacaaaaaaaacaaaaaaacaaaacaaaacaaaaaagatgtaacgtgatatccatgggatatctgtttctaccacagccgtttaagtgctccaaaccttaaagtacccacagttactacacctgtgactggaaccaatgatcccttttactccctgccaggacaaaccaatgtgtaggcagttttctttgcttagacatgaagcagttttaacactggcccttgtgaagccacaatgtaccaaaagtactatgccaaacatttataacctttagaaaaattccacatttccatattggccacctcaaaatggaaacagataactccctaaatgttaaccggccctgctctcctaatattaaacataaaaaccacatgggaaatatagatattcaagtagaagtagcataaacctgtcataaatcataaacaaaaactctttgtgggacagcatggatgacaaatggtctactatgtaacttttagaatgaggcagacaaagttggaaggctggttaattttccccttgttctcctgcttcagcttcatttccttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaatttttgccatttctgaagtaagtctttattcctacagattattgtgactagagtgttaacttttcgttgtatgaatcaaagcatgtcttcagggcctcttgcactattaccccagtacctagattcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacattttccacagaaaagaaactaaaataacctgttatacaattagtcacaaacacagtcctacttttttttttgcctatacacattaatattgtctaaaacatgtcttctttgtagcagctaggccctgccaccactgtgcttggctgagttcacaaatctgttgtaacctgtagcttctttgtcacttctctggctctcttctgctaagtatttttctggcagtaattaaaatctgccactgccatagctactgactggaaccaccatagctgccttggttttgtgttttggccagtatagaatccagagcttctgcctccaaagtttcctcctttcgtgcatccaaaatttgaggactgattgttataattgccaaaattattgtagcttccaccacctccaaaattgctttcactgccaccaacaaagctgcttctgcctccatcgttgttatagctgtgagagctgacactcctgctgtagccactgccctgatttccataatcctgcctccacttccatagcctctgcttccttcagcgtaaccagggctgcccctctataaccactgttgttaccaaatccattatagccatccctgttgctaccagatcaccaccagcatggctgctaccaaagtcaccacaaccactgaagtttctcctccatgaccaaagttgtcattcccaccaaaaccacctccacgaccatcaccagagtttccagaaccatttcgacctctttggctagatgaaacactagccatctctttcttcgacagggcatccctaacttcatagttgtggccattcacagtatggtatttctttttttttctctcgagacaaggtcttgctctgttgcccaggctggagtgcagtggtgtgaacacagctcactgcagcttggacctccggggctcaagtgatcctcccatctcagcctcccgagtagctgggactacaggcgcgcaccactgcacctagctaatttttgtattttttgtagagatgaggtcttgccatgctgcccaggctggtcttgaactcctgggcaagtgatcccctgcctcggcctcccaaagtgctagaattacaggcatgagccactgcacccagccagtatttcttttaaaaatatttgtttatttattttgagacaaagtctcacactgtcggccaggctggagttcagtggtgtgcgcatggctcactgtagcctttacctcccaggctcaaacgatcttcctgtctcagcctcttgaatagctgggactataggcacatgccaccatacccagctaatttaaaacaaatttttttaaatttaaaatgtatcttttttaaagcccccaacaaatatccttttcatagttaagtgggcatgtggtctttgagaatcttctcttgatacagctcttctgtccaccttatgtagccttgcattcacggctgcatccacctcctccacagtggcatatgtgacaaacccaaagcccctggagcacttggtatttggatctctcattaccacagtctgtgagtgctccctgttgctcagaatggctcattggaccctcactggtcatttcaaagctcaactctctgatgaagaacttctacagctgttgggactacttaagagactctgtcttagacatgatagcagtgggaagagagactttaatgatgttttcagcggcatccatgggtagaaaaagccattctcgtttctaattgctgaatatactctgctgtgaaattagacttagggcaaactgagactcagtaggcatgttatagaaaaatatataatcaggccagttgtggtggctcacagctgtaatctgagcaccttgggaggctgaggcaggaggattgcttgagcccaggagttcaagaccagcctggacaacatagggagactctatctctaccaaaaaaaaaaaaaaaaagccagatattggcacagagaccctaaaagagactttttaagagtctcttaaaagaaaagaaaaatatataatcatttgtgtaggggcagctagtttggttaagtgccatctttgcttgcttctcttctggatagcagaggctatgtattgtgggcccttcagatgtgcaagatggctctattggtgatggtgcccttcttgcagagctggcagggagttctaccaggctggcagtatgagaattcatgacctgtgttctgttcaaacttctggtggggtttgctccatgggcaaaagatttgttgcagtgggatggtactgttaggttgtccttaacagtatgagttgggcagacaagggcctacctaagaccattgtccccttgactggaccagactttttgagagcagtgctattttcttttctggagcctacatggcaaatcagggcatttattcagtcattaaacaaattcttatttaatacatattaaagccaggcactattcgaaggctagggattccacagtgtacaaaacagataagatccctgcttttagggagcttgcgttctagtgatctgtatgtcacaggtgattaagtgataagaaaactttgaaattaggcagaactgtgatcagattatagtagtctagtgactttgcctttggttttctcagggtaaagtggtagttaatgattcctaccattgcagcgttgttgtcaggattaagtgagaaaagtgctgtttaaagttcccaacacaaagaattctcaaaactcgacaatagaaaataagccaggccaggtgtggtagtggctcacgcctgtaatcccaacactttgggaggctgaggcaggcagatcacttgaggtcaggagtttgagaccagcttggccaacatggcaaaaccctctctgtactaaaaatacaaaaaaattagctggtgtggtgacacgtgcctgtaatcccagttactgggaaggctgaggcaggagaatcgcttgaagccgggaggcggaggttgcagtgagtggagatcgcaccactgcattccagattgggcaacaaagtgagactctgcctcaaaaaaaagaagaagaagaaggaagaaggaagaaggaagaagaaaataagccacttaataaaaaatgggaaaagatttgaacagagacttcaaagtagatatatggatggctaataagctatgaaaagatactcaatattattaaccattagggaaatgcaaattaaaaccataatgaggtatcaccacatgcctgttagaatggctaaaaataaaaaatggacaatatcaagtcctggacgaggaggaagagccactggaactcttgctgatgggaatgcaagatgataccgccagtctggaaaagtttcacagtttcttacaaagttaaatatatgtcccagcaattcttcctctaggtatttaccctatgaataaatgaaactttatattcacagtagaacctgtatatgaatgtttatagtatctttatttgtgattgccaaaaactggacataacccaaatgtccttcaatgtatgaacggataaacagactatggaaaactactcagcaatataaaggcatgaattttttggatgaacacctgtggggaaaagcaaaaacaaaaggcaaaaacaaaaagcaaaacaaaggcatgaactactaatatacacaacatatgtgaatctcagaggcattatccgagggaaagaaaccagtctcaaaatattacatactatgtgattctatttatatgacattctgagaaaggcaaaactatagggatggagactaggtcagtggttatcaggggttattagtgtaggggaggttttgactacaaggggaaagcatggaggaagtttttgggagtaatggcctaactgttctgtgtccagattgcaagggcagttacatgaatctattaataaatatgtattaaaactcatggaactatgcgccaaaaagttaaatttcatcatatgttaatttttttaaagttcccagcatagtacctgacacgtaattcaagctcagtgaatactcgctactttcccttttctcttttcctctatatatccaggaaatcaactagcatctgacagttgtatttttcttagatagggtctcactatgttgcttaggctggtgttgaactcctgggctcaagaaatcctcctgcctcagcctcccaaagttctggaattacatgtgtgagccaccacgcctagcctgacagttgtttttttttggagatggagtctcactctgtcacccagaatggagtgcagtggtacagtcttggctcactgcaacctctacctcctgggttcaagcgattctcctgcatcagcctccctagtagctggaactacaggcgcgtagtgccacacccagctaatttttgtatttttagtagagatggggtttcgccatgttggtcatgctggtcttgaacttctgacctcaggtgatctgcccgcctccagctccgaaagtgctgggattacaggcatgagccaccacgcctggcccctgacagctgtattttaatgtttgtctgatgtattttgagcccctttagggaaagaactgctcttatctggtttgtctctcttttccccagtgcccaacaaagtctgttatagaatatgtgcttaatcactgtgttgaatgactgaccaatattgctatagcagaatgctatcattctgctatgggagtcttagcaagggtgtgatcacacattttaggggataaggatgagtaggtagcagtatgaatccaggaagctacaagatctacttatgacttctgttagtgtctgtggtgtctggtatagaagtataacacagggttatgagcttatgctctggaatcatacagactccattctgcctcttccagctgtggaaacttagagaagttacataatccctttccacctcagtttcttcattagaaattggagtaataatagtagtaggcttttcatgaagatgttgcaaatattaaatgaataatgcatgtaaagcacttaatacaatgcctggcacatagaagaggctcaattaaagtttttacgttatcatcagaaagaacatatattttgatgcaaacaagcctgtattcaaaacttggctttgccacttactggctatacaactttaggcaaataaccttacctttctgagccttgattttttttttaagctatttgaagagggatgttgtgagacattaatgtatgtaaagcccctagcacaatgcctggtacgtgataggtgctaaagccatgtttttttctccctcaacatgagggtacaatagtgagggctggcttgtatagcaaaattccatatcagctctatcaccatcccatggcaccacagcatttagccatgggagccactcccagcagtgtgcctaacttgactagggccaggacactgtaggaggcagaggtagttctgttttcgcttaagtggttgatattaagagggagggcatgataaagcaggatcacacatttatagggactacaacttttctggcagctcacccagcctcctacatatgcctgtgtactttttttttttttttttgagacggagtttcgctcttgttgcccaggctggagtgcaatggcactatctcggcttaccgcaacctccgcctcccaggttcaagcgattctcctgcctcagcctcctgagtagctgggattacaggcatgcaccaccacgcctggctaattttgtatttttagtagagacggggtttctccatgttggtcaggctggtttcaaacttctgacctcaggtgatctgcccgcctcggcctcccaaagtgctgggattacaggtgtgagccaccacgcccggcgcctgtgtacttttaaaaaggtctggcttttgggccaggcacggtggctcatgcctgtaatcccagcattttgggaggccgaggcgggtggatcacctgaggtcaggagtttgagaccagcctgtccaacatggtgaaaccccgtctctactaaaaatacacaaattagctggggttggtatcaggtgcctataatcccagctgcttgggaggctgaggcatgagaatcacctgaaccccagggaggcggaggttgcagtgagccgggattgtgccactgtactccagcctgagtgacagagtagaaatgtcatgagacctgtttagagtttagtgggggtagaaatagacttgttttctatgtttttcattgtcccatccagagtaatgctaggtcctgggaggctgtgagagttcgggaagctggcatcaggttcccgatgccaccatttggcttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttgcagatgttattaccataattaataataattatattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcagggtcttgctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccaagttgccggggattacaggtgagagccactgcaccttggctacctttgttaattctctggacatacctcctaccgcttcggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaactcccatagtacatagtctctatcgctcgatttagcacttaattagaaattgccttgctttgtgccctaatgattttgattgtattgttttgtctataactttgtgttcctgcactaatactggcattattaaagcacaactcatcagattacttctaccatgtgccaagccaagctgattacatataaagttttgtttaatccttaaccactctgtgaactaggtgttattaactccattttagagatgataaaactataaatgagtggcttacttttgcttgtttaattaatctaaactctgctctgtcattcaatgctcccaccatttggctttagctcatgctgctagttcatgttatactgtatttccttactctatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgaggccaggagttctagaccaggctgggcaacataacaagaccccatctctttaaaaaaaaaaaaaaaaaacccacacatttcagtgcaatgcctggaacaaaacaacaacaacaacaacaacaaaaaaaaacaaatagaaacaaaaggaaaaagaaatttcatttgtccaccaaggcctagatcagggtttcggaacctcagcattattgatattttgggccagatagttctttgttgtggggagctgtcttgtacattgtaggatgtttagtagcattcctagcctctacatactggatgccagtagcaaacctttccccttcccccttccagtttgacaaccaaaaatattgccagttactattgtcagttgtcaattttcaaactgccccttgttgagaactactggcctagattaaatgttgcttcatccaagaaatatatatatattttttggagacggagtcttgttctgtcgcccaggctggagtgcagtggtgtgatctcggctcactgcaacctctgcctcccaggttccgatgattcttctgcctcaggctctctttcatcatgttggccaagctggtcttgaactcctgaccttgtgatccatctgcctcgggctcccaaagcgctgggattataggcgtgagccaccacgcccagccaatccgagaaatcttgtttgttctcctacagtgggaagtaatcctttctcatgttcgagagtacttggcatgaaccttatgtttgtcatgttgctctgttctgtattgtaattgggtccatccttaactgtcctaccagattttgagttcctttaggggtcatgaactaggttttattcattgctgtttctcataacattgtgtttggttcaggacctttctcttaagggtgctgagttgacgttatttttgaattttgaattcgaaaacaaagatactatcttattgttttatgccctttaaatagtttctctagtgcaaaggaggagtacagagtgggctggtcaatggtactggggacagagtgctttggacttgtgagttccctgtcaggataaaagctgaagtcagtgttgggttgtttttctggagttgctatagtctgggctctagatatgttagtatatgacctatacgtctgacctcctctgtgaccttcttccctacccttctgccctatgttatgaatcatgtgcagaatctggatggaggtaagattactgtacttaaaatgataggaaagactttaagaataacacatactataggagcacaagtgaagaaaaaaaggaaaacactgagaatgcccaaaggctatgtagtagagcaaaagtatgtacttataaagcaagaaagatagtttcaggtatacttttgccaattattagttgtttgactttggaaagtttctctctctctctgtctctttcttttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacaggtgcacgccactatgcccagttaatttttgtattttttgtagagacggggtttcgccatgttacccaggctggtctcaaaactcctgggctcaagcaatctctgcccacctcagcctcccaaaatcctgggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagtagcagtatttctacttctttaactcgtactaccattgctatgatgtactaggcttgtgctgtgtactcttgcatatgctgtctcatataatccttacaagaaatctctgagacagacagtaatttttttctgtataacccataaggaaagagactgaattagctcattgttaaccatttttgaggttattgtaactcagatgtgcctcaggctgatgataatgttctaaaattagattgtggtgatagttgtatacttctgtgaatatactaaaaactatggggttttatactacaattagtatgtgaattaaatctcaataaatatgttttttaaaaaagtgtcaccgcattggttggagtggtggtcacctttcgcttgcctttctgtagcccagcccataacaatccttagggccctgtagaaaagcactttgaaagtcatgttgatttctatctccatttttaatttttattttttttgagacagggtcttgctctgtcacccaggctggagtgcagtggcgtgatctctgctcactgcagcctccatctcctagggtcaagtgattctcatgcctcagcctcctgagtagctggggctacaggcatgcaccaccacgcctggctaatgtttttgtgtttttagtagagaaggggtttctctgtgttggccaggctggtctccaactcctggtttccagtaatcggcctgccttggcctcccaaagtgttgggattacaagtgtaagccaccatgccctgcctctatctccatttcccctgcctccaactttgatagagatgcagtggtgctttgaagtctgaagtaccatggttgctggaagcagatccgtggttagctaactgacagcgaggttgcctcagttcctggggaggtatagatgacttttgagaatgtcagactgaagagtcctggagcattctcttttggagaatttctccctctttccctctttttattccttccttttccttttttgtagttagtactgcttctggggaagttaagatgtcaaagaatctgtgggacaaccctggtggcaattccctcttacccatataccaggggcctgaatcaatttcttgacccctactatgtgacattacatgtgaggagttgtcaaagacagccagccaagtggctctagttttatttttccttgattaaccttgtgctcagggcctctctctgattcccatggctgctatatcactcccagaggccataccggcacctgagaagcagagctctccttttggtccctggacccaattctgaacataacttttctttgcattccctgcacacagctttgacagcctggagctactgctgctgctgctttttctctttctgctcctcctcctcctctttctcctttcttttttttttttagatggagtttcctcttgttgctcaggctggagtacagtggcacagtctcggctcactgcaacctccgcctcctggattcaagcgattctcctgcctcagcctcgcgagtagctgggattacaggcatatgccagcatgcccggctaatttttgtattttgagtagagacggggtttcatatgttggtcaggctgatctcgaactcctgacctcaagtgatccgcccgccttggcctcctaaagtactgggactacaggtgtgagcaaccgtgtccagcctctttctcctttcttaaaaaaatttactatatgcaaatttacttcagcattggtttctggtatatatattttttgctacagtaattcttctttgacttcagtttggaggcactgctctgccttttttctttctagttctctgcctgtatcctggtgcagtcatcatcttgtctcctacttcatggaacattctgaccccctgctcttaattcaggcaaagcatggattgaagtctgctcaggccctttggacagaacagagatagctgacaccatgaatgacataatttttcaagtgaaacctgctccttaggctaaagaaatgtcctgttcccattcttccttgtaagtacttatagggtggctgtagaattcacctaccaggagtggctcatcagtttataggccgcaacttccattgagttcaagttatttggcccagctcatacattcagtcctaacttttgtgagtttattagaatagctttagaataaactatttggactttgactttttaaaagtctaagcatgagctttggagtccaacctgggttcaaatccaaaccttgcaatgtactaaatatatggccaagtgatttggagactcactttcctcatctataaagtaatgatgacaataagatactctttgccatgaacaagccctaggctagtgagagacacaattatgtaaacaggcagtgacaatagcacattttaagggctgtaatggtagtatgcataggtcctgtgggagtttccagaggaatcaggatgcagtgatcttatatgtactggtgtagcagaagccatattgtcagccagcacgcaggcaagggtaccagttcccagacaagctgagctacgtatcagtgagagtaggcatagtttgcaatctgtcccagtaccttagccagatacaagatgaggcagcagctcccccagatggtacccctcatgtttccaggaaaacccgacggtggcttgctttgacagatagggaaattctttctcactaagcaggctgttgttttccttcccccctctttgttattgagtctgctttgtcttttctggatggtaatcctgtcgatgacagggatgagatatatttgtaagacttgtttgtatagatgtctatatatgtgtatatgtctatatgtgcctttgtgtttgtgttttttttgtatgtgtgtatacatcattttgtgcttgtgtgggtatgtgtctttctgcatttagatgtgtctgtgtaagacaagaagtggagggagaagaggaacactgagccaaggaagtaggggctgaaagaaagcccataaatgaggttgaggatcaaggagcaggttagggacaaagggtttggcctgaggtataggacacaggacctggaagtaaaagcagagccagaaatgtaatcagcagcccaaagatgctgtcagtctaggcagaatctgggccccacagagtggtaggcagaatgcaggtatcacctagcagccaggaatggtcaagctagcagagagagaaaagccatgcttcagaaattaaaaacttctgactcttcctgtctaaggaggaattggcagctggctcccaaggccctgcttcccttcagacctaactggtgtttgtgtttgtttgactatatatgtattttttcaagtccttctgtgcatgtctgtgtctgcatatgcctcacattcagtgtacttgtacttcatagcattaagaagaattgtctgattcacttaagttcagtgagtttcctttcatttcctttcattcattcttgtgttcttctcctcacttataaatacctcctttgaaatctttcttactttttgatgtgctccttgccttctttctctcttttttcttcaaacatatttagtgtgtgctatgtgctggatgctggatatgctttgcatattcatttaaagactaataagatgaatttactacctagaaaggtctcacatattactgaggcaaaaaaaaatacatattcaatccccatagatattgtaacaagagatgagccctgcatgctctggaagtacagaaaagagttaatccatctgaggatgataggaaacactatccagaaaaggtattgcctgagatgaatttttggagatgaataggggtttacatggggagggggctgagcatgatacatcatgtggagtaacaagtatgatgtccttgggaatctgtggtcagtggttcttttaacttgagcaaatgtaatagtggggcagggagggagaggttgggaataagattagaaaggcaggctgtagccagatttgtgtgccatactgaggaacttggatttcatcctaaagttgaaaagctagaagtaaacagagctggccctaattctgactgaaggtatgtcaggagcaggttttgcagaggaggtgaagttggaacttggtttttaaagatgagcaggagtttactagatgaagaaaggaagaagagcattccaggaaaggggaacttaacgagtaaaggcaggaggcaaaaaatatggcaactctgggagacatcaagtagggaagtatctagagaatagttatttcatctatgagatagggacaccagtaacatataccttcaatggctgatgtgaggcttgaaaaatatcctttgtaaaccatagagctgtgtgcaaatttctatagttgttgtgttatccagtttcttctaattttttgtcagtacccaacatgcatcaggccttctcaggtatagatccacataggcatacacctcagcagtttggcactggcttgatgagaggcatgccctcttttatctagccacttggtgtcttgaggaggcagaggtaagattagaagtctctgggaagtcactggtaagattagaagttgctgggtcccttgacaagggggctcatattctttattcttgtttatcctcagacactaggtttctcctcagataaaccagtataaatagtatgagcccccttgtcaaggggacctaggttcagaatagtcaaacacatatgaagcatcttctacatacaggcactgtaagggactgtgccttaaattatctccttttctccacattgtaactgtgaggtagtttgcattttacaggctctaggtgacacagtggtaagtggcagaaatgtgattcaagacattatctgtgaaattctttttcctctgtgacacttcataagctttgtgatttctctggatgttgaccaagctgcgtgatcagttaagagtggaaaactttgtgcagtctcaggcagtatggggatggaggagttggagagaaagttgcttggctctgtctttgggattgagtggtaacactttcctctgcatagaacagtggttctttccttcgaggaccaactctcttctatatatctgtctcacctagatgctttcaatatgtctgattaatctgtgtgtccttggatctcagcacaagacctgtcacatagtaactactcagtaaatattggttaggcaaatgaaagaacaaatggtgcttaacaaagccttctggaactcccaatgcctgcactattcttctgccttctcttgtgtagtacaatactcttaataggatattttgtccttaaggacacacacacacacacacacacacacacacacacacacagtgtgtatatatattttgtattgctcattgatgcataagcctaaatcccccctcttagagttgattagatgccaggagcttcttgggagaggcatgagtttgttttactctcttatattctttgtccctaagcctcttcccataccactgcccaaaggtgagtgtcatttataaggaacacgtgatgagctctaattctttttgccaagtctattgaagtgggtgttctattttggaaatggagtcctagaggttttcctgctgttgagtgtttggctgggtttgtgatcctctcagggtgtttgaaagccatgtatagggatggtagcatgagggaaaactgagcagtgaatcgaagttgccgtttgttcatggggattgtcagggagagagatttcctcagcacctgaagccagagcagagggtggatttattatatctagtccagggatcagcaaactgtttttttcgtgtagcctgcaaactaaaaatgatttttacatttttttctttcataattgagattttattggttgaggatcagtacaaacatttcaatttgtacacaattcttaacatacgtaccgaaaatctaaaaagccatgtattgtaattctttttttttaaagttattccagtgactttccagcttaaaatttggaagcaaattgtccttaagaggctatcaagtaccggtatgttcacatgttgataagctgttacatatgtcccaccaattcacaactgaatagcatgtatactacatattcaaatttttaatctttcacagcacagtaaccaagtgattaggaaaacaggactaccacaaccaaagatgttacagagtacacacaattctgacagggagagccatgatcaaggactggttttctttaggaaacaattctactaaaaaataacatgggaatagaagtaatttaaaatgttcaagacattaaatgcagggctgctgactccatattgtcatttaatatgcattgtattataggatataaaaactaacccccatctatggagtgttaagctgacagcaaagacagtcaaaacctcccataattcaataacccacactgttttctggttgtaccaaaaaataaacaaccagcgaatgatttcacctcttaaataaagcatttacacttaaaagatgggatgaggtgggattccctccttcttaaaaatgtttctagagctactaaaaaacttgcatttacaaaatagttgataaaaatattcctctggattgtacaagaagggagacagggaccactgataatgtatgatgtgtggtattattcagacttggcttccttctctcctgcctcatcagaggctggactctcctcagttttcttttccctgtttactgcaggtaaatgttctttagtttcttggttagccacttcggcctgttttccctttgctccccttttcccttttgtttgcacttgtttgtctgaagatttatcctttgctgctgcctttttcggcttcgcttccacttttgcaggagcaggtttagcagacaaccgcgccgatctcctcttgggctcttccttggcggccccttccgcggagctgaccttgctcttaggcatcctggcggcgtggagggtgcgtgcgggatgtctgtgagccgcggcgcaccgagagccttcgcgaagctgggctgcctggtcgctgccgctcctcccgccgcccgagctgctgagatccccagaaggggcggtgggagaaccctgatttttacattttaaaatagtttagggggaaagctaaagaagaatttcaagatgtgaaatttatatgaaattgaaatttcagtgtctgtaaagttttattggcatacagccactctcgttcatttacatattgtctattgctgcttttacacaagaacagcagagttgtgtagttgcgacagagaccatatggaccaccaggcctaaaatatttactgtctgactctttacagaaaaagtttatctggcctctagtctaacctatcaattttaaaaaaacagctttttggagaaagaattcacataccgtgcaattcacccatttatatacaattcaatgggttttagtatattcacagatatgtgcaaccatcacctcagtcaattaaaaacatttttgtcacctcaaaaagaaaccacatacgcattagctattgttctctctccacatttcccccagccctaagcaaccacgaatctactttctctttctgtagttttgcctattacggacatttcatgtaaattcaatcatataatatgtggtctgttgtaactagcttttttcacttagcatgttttcaaggtgcattcatgttgtatcagtactgcctgtacatgttcatgtatatatatctgtactttatttcttttcatgggcaaataatattctattgcatggacataccagttttgtttagcattcatcaatttatagacatctggtttgtttcactttttggctataatgaaaactgctgctatagacatgtataagtttttgtgtggacgtgtgttttatgttttgtttggatgtatacttttatttctcttgggtacatacatatgaatagaattgctgggtcatatggtaactgtgtttacctgttttaggaactgccagagtattttccatataaaaatggttcaagtggctaaaccatttttacattcctgccagcagtgtataagggatctgttctctccacatgctcatcaacacttgttattgtctgactttttgattacagtcatcctagttggtataaagcaatatctcattatgattttgatttacatttctctgatgactaatggtattgaacatcttttcatgtgcttaatggttatttgtatatcttctttagagaaatattttctcagatcctttgctcatttattttattttttattatttaaaaaaatttccatcttcattttatattcacggggtacatgtgcaggtttgttacaagagtatattgcgtgatgctgaggtttgggattctattgattttcttatgcagatagtgaccgtagcatccaatgggaattttttcagtccttctccctatccccactccttttggagatcccagtatctattgttcacatctttgtgtttgtgtgtacccaagatttagctcccacttacaagtgagaacatgcaatatctggttttctgtgtctgcattaattcacttaggataatggcatccagctgcattcatgttgctgcaaaatattttcatggtcaatatgtaccacattttctttcctttctttttttttttttttttttgagtcagggtctttctctgtcacccaaactggagtgcagtggcatgattccagctcactgcagcctcaatctcctgggctcaagcattcctcccacctcagcttctgagtagctggaactacaggcatgcaccactgcctggctaatttctttgtattgttttgtagatacggggttttgccatgttgcctgggctggtcttgaactcctgggctcaagctctcctcccgccttggcctcccaaagtgctggtattacaggcgtgaatcaccgtgcctggcctgtatcacattaattaatggcatctaggttgatttcatgcctttgctattgtgaatagtgctgcagtgaacatatgagtgcacatgtctttttagtagaataatttattttcctttgggtatgtatacagtaatggaattgctggatcgaatggtagttctatttttagtactcttagaaatctccaaactgctgtggccgggcgcggtggctcacgcctgtaataccagcactttgggaggctgaggcgggtggatcacctgaggtcggggttcaagaccagcctgaccaacatggagaaaccccatctctactaaaaatacaaaaaaattagccggtcatggtggcgcatgcctgtaatcccagctacttggaaggctgaggcaggagaatcgtgtgaacctgggaggcggaggttgcggtgagccgagatcgtgccattgcactccagcctgggcaacaagagtgaaactccatctcaaaaaaaaaaaaaaaaaaaaaagaaaaaaaaaaaaaatctccaaactgctttccacagtggctggactaatttgcattcccatcaactgtgtataagtgttttcttttctctgcagccttgccaacatctgtttttttgttttttttttttttttttttttagtttttaataataactttgcgtcctggtatggtggctcatgcctgtaatcccagcgctttgggtggcgggtggattgcctgaagccaggagttcgagaccagccagggcaatgtggcagaacttggtctctacaaaaaaaaaaacacaaaaattagctaggcatggtgatgtgtgcctataattccagctactcagaaggctgagacatgagaatggcttgaacccagtaggcagaggttgtagtgagccgagattgggccactgcactttagcctgggtgacagagtgagactctgtctcaaaaaaaaatttaaataaaataaaaaacctttacttatttttaaattgggttgtctttttggtattgagttgttaaagttctttatatattttaggtacaaatcccttatgagatacgtgatttgaaaatattttctcccattctgtgggttgctttttcactttcttggttgtatcctttgaagcacagaagttttaaattttgatgaagtccagtttatttatttttttgctgttgtttctgctcatacttttgaggtcatgtctgagaaaccattgtcaaatccaaggtcgtgatgacttacccctgtgttttcttctaagagttttaaaggcatctgaagcttaatgtgcactagatggattctaaatatcatctcatccaaaacctgctatatatactaccttcctcatctcagttgaaggcaagtccattgtttcaattgcctgggcaaaaaatattctaaataattcataatttttcctcaactccacatctattggtaaatcctgtgggttctccttttaaaacatatccaaaatagaatcatttctcactatcattccactgcaggcaccaagtctcaatagtctcctagcagataatcatgtctacatttattctcaatgtagcagctagagagcttttttgaaaaaaaaaaaaaaatgtaaaccagatcatttcactctcctcaaaacttcatttttttgtttggtgtgaaagccacagtctccacaaaagttagcaaggccctctgtgatctggtccccacttattctgatctcctctctgacttatattccccttgtcactcactgtagccacactctttggtgttccttcatactcttttatattcctgctttagggccttggttctagcttttgccgctgcctggactattgtttccttaggtatttagtttatgccctcatatttccatataaaatatactttgtggctgggcgtgatggctcaagcctgtaatcccagaactttgggaggccaaggtgggcagatcacttgaggtcaggagtttgagaccagcctggccaacatagtaaaaccctgtctctactaaaaatacaaaattagccgggcgtggtggcatatgcctgtaatctcagctactcgagaggctcaggcaggagaaatgcttgaacccaggaggtggaggttgtggtgagcagagattgtgccactgcactccagcctgggcgacagagggagactctgtctcaaaaaaacaaaaaacgaaacaaaaaccccaaaaatattctttgtcatttgtcatacttcatgttatcaaagagacctttcccagaccaccctatttaataatgaaatctgcacctctactccattcctggcacccagatcttcattatgaatcactttttaaaataatttttaagaacttatcatcatctggattttattatttaatcacttattgttttattatttattgcctagaatataaagttcataagggaaagggatctgttttgttcactgctatgtctccagtacctagaacagtacctggctcactgttggtacttttttgtatggattcaaagtactatctgggggggtcacttaaagagcttcctttagtatttttttgtaaggtgtgtcagttagcaatgaattttctcagtgtttgtttatctggaaatgtctttattttcacaagagttttgccggatgtacaattcttggttgacatcctctcacttcagtgagccctttgatcatgttatcccattgtcttctggcatccattatttttggtgagaagttaactgttaatcttactgggttcacatgtgtgtgatgagtcatttttctcttgctgctttcaaactttctcattgcctttgacttttagcgttttacttaatgtgtctatttgtggatctctttgcatttatcctatttggagtttattagattttctttatgggtagattaatgtttttcaaaacttgggaggtttttcagccattatttctttgaatatttttccttctcctttttctttctttttttttttttttgagacatagtctcactctgtcacccaggctggagtacagtggcacaatctcagctcactccaatctgactcctgggttcaagcgattctcatgtctcagcctccccaagtagctgggatcgcaggcgtacaccaccacacccggctaatttttgtatttttagtagagatgtggtttcgccatgttgtccaggctggtctttaactcctggccccaagcaatccacccactttggcctctcacaggtgtgagtctttctgctcctttttctttatcttccccttctggtattcatatattggtgtgattaatggtgttctacatttctctgaggctctgttcatttttcttcattcctttttctctatgtttttaggattgtataatctctatcagtctctcttgaagtttgctaattcttcctgctgccagttcagatctactatttagcccctgtcctaattttccacttcagttattgtacttttcaactccagaacatccatttggttctttttttaaaacaataatttgtctctttattgacattctttatttgatgcatcattgacatcatgcattcctttacctctttaaaaatcatgatttttttttttttaatctttggacatatttataatggctaatttgtagtctttttctgttaaatctgacatctggtccctcttactgagagtttctgttgcctactttttttctggtatatgggtcacactttcgtgtttctttgttttttgtttgtttgtttgtttgaagctgaacatttttgataatatattgtagcaactttgggtacttgtctgattcctctggggcttattattatttgcttgtttatttatttaatgactggctagattgtttaagtggttgatccccctcctcccacagtgtgaatcctctgatgttgctcctcagaggactttggtatgcccacagtcatatttggatgataatggtttgggcagaactttgactgtctctttccctggccacacccagctttttaggttcactaattgccatctggttgctctgctcttttcagcaatgccctgaggcataaattgcttcccagactaatccaactatattagggttcctttgaagggatagttcctgaggtcagtgtttgagatttgttcttttttggtttgtttttggagatagagtcccactgtttcacccaggctagagtgcagtggcgtgatcatggcccactgcagcctcaacctcctggactccagtgatcctcctacctcagcctcctgagtaattgggaccacaggtgtgtgctactacacctggcttcttttttttttttttttttaagttctgggatatatgtgcaggatgtgcaggtggcctggctaatttttaaattttttgtgaagatggggtctccctatgttgcccaggctggtgaaatttgttcttaccctgagagactcctcccagctgtctctttccctagttatctccagcaaattctctagtctacagtttagcctatatctccaatgaatctgctaatcttttcctttcaccacaacttctactcttttgagagtaccctacccttagtcttgaaattctctacactctgtcacagatgaggtcatttcccctgggaagagattcagatctctttgttttatagcctgcttcctcggccaggcaaaatctttgagtcacggttctggagctagggtgggggacaatgacatgcttctgagtgacaccaccactttaggagctgaggacttggtggaggggtggcagtagcctcaggtctttttggttttcttctcccagagtgtaatcaccatcttatgagccagggcaatgccagttgtggctccagtattcttagtggcactgcatccaaggtaaagctctcgtcctatgagtggggtttaaacgggacaaaagaggcccaccttttagctgcactcacttagaacttagcctcagtaacaggtagctgggggaaggatcagaaatgctaatatcctgctcaggacattccaggcagctaaccctttaacagggagcttgagagagaaggtctgtgtttagctgcatcagtgtgcagtggagtttctgtgtcattgagttgggagaggcaaggtggagaacaggtcttggtttaaatattgtggactctcgctgttcttagattttcttgagcatatgtttcttcattggctgtgtgcctttaagaccatttccagaaactttaaatggttgcttttgaaaaataagtttcactagttttactggagagtgggtctgtggagcttctcatgctgtcaaactagaagtcccttctaacccatcaattttgtaactgttctttctcatagtgcattttctccagtgctatgcattcagcctatataaatgtggcagtatttaccccaattaagaagataatctctttcctctggggaaatattttctaattagtgatctatttctgtcctcctttcataaaacaaaggttccccagacagtattctttggctagcttggatactttggttctgacagtttgtaagactggagatgttagagtttctctgtctttgccattctggccaggtacctggcaagctgaaacttttaatgctgcctctaggatttgacctgtgtcatgtgcccagtgttttggtggggcatcaacaatgattccatgacaagcactgagcgttctcattgacctcagagggattctctgtatctatgtatgtgctaggtgctggaaaaaaaggagtaaaaggaaaggcaatgttgctgcctttgaagaagttcccctagtggtggagatagccataaaacagataaggacactataatttattaagtggatactgtgaggcacaatggcgtgcacctgtagtaccagctacttgggaggctgaggtgggagaattgcttgagcccagagttcaagaccagccttagcaatatatcgaaaccctgtctctaaaaaaaaaataaaattttaagagtgaacactgtgatagagttgcagaagaggacgccctaagtcagcctttcccatgttatagtcactgacacataatccggatctcaacagatgactaggagtgataaggagaatgttttaagtgagggaatagcatgtacaaagatattgtacaggtgaaaagcctggtactgtcagagagttttaagtaattcattatcattgggaattgggaattcattatcattgggaatgagaggaagtggcaactgatgcactgaggaaggccagcccatagaggagggagggtcttgcataaagttgtaaagttttgattttaaatggagttaaagctttaaaagctttcaaagaatcatagagtagaacaaaaaggaccttagaggttagtagactacaatgtcttgtcttaactatctccattcctaacctcttgacacatggactttatatagcaagcacttagaaaatatccgttttctacctcctctataggtcttccttacatatgagggatcagcatcactgtaatagtgggccctaggattgtacgttcttttagtatctttaatccttcttaaaacatattacacacacacacagacaggagagcttattttgtgccaggcactattctaaggtatttagttgaatttactcatttatgcttccctcaacatgagggttgttaggttttgtgctactatcttcattttacaaatgatgcaagttatacactgaaactaagtggtggaacgaggattcaaacccaggcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataaccacacactctgctctgtgccgggccctcggcttggagatggatttatggagctaaattaattattcatttatgtattccagaaaatttacaagatgctggtgaagaataaatgataaataaaatatagtctctatttttgagttgcttagggagagtaagagggggataatgtataccctgagaactaagggaacaaataggatagggcaatgaactcacctgggagagatctagaaaacttcacagaaggcagtgactttttatttaatagacaaagagtgggagaaagcattttaaatggagcaccttgtgcaaaatcttgggggtataaaagatcatggtttggtcaaggagcatgaaatggcttgatgtgtctagagcaggcaactttttctgtaaaggattagatagtaattattttagactttgatagccatagagtctctgttacaaatactcaactctgtctttgtagcatgaaagcagccacagaaaatatacatcaatgcatgagcctggctatgtttcagtaaaactttatgaaaactggctgggcatggtggcttatgcctgcaatcccatcactttgggaagccaaggcaggaggattgcttgagtctatgagtttgagactagcctggacaatatggtaagaccctgtctctacaaaaaatgaagaaaaaattagcccctgtgcctgtagtccaagctactcgggaggctgaggcaggaggactgcttaagcccaggaggctgcagtgagccatcttcacgccactgcatttcagcatgggcaatagagggagactcagtctcaaaaccaacaaacagcaaactggatttggcttatggccatagttttctgacccaatatctggtgtgtaaggtgtctggtagggagggagagtggccaggaaggtacttaggaagttaatgtgtcatattgtaaaagaccttgaatgccaggccaagaagctagggctttatcttgtaggtaatggggagccatgagatgttaagtaagggagttggaatagatatttactttaagatcattctagagtgattgtggtggggggaggagccaagatggccgaataggaagagctctggtctacagctcccagcgtgagcgacgcagtagacgggtgatttctgcatttccatttgaggtaccgggttcatctcactagggagtgccagacagtgggcacaggacagtgggtgcagcacaccgtgtgccagccaaagcagggcaaggcattgcctcactcgggaagtgcaagggatcagggagttagttccctttcctggtcaaggaaaggggtgacagacggcacctggaaaatcgggccactcccacccgaatactgcacttttccgacgggcttaggaaatggcgcaccaggagattatatcctgcacctggctcggagggtcctacgcccatggagtcttgctgattgctagcacagcagtctgagatcaaactgcaaggcggcagcgaggctgggggaggggcgcccgccattgcccaggctcgcttaggtaaacaaagcagccgggaagcttgaactgggtggagcccaccacggctcaaggaggcctgcctgcctctgtaggctccacctctgggggcagggcacagacaaacaaaaagacagcagtaacctctgcagacttaaatgtgcctgtctgacagctttgaagagagcagtggttctcccagcatgcagctgcagatctgagaatgggcagactgcctcctcaagtgggtccctgaccccgacccccgagcagcctaactgggaggcaccccccagtaggggcagactgacaactcacatggccaggtactcctctgagacaaaacttccagaggaacgatcagacagcagcattcgcggatcatgaaaatccgtggttctgcagacaccgctgctgatacccaggcaaacagggtctggagtggacctctagcaaactccaacagacctgcagctgagggtcctgtctgttaggaggaaaactaacaaacagaaaggacatccacaccaaaaacccatctgtacatcaccatcatcaaagaccaaaagtagataaaaccacaaagatagggaaaaaacagagcagaaaaactggaaactctaaaaagcagagcgcctctcctcctccaaaggaacgcagttcctcaccagcaacggaacaaagctggacggagaatgactttgatgagttgagagaagaaggcttcagacaatcaaactactccaagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggacccaatgcgatcaactggaagaaagagtatcagtgacggaagatgaaatgaatgaaatgaagcgagaagggaagtttagagaaaaaagaataaaaagaaacgaacaaagcctccaagaaatgtgggactatatgaaaagaccaaatctgcgtctgattggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttcagggcagccagagagaaaggtcgggttaccttcaaagggaagcccatcagactaacagctgatctctcggcagaaactctacaagccagaagagagtggggaccaatattcaacattcttaaagaaaagaattttcaacccagaatttcatatccagccaaactaagcttgacaagtgcaggagaaataaaatactttacagacaagcaaatgctgagagattttgtcaccaccaggtctgccctaaaagagctcctgaaggaagcactaaacatggaaaggcacaaccggtaccagccactgcaaaatcataccaaaatgtaaagaccattgagattaggaagaaactgcatcaactaatgagcaaaatcaccagctaacatcataatgacaggatcaaattcacacataacaatattaactttaaatgtaaatggactaaatgctccaattaaaagacacagactggcaaattggataaagagtcaagacccatccgtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacatgatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctgcaccaagcggacctaatagacatctacagaactctccaccccaaatcaacagaatatacatttttttcagcaccacaccatgcctattccaaaattgaccacatagttggaagtaaagcactcctcagcaaatgtaaaagatcagacattataacaaactgtctctcagaccacagtgcaatcaaactagaactcaggattaagaaactcactcagaactgctcaattacatggaaactgaacaacctgcccctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagagctagaaaagcaagagcaaacacattcaaaagctagcagaaggcaagaaataactaaaatcagagcagaactgaaggaaatagagacacaaaaaacccttcaaaaaattaatgaatccaggagccggttttttgaaaggatcaacaaaattgatagaccgctagcaagactaataaagaaaaaaagagagaagaatcaaatagacgcaataaaaaatgataaaggggatatcaccacctatcccacagaaatacaaactaccatcagagaatactacaaacacctctatgcaaatatactagaaaatctagaagaaatggataaattcctggacacatacactctcccaagactaaaccaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcagtaaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataataagagctatctatgacagacccacagccaatatcatactgaatgggcaaaaactggaagcattccctttgaaaactggcacaagacgggatgccctctctcaccactcctattcaacatagtgttggaagttctggccagggcaactaggcagaagaaagaaataaagggtattcgattaggaaaagaggaagccaaattgtccctgtttgcagatgacatgattgtatatctagaaaaccccattgtctcagcccaaaatctccttaagctgataagcaacttcagcaaagtctcaggataaaaaaaatcaatgtacaaaaatcacaagcattcttatacaccaataacagacaaacagagagccaaatcatgagtgaactcccatttgcaatagcttcaaagagaataaaatacttaggaatccaacttagaagggacgtgaatgacctcttcaaggagaactacaaaccactgctcaatgaaataaaagaggatacaaacaaatggaagaacattccatgctcatgggtaggaagaatcaatatcatgaaaatggccatgctgcccaaggtaatttatagattcaatgccatccccatcaaactaccaatgactttcttcacagaattggaaaaaactaaagttcatatggaaccaaaaaagagcccacatcgccaagtcaatcctaagccaaaagaacaaagctggaggcatcacgctacctgacttcaaactatactacaaggctacagtaaccaaaacagcatggtactggtaccaaaacagagatgtagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttataccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaactgacaaaatgggagaaaattttcgcaacctactcatctgacaaagggctaatatccagaatctacaatgaacttaaacaaacttacaagaaaaaaacagccccatcaaaaagtgggcaaaggatatgaacagacacttctcaaaagaagacatttatgcagccaaaaaacacatgagaaaatgctcatcatcactggtcatcagagaaatgcaaatcaaagccacaatgagatagcatctcacaccagttagaatggcaatcattaaaaagtcaggaaacaacaggtgctggagaggatgtggaataataggaacacttttacactgttggtgggactgtaaactagttcaaccattgtggaagtcagtgtggcgactcctcagggatctagaactagaaataccatttgacccagccatcccattactaggtatacacccaaaggactataaatcatgctgctataaagacacatgcacgcgtatgtttattgtggcagtattcacaatagcaaagacttggaaccaacccaaatgtccaacaatgatagactggattaagaaaatgtggcacatatacaccatggcatactatgcagccataaaagatgagttcatctcctttgtagggacatggatgaaattggaaatcatcattctcagtaaactatcgcaaggacaaaaaaccaaacaccgcatgttctcactcataggtgggaattgaacaatgagaacacatgacacaggaaggggaacatcacactctggggactgttgtggggtggggggaggggggagcgatagctttaggagatatacctaatgctaaatgacgagttaatgggtgcagcacaccagcatggcacatgtatacatatataactaaccggcacattgtgcacatgtaccctaaaacttaaagtataataataataataaaaaagattattctagtgtctaatatggtagatagactgacagaaaagagactagacgtacaaagataagtgagaaatgactgctgtatccctgccttgagcaacagcttctgatctcagtggaaacagatatttcactcatgaaacgtacatgtcctagaactctgtaaatgacatttagagctattgtacctgaaatatggtatgcttccttgctagatgttcaagaggtaaataagagttggtaaacttttcagatctggaacatgtgacttatgggtttgatatggcttggttctgtgtccccaccaaatctcgtgttgaattgtaatccccagtgctggaggtggggctgttaggagtgattggattatcggggtgatgttctcatgaattgtttaacaccatcccctctcagtattgaatagtgagtgagttctcatgagatctggtcatttagaagtgtggtagcacctccccctttgctctttcttcctcctgctctggctgtgtatggtgtgtctgtttccctttcaccttctgccttgattgtaagtttcccaaggcctccccagaagcagaagctgctatgcttcctgtacagcctgcggaatggtgagccaattaaacctcttttcttataaattacccagtctcaggtatttctttttttctttctttttaaaattttctttggcggagtctcatgctgttgcccaggctggagtgcagtggcacaatctcggctccctgcaacttctgtttcctgggttcaagcgattctccttcctcaccctcccaggtagctgggattacaggcacaagccatgatggcagctattttttatatttttagtagagacgggatttgaccatgttggccaggctggtcttgaattcctgacctcaagtgatctgcccacctctggttcccaaagtgctgggattacaggtgtgagccactgtgcccagccacaggtatttctttatagcaatgtaataatggactaatgtagggttctaaatattgtgggctggatgggggttggagagcagcagagaaagtgggaatggaggtgggacaatttggtttgggaaatatggaaggtaagtagtagggaacaaggttggaaaggggagggaagtgttattgattctaaggaagaacccaggaaagccatccagattgctgtacccaaaggtgtgctgctcttcttctggctttatgtcagtgaattctcttctctggtggatcaagctggctgggcctattttgtagaaattatagagagatgtctcccctcttctctgctcccactctcactacttcactactgcttgacacttgggatgggtttatgccatgtgccacctcctgggagatcatttttctgggcgcatggaactaaatatacttactgacagctggtagcttggctctttgtagaactattgagctgtatagttctagccaatgttgcattccccatggtaaggcaggactcttggggagcctccttaggtattcctgagagaagagctgcttgttctaagtctgaaatagtaaatccctttggtgggatccaaaagctgcctgtttagctttgttatcacctttcgttacttttaaactttgtcttaaatcagactttagctattagctggatgtgggacagtgttcaaagtaagatgtggtaatgcctacttcaagtatattgaacatcaaagttacagctcaatataatattcttgggtgctagtacccagcttgtggctgggtaactgggaacttccgttgagggtatatggtttggcaggggagatagacatctaataagactgataaaggtattcataggcactatgggagcacagaagaagtcacctttgatcaagaatctttttctgttactttcctgtccttatctcactctccttccaataataatctcaattaatatctgaattgtgctttcaaactcagtactttagtgtacaacaggaattacaaactgtgcccctgaagggtcagagggcattgtaagtgagtaatgtgggctgtataaatgcatgtgcataagtctgtgagtggtgagagctgtgggaaaatggagagcccacacctcttcagaaggagcagctctggcagactgttgccatgtagtcatgtactccaagagcagttctaagagataggggattgagacctccatagctcctttagcaccaactccccaacctttaagataccccaaattgtataacatatatatattcatactcatatataatatgaattatacatattttatatatagtcataggccacataaggacattcagtcaacagtgggccacatatgcaatgtggttccataagattataatatattttactatatcttttttatgtttggatatgtttaggtacacaaatacttactactgtgttacaactccctacaatattgagtacagtaacatgttgtacaagtttgtagcctaggagcaataggctatttcatataacctaggtgtgtagtaggctatacacatctagcatactctatgatgttgacacatgatgcatttcttagaatgtatccccatcatatgtcataagtgaatgacatataatgaaaccaattttaacagaggctaatttgttataaacaagggttaagttcctatggcatatttctggtcacaaaaacatcaccaaacttacaaataaagaccaaaacacttacaatatgaaacactgaaataaatgtgagctgtatatacatttaagaaagattaataaaaacaagtaagataattatttataattatttacctacttatttcagtttagggttgagagtgtccagagtttatgctagcagctcagggtgcaaggtgggcaccaactctggataggacgccatttcattgcatggcacactcacacacccacactcactcaggctaggaccatggagacatgccagttcacctaaaatgtacatctttgggatgtgggaggaaatcagagaatgcacagaaaacccatgcacacatggggagagcatggaaacttcacacagacagtagccccagccaggaattgatttttttttcattgacgttataaagaaatgacattgaaagaaatggtgttatttgaggagctgctgtatatatttattctttgatatggagaattgattttttccttaagtttaagtaaaaggttaataaaaacatcttcataaaaagttgcattttggctgggtgcggtggctcacgcctgtaatcccagcactttgggaggccgaggcgggcagatcacgaggtcaggagatcgagaccattctggctaacacagtgaaaccgcgtctctactaaaaattaaaaaaaaaaattagccgggtgtggtggcaggcccctgtagtcccagctacttggaaggctgaggcaggagaatggcgtgaactcaggaggcggagcttgcagtgagctgcgatcgcgccactgcactccagcctgtgcaacagggaaagagtgtctcaaaaaaaaaaaaaaagttgcattttaaaattaatttgtggccgggtgtggtggctcacgcctgtaatcccagcactttgggaggccgaggcaggcagatcacttgagatcaggagttcgagactagcctggccaacatgctgaaaccctgcctccactaaaaacacaaaaattagcatgatggtgggcgcctgtaatcccagctactcaggaggctgaggcaggagaattgcttgaacccggcgggcagaggttgcagtgagctgagatcatgccactgcactccagcttgggcagacagagtgagactccatctcaaaataataataataataataataataaataaagtaaaataaaattaatttgtaatgaataatcttcataaaaatagtgtgcttgctatgcaaatgcaacctcatgacaagtcccttagctctcactctccttttccaattaaattgttagtccttaagccactcctgtataaaattctaaagtcattggagcttactgtggctagatatttttatttttttgagacaggatcttgctctattgcccaggctggagtacagtggtacgatcacggcttaccgcaaccttaacatcttgggttcaagtaatcctctcacctcagcctcccaagtagttgggaccacaagtgcacaccaccacatgtagctaattttaaaattttttgtggagatggggtttcactatgttgcccagactagtcttgaactcctgggctcaagcaatctccttccacctcggcctcccaaagtgctgggattgaaggcatgagccatggagcccaacctgttttgatttgtttaaaagatagcctgagaaggtggacttttagtgaaattttctgattttttttttttttttgagacagagtctggccttgtcatccaggctgtagtgcagtggcatgatctcgactcactacaacctccgccttccaggtttaagcaattgttgtgcctcagcctcccaagtagctgggattgcaggtgtgtgccatcctgcctagctgatttttgtatttttagtggaggcagggtttcacagtgttggcctggctggtctcaaactcctgacctcaggtgatccacctgcttcagcctcccgatgtgctgggattacaggcatgagccactgcgcccggccaaaattttatgatttttaaatttaggttcaacttttcaaaatgctgtgcaggccagtaaaagacacacacaaaggcaatttatgacttctgcaaacttgtctcatttaatccttaccatacctgaaatgagggacattattaaccctaattttgagaggaaaataggctcagagaggcaaagtagcttgcccaaaagtcacacagcaagtaagtagcctgtttctatgggttctgcctttctttctttcttttttttattattatatattttaagttctagggtacatgtgcacaatgtgcaggtttgttacataggtatacatatgccatgttggtttactgcacccatcaagttgtcatttacattaggtatttcttctaatgctatccctcccccagcccccagcccccaacaggccctggtgtatgatattcccctccctctgtctgtatgttctcattgttcaactcccacttataagtgagaacatgtggtgtttggttttctgtccttgtgatattttgctgagaatgatggtttccagcttcattcaagtccctgaaaagaacatgaactcatccttttttatggctgcatagtagtccatggtgtatatatgccacattttctttatccagtctgttattgatggacatttgggttggttccaagtctttgctattgtgaatagtgccgcaataaacatatgtgtgcatgtgtctttatagtatcatgatttataatcctttgggtatatacgcagtattgggattgctgggtcaaatggtatttctagttctagatccttgagaaatcaccacactgtcttccacaatggttgaactaatttacactcccaccaacagtgtaaaagcattcctatttctccacatcctttccagcatctgttgtttcctgactttttaatgatctccattctaactggcgtgagatagtatctcattgtgattttgattttgatttgcgtttctctgatggccagtgaagatgagcattttttcatgtgtctgttggctgcataaatgtcttcttttgagaagtgtctgttcatattcttcacctactttttgattgggttgtttgtttttttcttgtaaatttgtttaagttctttgtagattctggatattagccctttgtcagatggatagtgcaaaaattttctcccattctataggttgcccgttcgctctgctgatagtttcttttgctgtgcagaagctctgtagtttaattagatcccatttgtctgttttggcttttgttgccattgcttttggtgctttagtcatgaagtctttgcccatgcctatgtcctgaatggtattgcctaggttttcttctagggtttttatggttttaggtcttacatttaagtctttaatccatctctagttaatttttgtataaggtgtaaggaagggatccagtttcagctttttacatatggctagccagttttcccagcaccatttattaaatagggaatcccttctccattgcttgtttttgacaggtttgtcaaatattagatggttgtagatgtgtggtgttatttctgagggctctgttctgttccattggtcgagatacctgttttggtaccagtaccatgctgttttggttactgtagccttgtagcatagtttgaagtcaggtagtgtgatgcctccagctttgttctctttgcttaggattgtcttggctatgcggactcttttttggttccatatgaactttaaagtagttttttccaattctgtgaagaaagtcagtggtagcttgatggggatagcattgaatctataaattaccttgggcagtgtggccattttcatgatattgattcttcctatccatgagcatggaatgctcttccatttgtttgtgtcctcttttatttcgttgagcagttgtttgtagttctccttgaagaggtccttcacatcccttgtaagttggattcctaggtattttatttgctttgtagtaattgtgaatgggagttcactcatgatttggctctctgtttgtctgttcttggtgtataggaatgcttgtgatttttgcacattgcttttatatcctgagactttgctgaagttgcttatcagtttaaggagattttgggcggagacgatggggttttctaaatatacaatcatgtcatctgcaaacagggacaatttgacttcctcttttcctaattgaataccctttatttctttctcttgcctgattgccctggccagaacttccaacactatgttgaataggagtggtgagagagggcatccttgtcttgtgccagttttcaaagggtatgtttccagcttttgcccattcagtattatattggctgtgggtttgtcataaatagctcttattattttgagatatgttccatcaatacctagtttattgagagtgtttagcatgaaaggctgttgaattttgtcaaaggccttttctgcatctattgagataatcatgtgatttttgtggttggttctgtttatgtgatggattatgtttattgatctgcatatgttgaaccagccttgcatcccaggatgaagccaacttgatcatggtggataagctttttgatgtgctgctgtattcggtgtgccagtattttattgaggatttttgcatcgatgttcatcggggacactggcctaaaattcttttatttgttgtgtctctgccaggctttggtatcaggatgatgctggcctcataaaatgagttaaggaggattccctctttttctattgattggaatagtttcagaaggaatggtaccagctcctctttgtacctgtggtagaatttggctgtgaatccatctggtcctggacttttcttggttggtaggctattaattattgcctcaatttcagaacctgttattggtctgttcaaagattcaacttcttcctgatttagtcttgggagggtgtatgtgtcgaggaatttatccatttcttctagattttctagtttatttattttatattttatattattttattctctttgtgtagaggtgtttatagtattctctgatggtagtttgtattcctgtgggatcggtggcgatatcccctttatcattttttattgcatctgtatgattcttctctcttctttgttgatcttttcaaaaaccagctcctggattcattgatttcttttttttttttttttttttttttttttttttgagacagagtatccctttgtcacccaggctggagtgcagtggcatgatcttggctcactgcaagctcctcctcccggtttcacgccattctcctgcctccgcctcccgagtagctgggactacaggcacccgccaccatgcctggctaatttttttgtatttttttagtagagacagggtttcaccgtgttagccaggatggtctcgatctcctgacctcgtgatccgcccgtgttggtttcccaaagtgctgggattacaggcatcagccaccacgcctggctgattcattgattttttgaagggttttttgtgtctctatctccttcagttctgctgtgatcttagttatttcttgtcttctgctagctcttgaatttgtttgccatttcttctctagttcttttaattgtgatgttagggtgtcgattttagatcttttttgctttctcttgtgggcatttggtgctataaatttccctctacacactgttttaaatgtgtcccagagattctggtatgttgtgtctttgttctcattggtttcaaagaacatctttatttctgccttcatttcgttatttatccagtagtccttcaggagcaggttgttcagttcccacgtagttgtgtggttttgagtgaacttcttaatcctgagttctaatttgattgcactgtggtctgagagacagtttgttgtgatttctgttcttttacatttgctgacgagtattttacttccaagtatgtggtcaattttagaataagtgtgatgtggtgctgagaagaatgtatagtctgttgatttggcgtggagagttctgtagatgtctattaggtctgcttggtccagagctgagttcaagtcctggatatccttgttaattttctgtcttgtttatctgtctaatattgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccatcatgtaatggccttctttgtctcttttgatctttgttggtttaaagtctgttttatcagagactaggtttgcaacccctgctttttattgctttccattagcttggtggatcttcctctatccctttattttgagcctatgtgtgtctttacacgtgagatgggtctcctgaatacagctactgatgggtcttgactctttatccaatttaccactctgtgtcttttaattggggcatttagcccatttacatttaaggtttatattgttaggtgtgaatttgatcctgtcaatatgatgctagctggttattttgcccattaattgatgcagtttcttcatagcatcaatggtctttacaatttggcatatttttgcagtggctggtactggttgtcctttccatgtttagtgcttccttcaggagctcttgtaaggcaggcctggtggtgacaaaatttctcagcatttgcttgtctgtaaaggattttatttctccttcacttatgaagcttagtttggctggatatgaaattctgggttgaaaattctttaagaatgttgaatattggcccccactctcttctggcttgtagggtttctgccaagagatccactgttagtctgatgggcttccctttgtgggtaacccgacctctctctctggctgcccttaacattttttccttcatttccaccttggtgaatctgacaattatgtgtcttggggttgctcttctcgaggagtatctttatggtgttctgtgtatttcctgaatttgaatgttggcctgccttgctaggttggggaagttctcctggataatatcctgaagagtgttttctaacttggttgcattctccctgtcactttcaggtacaccaatcagacgtagatttggtcttttcacatagtcccatatttcttggaagctttgttcgtttctttttacttttttctctcatcttgtcttcttgctttatttcattaatttgatcttcaatcactgatatctttttttccgcttgatcaaatcggctattgaagcttgtgtatgcttcatgaagttctcgtactgtggttttcagctccatcaggtcatttaagctcttctctacactggttattttagttagccatttgtctaaccttttttcaaggattttagcttccttgcaatgggttagaacatgctcctttaggtcggagaagtttgttattaccgaccttctgaagcctacttctgtcaactcgttaaactcatcctccctccagttttgttcccttgctggcgaggagttgtgttcctttggaggagaagaggcgttccagtttttggaattttcagcctttctgttctggtttctccccatctttgtggttttatctacctttgttctttgatgttggtgacctacagatggggttttggtgtggatgtcctttttgttgatgttgatgctattcctttctgtttgttaattttccttctaacagacaggcccctcagctgcatgtctgttggagttggcgggaggtccactccagaccctgtttgcctgggtatcaccagtggaggctgcagaacagcaaatgttgctgcctgatccttcctctggaagctttgtcccagagggtcacccgcctgtatgaggtgtctgtcagtccctactgggaggtgtctcccagtcaggctacacgggtgtcagggacccacttgaggaggcagtctgtccattatcggagctcaaacgctgtgctgggacaaccactgctctcttcagagctgtcaggcagggacgtttaagtctgcagaagctgtctgctgccttttgttcagatatgccctgcccccagagatggaatctagagaggcagtaggccttgctgaggtgcaatgggctccgcccagtttgagctccttgccactttatttacactgtgagcatagaactgcctactcaagcctcagcaatggtggatgcccctccccccaccaagctccagtgtcccgggtcgatctcagactgctgtgctagcagcaaggaaggctctgtgtgtgtgggacccgccgagccaggcacaggagggaatctcctggatctgccagttgcgaagaccgtgggaaaagtgcggtatttgggcagcagtgcactgttccaccaggtagagtcactcacggcttccctttggctaggaaagggaaatcccctgaccccttgcacttgccaggtaaggcaatgccccaccctgctttggcttgtcctccatgggctgcacccactgtccaaccagtcccaatgagatgaaccaggtacctcagttgggaatgcagaaatcacccgtcttctgcattgatctcactgggagctgtagaccggagctgttcctatttggccatcttggaagtccactgggttctgcctttctgactcttaaggcctgattgttgcagcttcatttctttattttctaaagaggtcccattcagcataagtaccttccttcaggtagagcttctatttgccagttcctcttttggcatcatcttctctctgaccttgttttctgaccctacttgttttttgtgtgttttgtggcaccagtagggtctgtatgtgagtccctatgcagatcttccttatactttctttctgagtttctctgctctccacttacctcggtgatcagacttgactataaaaatgagtctatttcttgttgatttcctataagcagctggtatctcatgtcagatggtttcctggagttatctgataatgggagaaaatccccttccttggagattttggtgtttctgctcccaaggcttgcttgtggtaactgtctttctagtcttagattaagaggttctaggttggagcctatgaggaccaaagaagggtatatcttgaagaacctgattaatcaaacctaaaaaatcatgaggatagcagatttgatctctaaaatatatcccaattctgacaaattctcatcacttccacagctaccaccttgtttcaaaccaccattagctcatgttattgcaatacccacctgagtgatttctctgtatctgccctttcccttttatagtctactttttaacacagtatccagagaaatcgttttaaaaatataaatgtcttcatgttatacctctgttcaaatccctgtaacagctcccatctcagagtgaaaaatcaaagtcttgataatagcctaaaaagtcagctgggtgcatggctcacgcctataatcccagcactttgggaggccgagacaggtggatcacctgaggtctggagttcaagaccagcctgactaacatggagaaaccccatctctattaaaaaatacaaaattggctgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaattagccgggcgcggtggcgggcgcctgtagtcccagctactcgggaggctgaggcaggataatggcgtgaacccgggaagcggagcttgcagtgagccgagattgcgccactgcagtccgcagtccggcctgggcgacagagcgagactccgtctcaaaaaaaaaaaaaaaaaaaaaaaaaaaacaaacaaaattagccaggagtggtggtgcatgcctgtaatcccagctactcgggaggctgaggcaggagaattgcttgaaactgggaggtggaggttgcggtgagccaggtttgtgcccctgcactccagcctgggcaataagaatgaaactctgtctcaaaaaaaaaaaaaaaaaaaggcataaaagggggatctgtgttctggaaccctgtggcttctttgagttcatctcctgctggttaccaccttactcatttctctccaacgatactggccttcttgttattccttgaacataccaagtatattctcttgcctcagggactttgcttctgcccttctccattcttgggatactcttctcccagttattctgcatgcctttctcccacacctcttttaaatatttgctttgaagtcaccttcttatcttttgccttgttgcactcctgaaggcaaaatggatcacaagcagctctgctggagccacccacaaaaatctggccagagttctcgctcttgttgcatctgctcaaaccagcatggtctgatctggaaatatagcctcaatatgtgcctccagtgttgccatcagtacgtgaaggatataggtttcattaaattggactaagtgatcttccttgaatggattatccaaggcatccacacaatgaaaaatcatattagctgtttgtacataaaataaaaatgaagaaaatgaagtcagcttcttaatgacaccttgattcctctcattaaaatgacaaattgtgaataccactactcttggcatctcctattcctcttccctgctgtttttttctttatttaaattatattttatttaaaaacatttttaaaattttattttatttgtaactgatacataacagttgtacatattggccaggcatggtggctgacgcctgtaatccgagcactttgggaggctgaggcaggaggattgcttgagctcaggagtttgagaccagcttgggaaacatagtgagacaccgtgtgtacaaaaaatttaaaaaaatagctcggtaccgtggtgcacacccatagtccaagttacttgggaagctgaggcaggaggatcacccagcctgggtgacagagcgagacactgtctcaaaaacaacaacaacaaaaaaccccaccaaccaaccaaccatccaaaaaaattgtacatatttataggatacagtgtgatgttttgatacatgtatacaatgtataatgatcaaattagggggtaaaattagtatatctgtcatctcaaacatatatcatttctttgtggtgaacattcaaaatcctttcttctagctattttgaaatatacactatattattgttaactaaaatcaccctactgtgcaatggaacactagaacttataaacttaccctcccaactgtaaatttgtacccactgaccaatctctccccatctccctgtctacccttcccagattctggtaaccactatcctacgttctacttctatgagatcagctttttaagattccatatatgagtgagaacatgtggtatttattttttgtgcctggcttatttcacttagcataatgtcctcgaggcacatccatgttgccacaaatgacagaatttcattctttttttctttatggctgaatggtatgctgttgtgtaaatatacgacattttctttaaacattcatttgctgatgggccctgaggttgattctatatcttggctattgtgaatagtgctgcaataaacatggaagtgaagatgtctcttcaacatgctgatttcatttcctttggatgtgtaccgaatagtgggatttctggatcatatggtagttctatttttcatgttttgaggaacctccatactgttttatatggtgactgtactaatttacactgccaccaacagtgtgtaagggtttccctttctctatatccttggcagcatttgttatttgttatttttttggtaatagccatactaactggggtgagatgatatctcattgtggttttgatttccatttccctgatgattagtgatattgagcatatttttcacatatcttttggacttttttttttcttttttctctgagacaaggtctcgctctgtcacccaggctggagtacagtggcatgatcacaactcactacaaccttgatctcccaggctcaagtgatcctctgacctcaggctctagcttcagcctatagctgggaccacaggcataaaccaccacacctggctaattttttttttttaattttttgcacaggcggagtctccctatgctgcccaggctggtctcaaaatcctgatctcaagtgatcctcccactttcgcttcccaaagtgccgtgattacaggcatgaaccactgtgctcagtcttgtttgtcttcttttgagaaatgtctagttagatctttcacccattttttaatctgattttttttctattgagttgttcgagttccttatatattctagatgttaaccgcttgtcagatgtataatttgcagatgttttctcccattctgtaggttgtctcttcacttttcattgtttccattttattttgatttaatcccatttatctatttttgtattttgttgcctatggtggtggtggtggtggtggttgttgttgttgttttttggcagtgcagtgacgtgatattagctcactgcagcctccacttcctgggttcaagtgattctcctgcttcagcctcccgagtaactgggattacaggcatgtgccaccatgcccagctaatttttgtatttttagtagagatggggtttcgccatgctggccaggctggtctccaactcccagcttcaggcgatccacctgccttggcctcccaaagtgctgggattacaggcatgagccaccgtgcccggcccccagtacagtttattgaagagattgtcctttcctcagtgtttgttcatgcatttgtccaaaatcaattggctatacatatgtggattttattcctgtgttctgtattcttttccatgtctgtttttatgccagcaccatgctgtttcagttactattgttttggagaatattttaaagtcagatggtgtgattgctctagctttgttctttttgctcaagatggctttggctattcaggtttctttttggttccatatgaattttaggatttttttttctatttctgtcaagaatgtcactgaaatttagatagggattacattgaatccgtagattgctttgggtagtatgaatattttaacaatattaattcttccaacccatgtacatagggtatctttccatttatttgtgtcttcttcaatttagttcatcagtattttacagttttcattgtagagatcttttacctccttggttaaatttattcttaggtattttattattttttgtagctattgtaaatgggattttttttaatttctttttcagatttgtttactagctctaacagttttttggtggtgtctgtaggtttttctagatttaatatcatgttattggctgggcatggtggctcacacttgtaattccagcactttgggaagcagaggtgggtggatcccttgagatcaggagtttgagaccagcctgggtaacgtggtaaaatcccgtctctaccaaaaatacaaaaaattagccaggtggggtggcgtgcacacctatagtcccagctacttgggaggcagagatggaaggatctcttgaggcccaggaggtggaggttgcagtcagctgagatcatgccactgcactgcagcctgggtgacagaataagaacctgtctcaaaaaaaaaaaaaaaaaaaaagagagaagatcatgttgtctgcatgcaggggcagtttgacttccttctttccaattttgatgcctttcttctttccttccttcccttccttcccttcctttcctttctttcctcttgcctaattgctctggctaggactttcattactgtgttgaataatagcggtgaacgaaggcatccttgtctcgttccagattttagaagaaaagctttcaacttttccctgttcaatatattagatgtgggtttgtcatatatggcctttattgtgttgaggtatattccttctatacctaatttgattgcagagctgggggctggaatcaactgaagtctcagtcactcacatacctgactcctgaacttgaagactcaaacagctggggctactcacacatttctatctctacatagactttccacatgatatctccagcagggtggcttcagcgtagccaggcttcttacattttgactcagggcccctcagggcccaaaagagagagagctaggtgaaatttatattgctttttctaacctagacttgggtgtcgtgcaacatcactgttgccacattctatttgttagaagatgagtcactaatgtcagcctatattaaaggggagggaaatccacctttaacgggaggattatcaaacaatttgtggacatgttttaaaaccattacagtcggccgggtatggtggctcacacctgtaatcctagcactttcggagaccgagatgggtggattgcctgagctcaagagtttgagaccagcctgggcaatggtgaaaccctatctttactgaaatacaaagagttagctgggtcgggtggcacacacctgtaatcccagctactcaggaggctgagacaagagaattgcttgaacttcggaggtggaggttgcagtgagctgaaattgcgccactgcactccagcctgggtgacgagcgagactctgtctcaagacaaacaaacaaacaaacaaacaaacaaacaaccatcacagtaaattaacctgtctaaacctaatgtaatttggggcaaatggcattatcttcaagagtatcactgttctcatttataaaataagtgtgataattcattggttgtgaagatttgatgagaaaatattgtggaaattcttagaatattgcctaatttataagcaagtactcaaacattttaaattcttccttttttctttcctcttttagcttattgattttcagttaactgtcatgtattgtcttttcatagttaaaaaatatgaggaaaggatttctaatttatatatatttttcaagtgagacatgtaacaaagaggaagtgatagtttagttggcaactaagacatgtgcataaggaaggatacatgagtgatgtgatacacttgtatgttgggtagatggaatgtgttatggctagctagaggcaggtgacctgtgtggagatcttgacgggctgactcctaggtatctcttgtgacttgtgtacttttcccttgcagttcctgagggaagacctcaattaccatgacccaacagtgaaacacagcaccttccatggtgaggataagctcatcagcgtggaggacctgtggaaggcatggaagtcatcagaaggtaataggcagcctggtcatcaatcctagttgtgggaaggtttagagaagagagaagcagcaacttggccttagaagaacatgtatataaaatgcttagtaaagggcaaattattgaagttattctacatatagtcactaaaaaagactgaatatagtcactctgctgggcatgggggaaggttctccagagttggcgtttttcttcattaggatactttttgaattctatcctattcctacccctttcgtcacccacctaaccctggcataggaatcttccaggttctgctgctttatctccagagatagggagcttgctggtctcttgaggcagcccctttcttctctagcttcccacttagtcccagctctgctgagtcctagacaattcaaagattgggtgagggtacagacagactctctcctcttctataccatcttgattgaaagcttttctataccattttggttgaaagctcctgagtcttcttttttccaggttaagtagccctacttcttgaagaaaacattttctcagcctccttcttgtcttgatttcctgcctataagcacttttgttaatgtgtttcttagatcctatagttggctgcagacctccaagtgtgattttatcatcacggagttgagcaggactgtcaccttcttgtttctgaatcctgtgcatctgttagtgcagtctgattagattctggtgcctcactagtcataccactctactgacccatgttgagcttaatgaaaacttcagatttctgtaaaactgctaaaccatgattaccattttttttttctggagcatttccttcagagttcttagtgaaagagcatgtctaattgtgcgagacttgacagggaaggggaaaacagggctttagcttcctctccatttatatctgtggctagggcacagataacaataagactagaagaaatctctcttcccagggtctcttagggcaggttctgatgtaacaggggttaaatgtaagtaaccatcaggatccctggtttttatttgaggaaccttaggcctagatgtataaagttacttgtcattatcatgcatttagtagagccagaacttcagctgtaggccaatgcttttcaataccctcttggttgaaagcattagtctaaggtagagaagactagttttggtaggaatgaggcagtttctatttttatttacattttaatttaggcttatagaatttgagatctgaaagggataatctatattgtagatggggagcattaaatgtgaagcaggaagacctggattctaatcctgattatgggatggacaggctgatgcttcctgttaactctatgttttatcaatgtagaagaaaaattaggcagctgtaggagagagcttcctggatatctttggaagctgagttccttctgggggcttttctttaatagctctcgagcaactcaggctatgtactgatgaagattaagcagtgacatgagctttggaactataccagcggtgccaggaaaaaatcttccattagcatcatttagttttggctttcttatttttctctaataacatgaggacagggtggctggtttttaagagtgggtttcaaaagtaggaacttagaattaaagatggcagggagagcattctggccttttctgaaagctcgcatagaagtatctaggaaaggaaagtgagagggcagaaacagagggactaaatcataatgctagaaaacagctccaggcagttttctggcaaggactttatttttggacttagcaactatttggaacacttccagtgtattctaaattacaggaaaatgaaagacaatggagtgaggttttttgggggagagtcctcattaaccatgagtggagaaaagcatttcaatgcagtgatgtagttcacagctgagaaatgatatatatgtaccctattagaatttgctcactgtgtgttatacctggtgatttgacagactaaaagtgagaatttttatatgtcctcttcctcccaataatttgcttcattattcagaaaaaggcccctaatctctccggagtgatgatttccagagctacaaaaagcatttaatattctggcaccggctcaaactagctgttctgagtttagctagatgatgtagatgtcagcagtggtcacttgtgttcagaacattagctggctagtgtcagtaccatctgtgtgattagcattgttaacatttttctgactaatgttgggagccagtcttttctctgtgttatatagatcttagcagaaaagttttctaatctctatcttagccaactctgggctttaggaataaaaacagcagcagcaacgacaaaaactgaaaaactactttaacatttatatagtatttaatatgtgctaggcactgtttctaagtgttttacatatattaacttatttctcacagaaaccatatgaagtatagatattatgattatacagagttagcacagacttcacaagttaagttcacagcccccgataagattactctcacttcagacatcagccataatttcaagctgttcccaggtcacctgcacttctgaccagctgactacaattcatgcattaccatggccttctcaggtttgataattaactaggactactcagagaattcaagaaagccctatacttatgattacaattttattataaaagttacaaatcaggaccagccaaaagaagaaatttatagggcaagatattggagggtcctgaatatggcacttttgtgtcctctccttgtggaatcaggacacatctccatttccagcacatcagagtgtttgccagccaggaaactcaactgaactttggtgttcagtgtttttcttagggtttcattacataggcaagtttgattgaattcttaggcacatgattgaacttaatatccagctccctttttctccataaaggttggattggtatcaccaggctcagagccccaatgttctagtcacgtggttgatttttatagtgaccaccccccatcctgagtcatcttatcagcctgaactcatgtgtgatccaagggacccaccaggaataataaagacattcctatcactgggaatattccaaaagttcagtgggtacctcccagtaacccaggacaaagatctgccaaattctttattatacaacattgaataattaagtatggaagaactggtaaagcagggttgaagaaggaccaagaatgagggccactccaggaaatccagcagcagagactaggggattcgccttttcttttttttcttttttcttttttttgagacagagtctcactctgtcacctgggctggagtgcagtggcgcaatctcagctcactgccacctccgcctcccaggttcaagcgattctcctgcctcagcctcccgagtagctgggactacaggtgtgtgccagtgcgcccagctaatttttgtatttttagtagagacggggtttcaccgtgttggttggccaggatggtctcaatctcttgacctcattatctgcccacctcggcctcccaaagtgctgggattataggtgtgaaccaccgtgcctggggaattggccttttctaattagctactttcatatgacccagctttattcattttttatttctaagtgtctttgctcaagagtcagatatgacaagagaagaatcagattggcgtagtgtggattacagatttaaatagggtgttgatggtgggagtgtgtgtgtagggtttggagagagctgcaatttccagcccctacaggatcatatgaggttagaggagtggcagttctttaaaggaagggtggctgggtagttttgtagaatccttgagaaatagaattactgcttgcatatttgagccattggaaacaataacagtgtcatttttggagaagaatgatgggaggcactgacctaagggaattctcctctaaccatggctttcattttttctaagcaaagtgcatcgttactgtttctcttctcctttcctggacactagattttaaatgatgctatctgccaaacaaagtatatttcttcttttgagacagagtctcactctgtagcccaggctggagttcagtggcatgatctttgctcactgcagcctctgcctcctggattcaaggcttcttttgcctcagcctcccgagtagctgggattacaagtgtgcaccatcacgtccagctaatttttgtatttttaacggagatggggttttaccatgttggctaggctggtcttgaactcctgatctcaagtgatctacccgcctcagcctcctaaaatgctgggattacaggcgtgagccactgtgcctggtgaatatttctttttttttctttctttttcttttctttttttttttcgaggtggagtcttgctctgctgcccaggctggagtgcagtggaatgttctcggctcactgcaacctctgccttccaagttcaagagattctcctgcgtcagcctcccgagtagctgggattacaggcgtgaacccccacgcccggctaatttttgtatttttagtagagacggggtttcaccatgttggaccaggctggtctcgaactcctgactataggtgatccgcctgcctcggccttccaaagttctaggattacaggcgtgagccaccacacttggccagtatttcttaagtggtaatttctttcctcgtttttatgaatcaagactttgtacctatcaatctttgattctatgaaatatgattgcagctgaaagcaaaagaacctggtagtctagtgtgcctgtggactttgccatagtagttgtttccaaaagtttttgtttccaaaagcctggtagaaaataaacattacagactgggcgtggtggctcacgcctgtaatcccagcactttgggaggctgaggcaggcagatcatgaggtcaggagttcaagaccagcctggccaacatggtgaaaccccatctctactaaaaatacaaaaaaattagccaggtgtggtggtgggcacctgtaatcccagctgctcgggagattgaggcaggagaattgcttgaaactggaaagcagaggttgcagtgagccgagatcacgccatggcactccagcctgggcaacaaagagcgaaactccgtctcaaaaaataaataaataaataaataaaataaagtaaacattacagtaagtaagttcacagatctccttttctgtctgtgctactctttggacgatagaatttctctgcaggaagcagtggagtagtacagcaggttcctgaataacgtcacttcattcaaccttgtttgattataatgctgttgaaaattaaaaaattgcttccttactgggaccattgtctctttgtggagtttgcacattttctccatgtctgcacgggctttctccaggtatatcagtttcctcccacatcccgaagatgtgcactttaggtgaattggtgtgtctaaatggtcccaatctgagtgagggagagggagagagaggagggacggaaggagggtgggcggggtgggggtgggagagagagacagagagagacagagtgtgcgtgtgtatgtggtgtgtgcgtatgtgtgccctgcaatggaatggcatctgattcagggttggttaccacctggcaccctgagctgccgaggataggctccagccactctcaaccttgaactgaagtaagcaggtaaataattatcttacttgctttaatcttccttaaatgtatgtacaggtcacgtttatttcattgtgtaatattaggagtgttttggtctttatttgtaagtttggtgatgtttttgtgaccagaaatatgccataataacttcacccttgtttatatcaattagcctctggtaaaattggttttgttatacatgcttttgcttaaagttgcagtttccaacaaaccattgatgacattaattgaggacttactgtactggagagctaggaagcctttagaaagaacatccaggccgggtgcggtggctcacgcctgtaatcctagcacttttgagaggctgaggcgggtggatcacttaaggtcaggagttcaagacctgcctggccaacatggtgaaaccctgtctctattaaaaatacaaaaattagccaggtgtggtggtgggcatctataatcccagctactcgggaggctgaggctggagaattgtttgaacccagggtatggaggttgcagtaagctgagatcgcaacttcactccagcctgggtgaaagagtgaaactccatctcaaaaaaaaaaaaaaaagaaagaaagaaagaaagcacccagcagagctgctgacctctctgttgacacaacacagggaggccaggtggcatcagacttctgtctaaaccatttcaaaagtcagatccgtatgaaagagctggcagcccatttttgcttttacataaacctaatgagagatatgtttagtattttcttttagtcattaaaaaaattatttttctaagttaaccatcaagtcatttagttaaaaacctcagacattagttgtttgctgctgtattttttggaagaatcatacagttggctttttctttcccttacattctttcagataatttttgtatactgataataaaaacaactagcatccatgtagtgatttaacttttatcacagtcattttatatttattttaaatagacacttgaggataaaaagttttacttgtattcccatttaataaataagaaaactgagtatctctcacccgagggttctacctgtttaatatatcttatgtgcatctccgatgatactaccttagctcaacttcattacctttttaaaaagatatttattgagttgcaattgacatacaaaaaggtgtaaatctctaaagtttactatttttaagattttggtacatgtatacaattgtgaaaccatcactgcattaaagatggtgaatatattaatcacccctgaaagttttctcatagtcctttgtagtctctgctcccctagcaaccactggtctgctttctgccatagattagtttgcatttgctacagttttatgtaaatggagttatataatatgtacttttaaaaaataatctggccactttcactcagtgtaactattttgaggttcacttatgttttgcatgtgtaaatagttaacttgtttttattgcttagtagtagtccattgtagagacataccacaatttatttacctatttagctactgggagacattgagctgcttttagtttttggctattacaaataaagctgctatgaacattcacatgtaagtctgtatggacatatattttcttttctcttaggtaaatacctaggagtggaatgactagatgatatggtaggtatatgtttttaagaaactgtcaaactgttttctaaaatagttgtattttttatattcccaccagcagtatatgacattttcagttcttccatatctttacaaacacttggtatggttggtctacttaattttagccattctgatagtataatgatcgtggttttattttgtatttgcctaatgactaacaatgttgagcatccttttatgtacatgtttccattcatatctcttttttggtagagtatctgttaaatcttttgtctgctttttattgggttgtttttctaaattgagttttgagaattctttatatattctccatttaagtcttttatcaaatatatactttgctaagattttctccagatctgtggcttgtcctatcagtcttttaacagtgtcttttgaagagcagaaagttgtaattttgacgaagtccagtttatcaatttgttttttaacagatcatgcttttggtattgtatctaataaatctttgcctaacccaggatcacacaaagatttctttctgtttctttctagaagttttgtagttttatgttttacatttaggtctataattcattttgtattaatttttatatgtggtgtgaaatatggaacttacttctttattgtgcttacacgtggtcccaattgttctagaaccatttttagaaatgctgttcttttcttcattgcgttgccacacctctcatcttttgtcaaaaatcagttgtttaagctgagtgcagtagcatacactgtagtcccagctattcaggtggctgaggtggggtgggtgggtgaaaactgcttgagcccaggagttggagtccagccagggcagcatagcaagaacctgtttctaaaaaacaagcaaacaaaaatgcctcaagttgtttgtataagtgtgagtttatttttggactctattatgatacgctgatctatctgtctgtctttatgccagtaccatgctattttgattaccatagaattataataattctttcaatcaggtagtgttagccctccaactttgttctttttcaagttattttggctgtttcaggtccttgaataaacctgtcaatttctacaaaaaagcctggtgggattttgaataggattgcattgaatctatagatgagtttgagagaactgacatcttcaaaatactgatgttctttcaacccataaacaaagtacatctctccatttatttaagagatacactttctctgggtactattttttggtctttcacatttagaactttcacatcttttgtcagatttatcactaagtagttcatagttttttatgctgttgtatatggtattttttaaaatcatggtaaaatacatataacaaaatttactatgtaaatggtattttaaaataatttctgattgttgcttatatacagaaatgtaattgatttttatatattgattttatattctagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcggctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctattttggttactgtagccttgtagtatagtttgaagtcaggtagcgtgatgcctccggctttgttcttttggcttaggattgacttggcgatgcgggctcttttttggttccatatgaactttaaagtagtttaaactaaaaatgtatattctatgaagtgctaaactcatttagtagatttcatcacatttttttccatagacagtcatgtttatctgccaataaagacagttttacttcatttccaatctgatgctttttttttctttttcttgcctgattgccttggatagtatttctagtacagtgttgaagagaaatgaggtgagcagatatccatgtttcatttctaatctttttttttttttgagtcggagtctcgccctgtcgcctaggctggagtgcagtggcatgatcttggctcactgcaagctccgcctcctgggttcacaccattctcccgcctcagcctcccgagtagctgggactacaggtgcccaccactgcacccagctaattttttatttttatttttagtagagacggggtttcaccgtgttagccaggatggtctcgatctcctgacctcgtgatctgcccgcctcggcctcccaaagtgccaggattacaggcgtgagccactgtgcctggctgtttctgatcttagaaaacattcagtctttcaccataaaatataatgttgggccagatgcggtggcttatgcctgtaatcccagcactttgggaggctgaggtgggtggatcacgaggtcaggagtttgagaccagcctggccaacattgtgaaacctcatctctactaaaaatacaaaaattagctggttgtggtggcgggcgcctgtaatcccagctacttgggaggctgaggcaggagaatcgcttgaacccaggaggcggaggttgcagtgagccaagattgtgccactgcactccagtctgggcaacagagtgagacactgtctcggaaaaataaataaataaaataaaataacaaaattatatatatatataatgttggctgtgggttttttgtagtgcctctctactcctagtttgctgagagcctttatcaggcatagatactggattttatcaaaggagttttctgtgtctattgagatgattgcatggtttttctgtttgtttgttaatttgataaattacagtgactgagttttgagtgtaaagctaaccctgcattcttgggataaatccccttggtcataatgtattatcctttcactgtattgttggattagatttgctaaaattttgttttaaatttttatgtctttgttcatgaaggatactggtttgtagctttcttaaaatgtctttgtttttggtatcaggataatgtttgtctcataggatgaattatgaagtattcctcaagtttttttgaagagttcatgtagaattggtattattttttcttaaatatttgatagaattcagcagtgaagctaactgagcttagagttttctttgtgggaaggtttttaattatagtgtcaatttctttaataggtataaggctgttcaggttatctatttcttgagtgagcttaggtactttgtgtctttcaagaaatttgtctatttcacctgtgttgtcaaatttactggtatatgttaataaaattgccttattttaatgtctgtaaaatcagtaataatgtctcattactgatcttaataatttgtgtcttcttttctttactgattggtcttattagatctttgttaattttacagaaccagtgtttggttttattgatttttctctggtttctatttcattgatttccactttgatctgtattattttctttcatctgctactttggatatcatttgctcttttattttttagtttggtaaggtgaaaactaaggtcaccagtatgagacctttcttcttttctaatacagaatttagtgctgtaaatctcccttaactactgctttagaggcatgtcccaaattctggtgtattgtgtttttttttttttttcctcttttccaactgatttattagtagcgcagacgaataaaaatacctagagtgaagacacaattaatggcaaatgttctcctattactttttttcctgatataatcttcaataacttagtatcccttaataatatgttctaatttgagagattctttttgccctggaaatgcatacctttaaaatctgttttagaccttagatccatccgttattggtttatcattatattggatgaaatgttgtgcttttttttttgacttagctcaaaatattttatatttcctttttgacatctttagttcacaagttatttagaagcaagttatttagtttccaaacatttggagattttttttagacttttttagttattgatctctaatttaattccattgtgatctgagatcatactttatgtgacttgaagcctttaaaaaattttaagatttttttctttcatgtcctaggacatggtctatcttgttaaatatcccatgtgcacttgtatgtgttctgttgggtggagagttctataaatgtcaatcaggtctgtttttgttgttttgcttttttttttttttttcaacttttaagttccagggtacatgtgcaggatgtgcaggtttgttatataggtaaatgtgtgccatggtggttttctgcacagataacccgtcacctaggtgtttagccctgcagccattagctgttcttcctgatgctttcgctcctcccactcccctgacaatgtatgttgttccccctgatgtgtctgtgtgttctcatcgttgagctctcacttgcaagtgagaacatgcactgtttggttttccattcttgcgtgaatttgctgaggataacagcttccaactctattcatgtccctgcaaaggacatgatctcgttccttttcatgggtgcatagtattccatggtatatatataccacattttctttatgcagtctttcattgatgggcatttgggttgattccatgtctttgctattgtgaatagtgctgcagtgaacatacatgtgcatttatctttataatagaatggtttatattcctttgggtgtatacccagtaatgagattgctgggtcaaatggtatttctgcttctagatctttgaggaatcaccacagtgtcttccacaatggtgaactaatttgcattcccaccaacagtgtaaaagtgttcctttttctctgcaaccttgccagcatctgttgtttcttgactttttagtaattgccattctgactggtatgagatggtatctcattgtggttttgatttgcatttctctaatgatcagtgacgttgagcttttttcatatgtttgttggtcgcatgaatatcttcttttgagaagtatctgttcatgtcttttgcccactttttaatggggttgtttattttttctttgtatatttgtttaagttccttgaggactctggatattagacctttgtcagatggatagattgcaaacattttctcccattctgtaccattcaggacataggcacaggcaaaagtttcatgatgaaaatgccaaaagcaaatgcaacacaagcaaaaactgacaaatgggatctaattaaagagcctctgtatagcaaaagtaactatcatcggagtgaacaggcaacctacagagtgggagaaaatcaggtcatgttggttgatggtattgttcaagtctacatatctttatcaattttccacctacttgttctatctttttcctttcttttctttctttctttcttttttttttttgagatggagtctcgctctgttgcccaggctagagtgcagtagcatgatctcggctcactgcaacctccgcctcctgggttcaggcaattctcctgcctcagcctcctgagtagctggaattacaggtgtgtcccaccatccctggctagtttttggatttttagtagagacagggtttcaccatgttgactggtctcgaactcctgacctcaagtgatctgccttcctcaacctcacaaagtactggaattacaggcgtgagccactgcatccagcctgcatacttgttctatcaattgttagagaggagtatttaagtttccagttataactgtggatttgcctatttttccttgtagtttctggttcacgtattttgaagctctgttactaggtgcataaagatttaggatgattatttcttagtgattaactgaccccttcaacattatgaaatgaactgctttatccttcgtggtaatctttgctctgaaatctactttgataaaaatatagctgtcttttgactgttgttagtttggaatgtctttttccatccctctacatttaatctatttgtatttttatatttaaagtacatttcctgtaggtgcatatagttgggtcctatatatatatatgtatattttgcaatgtgacaatatctgttaattgcattatttagaccatttacgtttggtgtgattattaatatgattaatcaaatatgattgatatgattattaatataagataatttaggttagtccattttcttgctatttgttttccgtttgtcccatctgttctttaattccttttcctaccttttctgctttcttttgggttaattcagtattttttataattcaattgtattttctttgttggcttattagatataactggtattttagtggttgctttaggagataaaagatatgtatctttaactcatcacagtcttttttttttttttgagacagagtcttgctttgtaacccaggctggagtgcagtggtgtgatcttggcttactgcaacctctgtctcttgggttcaagagattctcgtgccccagcctcctgagtagctggaataacaggtgcatgccactacgcccagctaatttttgtatttttaatagagatggggttttgccatgttggtcaggctggtctcgaactcctgacttcaggtgatccgcctacctcggcttcccaaagtactggtgttacagatctgagccactgcactgggcctactttcaagatatattataacatgtcacatgtagtataagaagcttccagtagcacatataccctaaaacttaaagtataataataaaaaaaaaaagaagcttccagtagtgtattttcatttccctctctcaagcttagattttaatccttgcactgtggcttggaaattcaaggccataagctggggcaattgtataacttccctcatttgtttcctatctctcaagagtcattgtcctttgtaggctgatgtccagtgtcctgaaaaccattatttcatatatgttgtcttttttgggaggggtaattttaattcaggagggagggtaaattccatctctggtacttcagcttaccctgaaacagaagtgtcagctgaatcttcttttgcttgggccgttgttcttcatataccattattcttggcccagcctagctctactgctatgtatctttcacttggttccagatctgacgaggtctttgcttacatttttcagagttttcccatttttctctcatacatgaaacaaacaagttagggcatcaaatttctgggtgtaagaaatattctcaaatggaagttggagaaataaagatactgttaaaaatgttacaagtaaatacctgtatagcaataaatagtaatcatgttattttgaaagaataaatactggctttcctattggtcggataacccttcagcttgtgtaggagtagcgataagcttagatcacaactgctgtctcatttgagactcaacagaataagatatccaaagcttagtaatttttgatgaaaaaaaattatagaaaatgttggctctgtgtggtgactcatgcctgcaattccagccctgtgagaggatcacttgagccccagaggttgaggctacagtgagctatggtcatgccactgtacttcagcctgggtgacagaatgaaaccctatctctgaaaaaaagaaagaagctgggcgtggtggctcatgtctgtaatcccatcactttgggaggctgaggcaggtggatcacaaggtcaggagttcaagatcagcttggccaacatggtgcaaccccgtctctactaaaaatacaaaaattagctgggcatggtggcgggcacctgtaatcacggctactcgggaggctgaggcagataattgcttgaacccaggaggcagaggttgcagtgagctgagatcatgccactgcactccagcctgggcaacagagtaagactccatctcaaaaaaaaaaaaaaaaaaaacgaaagaaagaaaatgtcagtgatttttttttcatgtttatctgtgagatgttagtcagatgtattgaaattaaatgtccatctgtaatctcaaaatgaattaccttatctgggagaaaagagtaatatgtacacataaataaaaatctgatgatattttattttattatattgtactttttgatggtgtctcactctgttgcccaggctggagtacagtggcgtgatcttggctcactgcaacctctgcctcccaggttcaagtgattctcctgcctcagcctcccaagtagctgggtttgcaggtgcccacgatgacgcccagctaattttttgtatttttagtagagatggggtttcatcatgttggccaggctggtcttgaactcctgacctcatgtgatctgcctgcctcggccttccaaagtgctgggattacaggtgtaagccaccgtgctcagccctgatggtattttatatcttgagagtttatttatattttaatgctgtagttctctgttattccttatctacctctgtggtattggccctagaaggtagtgtttttctcctataatttatgtaaacatttctgtgttaaaaatttactgagtaccttctatatactaggcattgtgctagatgagtttagcatacaaggtccatgcttatttctctgatctacttgttttccatcattccacaccacatctcctctggaagtgcactgctttattggcagttcctaggaaatgttgttctttttcatcccatggtgctttcatatatgctgtttcctctattcatctttctcatttgttgatctgtttaaaactcaattaatcatttctttaagtcttcttccctgaaaaccacaggctaagttaggtgtcttcttctgtgttcccacagcccctatctcttcacagcccttagcacactaaatgcaaagatctgttccactgccggttttcccatcagactactggagtgcagcattttatatgattttatctcttaatacttagcacagggcctggcccagagtaggaatgcagcacacaaaaatgtgtccttgactgtttgattgtgtgatcttagataagttgtttggcctacccaacatttcatagcacctaggttctcttactactctgcagccatgctgccagacttctctaatctgtctctactaaccttgtggtttctctcttggtggtctttaatagcatgtcctgttgggccctgggagacctggtttttgcctggtagcctagtgagcctatcacatgaggcctaggccagattatttttgcaatgatggttcagggtttgataatgacatcagattagaaaatgaagacctttacctcactgtagtcccagatgagaagctgctagtgggaaccagaaggaagctacttaaagagacaattcacagttccaggtcacacactatctttaggaagggccactttggaaggatttgatagctgccttggagtgctgttattcagagcagaccaataagaagctgggttttgtgatgccttttctgattctgtcagtcactcctttctctgtgctcccacatcaccttatatatccctgtgacctagcatttatcacactatattatattcatttgtttccttgtatattcccctctctagaagagagcccttgaggctggagttcatgcatattcacctctgtgctggttaactcaccctttacctgctagagtagaagccaataaaagcttagtgaatgaatgaataaatgaatggcgataataattatagatgattttttttacacttatagtatgctaggagcttccctttactacatttttatgatgtgaaaactctgattttcatcattttggtggtgaaaaaaatgaggcacaaaatattaagtaatttgcccatggtcttacatctagtaagtggcagattgcaaattcaaatcaagacacctggtttcaaagttcacattcttctttttttttttgagatgggatctttgctatcactcagggtggagtggtgcaatcttggctcactctagcctcaactccaggtgatcctcccacctcagcctcccaagtagctgggactacaggtgcgcgccatcacacacagctaattttattttttgtagagacgaggtctcactttgttgcccaggctggtcttgaactcctggcctcaagtgatcctcctgccttggcatcccaaagtattaggattataggtgtgagccaccgtgcttggccaaagctcacattcttaaccactgtgctatatctgactagctgactaaaggctaagtgaccaactaactaacagctgtgtgaaggaggggcaaagaaagtactggcaaccttcctgccagacctcattctcttgagatgtggatttgaaaccacaaaagtagatgagggcttcgtctggaggcaccacaggtccattatgggaaagagatactgattcgggaatccatttactattattccttccctgccaagagaaaagattggccaaggccaagtgtttgccctggcacatccctggatgtattgctatagctcaagtgctagggagtatactgttccttctgcctggtatgcccttcccccaaatgtccacatgcctcataccttttatttcattttctgctcaaatatcacttcatcagagaggccttccctaatctgacctaatacaatataggactattttttatccccttaaccccttatggcttaattgttctttattatacttatcaccatctgacatataattatttgtttatagtgttttattttgtctccctccaccaaaatataagcaccatgggatctgtgactgttttgtgtattgttgtatctttactcctagagtggtgcctggcaagtagtagctgctcaataaatgttttttccccctaatgaatatattattttggagtttgagaccacttgttttcaaggacctttgtcatttggtgtcagcaatacctcattctccttgaccctatatataactcttggactccagacaaactagagtcagtgttctctgagcatgcttcacatcttatagctctttgtctttgttcacgattctttcttctggcagatctgcatctctgtccatccagattctgaccagtccttaatatctacccctttttgaatgaaggtacatatgaagaaaaagttactactgagtttgtattaaatcctaggcatctcaaacacattaactcatttaattcaacaactctgggagacagatattgctaaattgtaagctacatgggagtagggatctctctcttgatcaccgctctattcctagtgcctggtctcagaatagaacgaaataaatgcttgttgaatagcaaaatgaatattttacagaaggggaaattgaggttcataatggttaagtgatttacgcaagctagttcatggcagataggataggcaaggtcttccagcttcaaattcagtgtttttttgtaatatatcctaaaataaaaaatcagtgttctaaaatgccaggggtttggcagtctttaataactttagtttttgtagctacctcagaataaaacaggaggttttattgatttttacatgaaaattgttcttaatcataaaaggtctgttcctttctataaaacatagtatggagaccagggtatatctttactacccaagatgctaactggacaccagtttctgggattctttgtggatatgtgtcattagtactttttaatttttttatacctcccccctttacctccgtaagtagtctgtgggggtaagtgatacttttttgtgagaaaacataatataaatactgatgggatggacaacaagtgatccaggacccacagattgccatcatttgttcattcgaagaagatactagaggtggtatttatgttgtacttatttttatctcattgtttaatttttatgtgtgttttacaatctatctaatgttagtaaatgaatctaatttataaacacatatacgtatattggcaatgtgtgtacaaagctttttttttacaggtagattatgtcattaaaaagattggagatggctgggcgtggtggctcatgcttgtaatcccagcactttgggaggccaaagtgggcggatcacgaggtcaggagattgagaccatcctggccaacatggtgaaaccctgtctctactaaaaatacaaaaattagctgggcgtggtggcacgtgcctgtaatcccagctactcgggaggctgaggcaggagaatcgcttgaacctgggaggcggaggttgcagtgagctgagattgtaccattgcactccagcctagcgacatagtagactccgcctcaaaaaaaaagaaaaaaaagataggagttaagtcaccctgtgtgtctctcttgtgaaggatggtttgttgtgtagaactccaggggttagccttctctgattcggtgtagcattgtttgtcattttgcccagaggtgtagtctttgatctggctaggggccacatggacaggctcaggggatgggagacttatgacattaggacattgactcttgcttgcatgtcctcctgggatttggacatatgagtcatttggagtctgtatctgtactaagctctccttgccaaattctgcagcctgtcactgatagccacagctctctgtacttgctgttgccttcttcctcactctggcccagggattcttcctatcttctctttggaatggaaaacagaacaagacttttaacttttaggtgcttgaaccttggggacagggagccctgatatatcagctggtctgttgaatgagatcttcatgctggaactcagggttgctatctgagatacagatgttatagaggatacagctcatcctggcttgttttgttcagactatagtgactccaggtggacaccatgctgccaaaccctacctagatagggcatctgcctaggtaacagaatgatatatgcagataaaaacaacaacaacaaacaaaccaaaacaatcttgaggtttggtctgacatgctgaagctattctccttttcccctacagcttagctatgtaggagcgattattctagagtccatcttcagtggagtgtattggcccccttggcaaccccgtgcctcacttaatgcagtgtttagagcagtggttctcagctgggggcagtttttcccttccatgggatgttgaacaatatctggagacattttttaattgtcatgattggcagcatgttactggcatctatgttgttaaacatcctgcaatgcacaggacagcctccacaacgaaggattatctcatctaaaatgtcattggggcagaggctcagaaactctggtctagagtgacttctgcctgtcaccactgtggtgtagggtgctgatagaggagtttctgcatgccaagattctatgcccagacttgtatcaaggcatcctcccagtagacaaaaggcccttgatgtactgctggcctcaggccttctagcaataaaaaagtagccttctttccactacactccaagcagaaaggcccctttgtgctggatgaggtcgacttcccttggcagcagtggcaggagtgtgttgttctctgtactttacaggctagcacttgtctgtctgccttatatctgtgtgtcactctcttatgccttcattacctgacactccagaccatagtaaatgataacatctgcaatgcgttaggatatatattcattttcaggaataatacgttctagtccatttaacttccatcagcattttttttttttttgagtcagggtcttgctctgtcacccaggctggagtacagtgttgcaatctcagctcactgcaacctctgccttccaggcttacgtgatcctcccacctcagcctcctgagtagctaggactataggcatgtactaccacacctggctaattttttaatatttttttgtagagatgggttttgtcatatttcccaggttggccttgaatttctgggctcaggcgatccacctgtctcagcctccctatgtgctgggattatagtcatgagccaccaagtccatccctcaacacttctttttttttttttttttttttgagacgaagttttgctctgttgcccaggctggagtgcagtggtgagatctcagctcactgcagccctccgcctcccaggttcaagtgatccttccacctcagcctcccgagtagctgggattacaggcacgtgacaccatgcccagctaatttttgtatttttagtagagacagggtttcaccatgttggccagggtggtctcgaactctcctgacctcaaagtgatccacccacctcggcctcccaaagtgctgggattacaggcgtgagctacctttttttttttttttttttttttttgagacagcctcagtctgtcgcccaggctggagtgcagtggtgcgatctcagctcactgcaacctctgcctcctgggttccagtgattctcatgccttagcctcccaagtagctgggatcacaggcacgcaccacccctcaacactaatttaaccccagctctgtcatccttcttttctcaacggtatctcttggaaattaatttatctttttcttccaacatattctagtctgggaattagaaatataaccaagcactgactaagcacccttcacttaagcttctagtatcttgtctcctaggatgcattcctggacacactgtgtctgcctcatttccttcccctgccacctttcccttctcacctcccatgcctctgcaaatagtctaatcttcccccaaaggcactcagcttcagagctttccttctgaactccagcatcttcttgaggacattaagagattggagcattcttgccttcaactttattttattcaggatgtctccctgattatctgctttgcatcacatcctgggctgagaggaatgcctgattttgtttgttttgttttctttgtttttgagacagggtctcgttctgctgcccaggctggagtgcaatggtgcagttatggctcactgcaaccttgaactcctgggctcaagttatcctcccacttcatcctcctaagtagctgggactacaggcatgtgccattaggcctggctaatttttttatttttcttttgtagagttggagtctgctgtgttgcttaggttcgtctcaaactcctggcctcaagtgatcctcctgcctcagcctcccaaagtgctgggattataggcatgagccaccatgtctggccaaatgcctgttttttgacaagcatttcagaagttacttatccacgtgagctgtatgtttttctaaggaggttttgttgttgttgttttgaggcccacatcaaatcatttctggaacccctcatttagagtagttcttattgatgccactgtatatgaagctcttagttcagaaacagtggatgagcaaaaatgaacaggacacattccgtgccttcaatgttttctgcctattaaagggaaattagaccaggtctgatggctcatgcctataatcttatcactttgggaggctgaggctggaggactgccagaggccaggagttctagaccagcctgggcagcattgggagaccccatctctacaacaagtaaaagaatttgaccaggcacagtagctcacgtctgtaatcccagcactttgtgaggccaaggtgggaggatcacttgaggccaggagtctgagaccaacctggacaacatggtgaaaccccatctgtactgaaaatacagaaattaactgggtgtggcggcatgtgtctgtaatcccagctactccagaggctgaggcaggagaattacatgaacctgggaggcggaggcttcagtgagctgagatcgtgccactgcaccccagcctgggtggcagagcaagaccctttttcaaacaaaacaaaacaaaacaaaacaaagacaaagacaaagacaaaaaaagagttagcctagcatggtagtagtacatgcctgtagtcttagctactcaggaagctgaggcaggaggatctcttgagcccaggagttcaaggctgcagtgagctgtgaccatgccactgcactcaagcctcggtggcagagcaagacctgtctctcttttttttttttttttgagatggagtctcactctgtcacccaggctggagtgccatggcgtgatctcagctcactgcaacctccgcctcccaggttcgagtgattcttctgcctcagcctcccaagtagctggaactgaaggtgcgtgccaccacgccccgctaatttttttgtatttttagtagagacagggtttcagcatgttggccaggatgatctcgatcccctgacctcatgatctgcccacctcagcctcccaaagtgttgggattacaggtgttgagccaccgtgcctggccaagacctgtgtcttcaaagaaaaaagatatggatcttatgagaggacagtgatgaatctcaccgtatcattcaacttcaaaacttttttggcttcttgctgcttacagcagtggttttcaaacttgaagaatgtacaaattccttttaaggtaaataatacatcttggacctgcagtgctgacttaaattatttttattataatgttatttaagtatatacaaacatagaacaaagtttaagtcactgtgtaaaatttgtatataagtgtaaacaaaaacagatttatactttaagtaaaaataaacttcagatccaataaaatgatgcttttttgctgaaaatcagttgcttccaggctctttttaagttcagcatatctgtattgctgggtaccatgtgatgactcattcctcccaccatttttctttatttaagctaccatgaaactttgattcatgatctcatttgaccttcactgggctggaactattccttgtgtattgtgtattaagtctacttctattccttcataattgacttttaacaaagtatagagataaatttgctttctgtgtgtttaaacacaatacagatataaaaattattattattattattaattttttttttgagacagagtctcgctctgtcgcccaggctggagtgcagtggcacgatctcagctcgctgcaacctccacctcccgagttcaagcaattctcctaccttagcctcctgagtagctgagattataggtgcccgccaccacgcccagttaatttttgttcttttagtagagatggggtttcaccatgttggccaggctggtcttgaactcctgacctcaggtgatctgcccgcctcggcctcccaaagtgctgggattacaggcgtaagccactgcacctggcctataaattattttaaaagggtactttttatgactattcattaaaaacatcacattataatattgaggaatcactagctctagtgctccacgtatggtgatgatgcaatttgccatgttgcaaatgaccattcagttgtttcagttagagttggttcctgttatgacagaaaatcctttcaatctgatataagcaaaagggagaatgtacttcttgcacaaaactgaaatatctatgaataggactttctacaggcattatctgactcagggcttaaattatatcagctggattttttttttttttttttgagacaggctctcactctgttgcccaagctggagtgcaatggcatgatcgcggcttattgcaacctcgacctccgaggctcaagccatcctcccacctcagcctcctgagtagctgggaccacaggttcacatcaccacacctggctaatttttttttttattttttgtagatatgtggtctccctatgttgccctgactgatctcaaacccctgagttcaagtgatcctcctgcctcagtctcccaaagtgctgggattataggcgtgagtcactgtgcctggcctgtcatctggatcttgactcagcttttcctctgtatgaaggcttccagcagcatcagggaggttgtatacacaacccccctgcccaaacacacacacacacacacacacacacacacacacacacacacacacacatgcttagaacgtgaatgatggagccagactgcctgagaccaaatcttggctttcccagttcctagctgggtaactttgggaaagttatataagcttgctgtgctttagtttcttcatccttaaaatggggataaaatgggatatctacttcatatgaaaatgatgaagattagtgagttaatatatgtgaggtacttagaacaatactctcatagactaagcgctatgtaagagatggcttctattactattattattattgttgttgttattaacattatagttcaggttcattttatcccagacaccagtatagtggaaaagcaagcatatcccctatgggccaaacaaaaattttagaattcagtttcttcagccttgatttgggttatgtactcatccctgaactaagcactatgggcagaaagatggaatgtattgattggtttagcttgggttacatactctacttttaaaggctgatttagctttacctgaagcatattagctgagagcaagggaggagtggttctgttcatacaaattcagaatactgttgccaccaaaaagggaagtggatgcttggtggcaaaagtgaaccatgttcattatagtgctatcagatagatcgtaataggtgatcctgttatactacattagtctctctggggatgcaccaattgggacagttcttgtctgaattaaactaaaagacagtttatatcttttagtgggtaatatttgtctttttgaattgcaattatgaatgtatattttgtgtaaaaacatcagtttgacctctgggttcttttgtattaaaatatttaaatttgagatatattattgttatgaagtacattatgtcctaaaattccaggaaaatacagttgagccttaacaacacaggggttaggggtgctgactgtcccttttcccccatgtagtcagaaatccacttgcaacttttgactccctcaaaattgaactattaatagcttgttgaccagaagacttaccaataacataaacagcctattaacacatattttatatgttatatgtattatatactgtattcttacaataaagtaagagaagaggaaatgttattaagataatcataaggaagagaaaatatatttactgtttattaagtggaagtggatcatcataaaggttttcatcctcatcttcacattgagtgggctgaggaggaggaggaagaagagagattagtcttgctgtctcaggggtggcagaggcagaaaagatagagaaggtaggaagggaggtgggagaagcaggcacactcagtataccttttattgaaaaaaaaatccatgtataaaattcatgtataaatggacccaggaagttaaaacctgcattgtttaaaggtgaacggtgtcactgtaactattttgcatcaacacacttataaacacaaatgcaacatgagcactgaagttgagagcctgtattcttatatatctagatgatacagaataaacttttgctttttacttttagcttatttccaaaatataaatatagaatcaaaacactttaatggtaaattgtcttttttttttttttgagatggagtattgctctgtcactcaggctggagtgcagtgacgcaatctcggctcactgcaacctctgcttcccgagttcaagcgattttcctgcctcagcctcccgagtagctgggactacaggcatgcaccaccacgcctggctaatttctgtgtttttaatagagacgaggtttcaccatgttggccaggatggtcttgaactcttgaggtcagatgatccacctgccttcgcctcccaaagtgctgggattacagtcatgaaccactgcctggccataaattatctttttttatctgttttgcaacagtctcactccgtcactcaggctagagtgcagtggcgtgatcatggctctctgcaggctcaatctcccaggctcaagtgatcctcccacctcagcctcctgaggagctgggactctaggtgtgcaccaccacacctggctaattgtccctgtttgcagatgacatgattgtatgtttagaaaaccccatcgtctcagcccaaaatctccttaagctgataagcaacttcagcaaagtctcaggatacaaaatcaatgtgcaaaaatcataagcattcctatacatcaagaacagacaaacagagagccaaatcatgagtgaactcccattcacaattgcttcaaagagaataaaatacctaggaatccaacttacaagggatgtgaagcacctcttcaaggagaactacaaaccactgctcaatgagataaaagaggacacaaacaaatggaagaacattccatgctcatggataggaaaaatcaatatcgtgaaaatggccatattgcccaaggtaatttatagattcagtgccatgcccatcaagctaccaatgaattttttcacagaattggaaaaaactactttaaagttcatatggaaccaaaaaagagcctaagccaaaagaacaaagctggaggcatcatgctacctgacttcaaactatactacaaggctacagtaaccaaaacagcatggtaccggtaccaaaacagagatctagaccaatggagcagaacagagccctcagaaataataccacacatctgtaaccatctgatctttgacaaacctgacaaaaacaagaaatggggaaaggattccctatttaataaatggtgttgggaaaactggctagccatatgtagaaagctgaaactggatcccttccttacaccttatacaaaaattaattcaagatggattaaaaacttacatgttagacctaaaaccatgaaaaccctagaagaaaacctaggcaataccattcaggacataggcatgggcaaggacttcatgtctaaaacaccaaaagcaatggcaacaaaagccaaaatggacaaatggagtctaattaaactaaagagcttctgctcagcagaagaaactaccatcagagtgaacaggcaacctacagaatgggagaaaagttttgcaatatactcatctgacaaagggctaatatccagaatctacaaagaactcaaacaaagttacaagaaaaaaccccatcaaaaagtaggcgaaggatatgaacagacacttctcaaaagaagacatttatgcagccaacagacacatggaaaaatgctcatcgtcactggccatcagagaaatgcaaatcaaaaccgcaatgagataccatctcacaccagttagaatggtgatcattaaaaagtcaggaaacaacaggtgctggagaggacgtggagaaataggaacccttttacactgttggtgggactgtaaactagtttaaccattgtggaagacagtgtggtgattcctcaaggatctagaactagaaataccatttgacccagccatcccattactgggtatatacccaaaggattataaatcatgctgctataaagacacatgcacacgtgtgtttattgcagcactattcaaaatagcaaagacttggaaccaacccaaatgtccatcaacgatagattggattaagaagatgtggcacatatacaccatggaatactatgcagccataaaaaaggatgaattcatgtcctttgtagggacatggatgaagctggaaaccatcattctcagcaaaatatcgcaagaacaaaaaaccaaacaccgcatgttctcactcataggtgggaattgaacagtgagaacacttggacacaggaaggggaacatcacacactgaggcctgttgtggggtggggggaagggggagagatagcattaggagatatacctaatgtaaatgacaagttaatgggtgcagcacaccaacatggcacatgtatagatatgtaaaaaacctgcacattgtgcacatgtaccctagaacttaaagtataataaaataaaaaaaagaaagaaagaaaaaccaggcgaccaaatagaaaaaaaaaaattttaatagagacagggtctcactgtattgcccaggctggtcttgaattctggagttcaagcaatctcccgccttagcctctcaaagtgctggaattacaggtgtgagctaccatgcccggcctatattagattatcttgaccagtgctgtctaacagaactttctacaatgatggaaatgttgtatagtttatgctgtccaatatggtaggcactagccacatctagctattgggcacttgaagtgtggctagtgccatcgagcaactgaattcttaatttatttaattttaataaatttaaattgccactgtggctactggctactactgcttggacagtgcagctctgaataacatcaaataagagaatggctataaagtgcccagtgtgctctatactaagcacacagtagatgtgagaggaggagaggtctatagattctgtcctgaaaagggttgggcctcacctaactggccagagcaacctgagttaggcttatcccaggacaatactagtagctatcttagcatggtagtcaagactctttgtgacatggcttcaaccttcttctgccactacctgccatatattctatattctagaccaggggtccccaacccctgggccacggacctgtgtcagtccatggcccgttagggactgggctgcacagcaggagatgagtggtgggtgagggagtattactgcctgaactccaccttttgtcagatcagcagtggcattagatcctcataggagtgcgaaccctattatgaactgcacatgtgagggatctaggttacgtgcttcttatgagaatctcactgatgcctgatgatctaggtggaacagtttcatgctgaaaccatctccctgcccaggtccatggaaaaatcatcttccatgaaaccagtccctcatgccaaaaaggttggggactgctgtttcacacacatcaaatttcacatcttttcttttgcacctgtcttcattctgtattgagtgccctcctctccccacacccatgaaatatttgagataagcttctactaatcctttatgttgcaatacatcatcttctctgaggctgtccctgaagccctaggcagttatttcctttcttctctgtgccgtatgtatttttctcatcagaatctgtgcttcactcatgctgtttagcttttgatctcttccactggattgggaactaacttcctccaggcttggcactaagtagtccccttatgaatgctcagttgaatagctggacgaatggatggatggataattgattctcaaccctggtcacaacagtttaaaaatattccaaaatcaaatttattgagttataatttacataaaagaagatacacctattttaaatgtacagtttgatgcattttgacagatgttatcatttgtgtaaccaccaccacattcaagatatagaatatatccatcaccttataatgttgcatttgtgattttttcccagtcagtccccagctcccttcctggctccagctaaccattgatctgctttctatcactatagatttgtcttttctaggatttcatataaatagactcacagtgtatactcctttcatacttagtattttatgggacagatagatattaaacacacaaatgtggtaaatattaaggtcagcatgacaacaaatgaaagcagtgcttggcattctagagtcatggctttgcttgtctcttttcacagtatacaattggaccgtggatgaggtggtacagtggctgatcacatatgtggagctgcctcagtatgaggagaccttccggaagctgcagctcagtggccatgccatgccaaggtcaggaggggactgggtttttctctgttgagggtacggggaatgggctggagtgggcctgccttcagattgctctggccagttaagtgaggttctgcctttttcagggcagcgtctatagatcttgcctcttctcacatctgttgtgcacttgctataaagtatgatgggcgctttgtatccactctcttctttaatattcctgtcagtcctgggaatagtactgatagctgccatttactgagtgcttagtacatgccaggcattctactcaacactgtatacagtatctcatttaattcttacatcagtcctgtaaggtgggtattattgtatatagatgatgaaactggttaagtaacttatccaaggtcacaaacatgactagttaggggcaaaactgagatttgaatcttggtgtacatcaaaccctgttggtgtttcttttttctttttttcctgtgccctgagcagctgcctcttttatcacccgggagcctcagggctcttttagcctcccctgggttatccatatacagcttatttataataaaaatggtacagaggagaggctgattgccattggccccagcctcatctctgggatggctccaacagctgttgtttcataactctttgcctactttacacgctgaatatgctagggcttgggctgggagtgggaaggggatggagtactgcttggacttcttgtcatgtcaaactagtgccatatgccattcagtcattaatccatttacttattcatccaacaaatatttactgggtacctgctctgtgccaagcacttgtgctgggtgctagggataaagatgacaacaagctgtccttgccctcaaagggcttactatctggtaagtgctgattatgtataatctgtcatcttattatgtaggtgcatctggttttgagcttcagcaaaggggaaaggggaaggtgaagctgttggaatgcccacactttgcagtctccagccacagagctactgagcactgctgtccaggcctagctgagctggctgttccctcctctgctgcctgcagcctcttcttcacagcttctctctgctctggagagagtaataatcttaatgtttgtacctccctttatagagtgctttcctacatattatttcagttgattctcacaactctgggaggaagagtatcccaacctttgggtgaacaaactgaatctcaaatattttataatttatccaagctggtaagtggcagagctgggatttgaacccaggtctgtcttgttctaaatgccctgctttttttcactgcatcttcctcttgtgccatgtggttaaagataggcttcctttcaatattcagtttagttctattttacaaaacttcactaagcacctaccatgtgccatactctctggtgggcccagaggacaaagagatgtattagacctgacccctgacttgaggaactccatgtttaatggaaaagtagatgactgaccactaagatccaggatttaggtttctttcttgctacccatagaaatagcaatattgccttgtggatccctggaccattttcctcatgggaaggatatctttggcttggattaaaactgcaaagcataggataagaagtcagttctcaggtcactggttcacttagcttttttgtggctagaattacagccaagaccaggtccagccaggctgggcacaggtgtaggggatgtcaagctgtggcaccttagtgacagcaggaagcatggggccttcagtgcttggggtgaagtgagggtggttctaggcccatcactagctcacatggtataatgagaataatctagcagatttgagttcattctctggctttgccacttacttgtgtgtgactttgggcaagttactcaactctaagtctccattttcttatctagaaagtcgcactaggccgggtgcagtggctcacacctgtaatcccagcactttgggaggccaaggtgggtggatcacgaggtcaggtgatcgagactatcctggctaacatggtgaaaccccgtctctactaaaaatacaaaaaattagccaggcgtggtggcaggtgcctgtagtcccagctactcgggaggctgaggcaggagaatggcgtgaacccgggaggtggagcttgcagtgagctgagatcgcgccactgcactccagcctaagcgacagagcgagactccgtctcaaaaaaaaaaaaaaaaagaaagtgacactaataatggaactgagttcttaaggttgttgtgaggactgaatgaggtattgtatgtaaagtatcagaacagtagcagacacacagtagttgcttagtcagtgttagctcctttctcatttctttcattgcttacaagtagatagcattccagttcataggtttctttgagaaatagactgtagaaaagacgacaatgtttattctcattagtcagacgaactgcagcacaagtgtttcaaagaggaaccccaagaactcccaggcttgtaggaagcatctgattttacataagtttgcacagtaggaaactgaggtcctcggggaggaacaaagcaacttatgatcagacaaatgagtcactagtagagctgaaatgagaagccagatctcctaaccactcccacaccccatcacagtgcctcactgcgtctcttactggtgggcttgattgctttccaaggccagagaaggaagtagctgttcctgtatgctcagacaggagtataaatcacactgtgatgtcagaagcttcttttctagctggagaaataaagctatgcatcagaaaagagcaccaatcttatagagtagtatagaattaagtgcttacttgtgggacctagaccagtggttttcaacctttcatatcttttacccccctcctcttatatccactgtgttccagcagaagagaaacaaagttccatttttcctaggtcattttcttgttcacaggctttctcttattaaagttatcactgacagtatgggtggaggtcataaaaaattacagtaattttattggaggtaacttgtattgcagtgactcaaatacaagctaacaggactaattccatttttgtcatcagtggttaattaaaattttttttccttttctatatttcatttcaatagcacattagcaggtttatatataatgacagtgagtttagattaggataattcataaatcccagaatcactgggtcatatgacatgacagtttgacctgggctgcacaggaaatgcatttataaatggtaggaggtggggaaaatatgtagaggataaaccctggaaggagaagcacaacagaaaatttagttgggtgtgggaatggtcacagacaggtaatccttagaggatagggtgcttagaagttggtggatatggggagagggctgaacaaattcttggtaaatgttatgtgtctctccatataccctgttgagacccaactggtatagactctgtgttctagagtgcagaggggagcaatcaccaagagctagaagtgttcctgggggaggcgggtaatcctaccaggatccttcctggctttactgggagggaactgatctgctactctttgcctcaacaggctggctgtcaccaacaccaccatgacagggactgtgctgaagatgacagaccggagtcatcggcagaagctgcagctgaaggctctggatacagtgctctttgggcctcctctctgtgagtcttgtgttgagaagggctactgctgtgccatggaaaccaaagctgttgtagtggataggctaaggctaaggctctgggtctcctaggcacacctgcaagatagcacctatactatttccactggtattaaggtatgaaagagtcttacattttagtccagacacgtagcaacatgcattcattaaatactttaaggaaatatctgcattgtgccaatgctgtgctggaccctgtaggaagacctggaatgaatcatgttctgccctgaagggacaacatgagtgttctgtagaggtacacagtacttctgaggcccagatgagggctagtgaaggtatcctatagacaaggtgacatgttacctctgcctttaagggtggatagagctttattctatggaggtggcagaataggacattctaggcagagtaaacaacctgagcaagagtacaaaagctaaaatatgaaaagtatgctcagggatagaagtaaccccctatgggctgaaagctttttacctgttacctacttctatatttcatttcaatagcatatcagcaggtttatatatatataatgacagtgggttattgtagacatgtagagtgcatgaactgattaatgaacatctttgtattattgaatgaccaaggaggactaagtgggttttcactgaagcagtagacacactcaggcctaagaaagggtggtctcttcagccagggtctagttgagagaattaggttgttcagtctctacagatctatgtggtaggaacggccagcctgtaatcctttttctaattctaagttaaccaagggggagcaaaaagtagtgagatttcttggaaaactattttcaaccaaacaggatcttagggcccacttcctgccctttgggaatggctggcctcgatttagggtgccagcagaagaatgctattgaaccaggaaacagtccagagaagcagctggcaggcaaggtcagaggccatataacatttccctgtctgtgaatatggcttggctaatgtgcaagttgatgtctcaatacaagtggatccatactttttgaaagtatgaaacagagcaacctgggagaagactaatgtttccacttcctttgccaccttttttttgggggagtggagggttctaggacacattttactcaccttcattggtaggttttgaataacgacacagtgaatggttctactctttatgtaaggcgtagtctctgtattgagcaatggccttccagtcattcactaacctttactgagcacattctatgtaccagcataatcggcagggtccctgctctccagtacttctatctaaatggagatagctatgtcaacaaatatagtaaagtgtcaacaaatatagtaagtgttatagctattatgtaagtctttccagagttcaactgggggcacaaactagggaggagtttcctattggagtccagggaaactttatggagaaagtaattcttgagctgagtcttaaaagatgagaagtggccttattaaactctccctatgttaacagcttacacatctctttgtatacaccaacaaggacacttatacccaactataaaagctaggctacttttgcagaggttctcctctgtcaccaccatgcaaggggaagctttcagcagcctgaaagtcttccttagccttgtaatatatattatcaagctttatctgtatcaaaatcagatttatcatgtctgaaaggatacagtagaaactgcaggttaaagcagtcaaggattttatctgaaaaaatcagctagcatgggaaccagaatgctggggacatggtactgggtccaggatatcagaaccaacaagaggggccctggtggagcaggttggactgataccaggacaggggtattcttctcttaggcttattgcatgtagcccatgtgctgcatgtgatctaacttaaggaaggccagagatcagcaggaaaactatcttcctgagataggcagaacacaggtactgaagctaagaatatacttcacactgactgggatacttataataataatagtttttaaaaatggaaaacttgtgttggcgagggtatagagaaattgaaaccctgtatattgctggtgagaaggtaaaacggttcagctactgtgtaaaatagtctggtggtttctcagaaattagacacagagttaccctagaacctagcaattccacacttaggtatatatgcaaagaattgaagacaagtactcaaacaagtacatgtacatgcattttcatagcagcacatgtcacaagagccaaaaaataaaacaacccaactgtctattaatagatgaatagataaatacattgtggtgcaatggaatattattcacctataaatggaatgaagttctgatacatgctacaatgtggatgaacctggaaaacattatgctaaatgaaagaagccagacacaaaagatcacatattatatgattctgttaatatgaaatgattagaatagataaatccacagagacagaatgtagactaatggttggcaggggttggtgggaggagggaatggggagaaaccgcttactggtaaaaaattttactgtagagtgatggaaatattttggaactagatagaggtagtggttgcataacatcatgaatgtgctatatgccactgaattgcttactttaaaatggttacttttatattatgtgaattttacctcaaattattttttaaaaagcatatacaacaaaagaaagaatagataaattggacttcaccaaaataaaaaagttttatacttcaaagaatgtaccaagaaagtgaaaagacaacccacaaagtggagaaagtattggcaaacatttttctgacaaggctctactatccagaatacataaaaaattcttgctaggtacggtggctcatgccagtaatcccagcactttgggaggctgaggtgggcagatcacctgaggacaggagtttgagaacagcctggccaacatggcaaaaccctgtctctactaaaaaaatacaaaaattagccgggtgtggtggcacatgactgtaatcctagctactcaggaggttgaggcataagaattgctgaaacctgggaggcagaggttgcagtgagccaagatcgtgccactgcactccagcctgggtgacagggtgagaccctctctcaaaacaaacaaacaaacaaaaaatggacaaaggatttgaacatattatttgtatagtccacagttcaatggccaatatacacctgaaacaatgctcaacatcattatcagggcaatgcaaatcaaaactacaatgaggtaacactttttacccactaggatataataaaaaagacagtaacaagtgttggtgaggatgtgttgaaattagaataatagccaaaaagtggaaacaactcaagtgtctgtcagttgatgaatggaaaaaaaatggtatatacatacaatagaatattaatcagtcactaaaaggaatgaagtactgatatatgctacaatgcggatgaaccttgaaaacatgccaagtaaaagaagccagtcacaacaggccacatattatataattttgtgagttcacttatataaaatgcccagaacacacaaatccatagagacagaaaatagattagtggtttctggggctgggggtgggggcagtgggaaataggaagtgactgctaatagatatggcatttctttttggggtaatgataatattctaacattaattttgccagtggttgcacaaccttgtgaatatagtacaatcattgaattgcccattttaagagagagacttagaattttagggtctgtgaattatatcttaataataaatatatacatgcataccttgttttattgtgctttgccttactgcacttggcagataattgcattttttacaagttgaaggtttgtggcaatcctgtgttgatcaagctgttggtaccatatttccaaaagcatgtgctcacttttgagtctctgtgtcggaatttttaagcaataagttatttttaaattaaggcacgcacactgtatttttagacataatgctattatacacttaatagactacagtatagtgtaaacataacttttatcactgggaaactaaaaaatttttgtgactcactttattgctatattagctttattgcagtggcctcaaactgaacttgcagtgtatccgaggtatgcctgaacagctttttttgtagctcctggatttttattcagacaacttgtttgaagtttggggaagaaccctgtattggcaggtgaccttggtcccttttcaaaattgccactcactgtgtgaccttgggtagtcacttttctcaggtgtgttttatgatttgtatcaggagattcctccctacagttcctttcagctgtgacattttatgatttttgggaggaacttcttcctcaataagggttctgtgtaaaagacaggaggtctgttccttcctggtgtctgcatcctgtatttttaggacttctgtgcttggtccttgccttattaagtgagctttggcaattcagttctgcctagatttgggtttccttatctgtaaaatgggtttgttcattaaaggttcttactggttctctcattcaaggattctgatagagctgggtatactcttggaagctaaggttttagaaatcagcagctgtcctgatggcaaatattgtttttatatttttctactgatgcttgtcaaaggaaatatttgaaaatcgccggctggaatctgaggaaaatactaaggagctctttgccaggagacttctgaaaggggtagggacatgcctgctgggtgtttacaaaaagtcccttgatctgtgcccctctagactttatttcccctctgagcatggactaaaaatccctatttcagttctattctttaatacccatttaggaggcctgtactggctctgacctgtattctgaacttaggatgagttcttaaggctgagtgagcagacacttagacctcatcatcagtcatttagcacacaaacaccccagagaacctagacttgttacagctgtgagctatggccaccttactgagctataataaaaattctgttattggtctgaggcttgacatatcttcaattaaaggtttgtcatgcagtagccaagagggtctgctgagggaacaggtgccatctgtccacagcagcctcagaacttgggaagagggaagagggaagagggatcagactggctcagcagagggccacctcaaggtccattttctgacagtagatggcatgcttaatcctccccatgtgaccacagagtagcacactgccctttaggatctttttcactctacagagttggctctgggtttacaggcccatctagggctcgccaaacagtaccagtttgcagatgttaggtgtgtttggagatgttaggagatgttatccatcttctacttccattagaggaaacaagatataataaagagttccagctttgaaatcaagctgaccagctctatcactcagtagctttgtgaccttggacacatttctaaggttctctgtgccccaatttgctctaaataaatggtagctactatttttaatttttaatgtgtgcctacagtgtgcttagtcctgggctaggggctagcatgccctttgtgctttcagcaggaatattgagaaaagtgcagggaggcctacagaataattgttgcgggtcaggggcagttggagataggaaaagaaaagactatgcctcatcttccttcttcattggctcagaaaataggggaaagtccccagtgagcaggagtggttgcttttctggcaaagctcactctgatctctgtacctgcatccttaccctctctctcttttctgttatggtccaatttgcccttcaagctttctccaggatgtttttccatccttttacaggcatgctcaactctttcctcttattctcctgtaggaacccacagccctttgtactttttttttttttttgataacaatatgtctctctgccttttatcctttaaactgggaactccttgatgaaagaattttgttcatctgtcatcagcacccagcttaagatctagccagaattaagtgctgggagatgtgtgctagaagttatatggaaggaggctgggcctctccagactacagaagtgaggggatttgggagaagaatctggcccagcttggttttggggagaaatgctatctatggagtacctgaatagctgaggcatttaaagcatttgttgggctataactagaagggaggggggcccatgagtagctcttacacgttaaacagacatcccagcacagaaggctgtgtaaatgacaaaagaaattcctactacatattttggcagtgagggatgaatatctatatctgccagggtattgtgtgaagtggacagggtggagagaatagattgggagaagggattccagaaggtgataatgattggatgctcactttctcagtgctaacttgtaccctgaaaattcttattattacccctgactttgttaacatctcagtatctcatttttttacaaccacttcccttgtctcaggcctgatggtgttaatagttgacctcattttgctaaaatctaattgcagcacacagactgggaattctgccatcctctggttcccccagtcccagccagcttccctgggttagctctgttcacctagccagccacatctgttctcctgaaacctccatggttactctgccctggctatggttactgagtgcaaggtagattctgagagctgagtttgtgtaggggttgtgcgatgcagctggccatgctctttttgtctccaggagctggcatttgccctctatatgcactttgtattgtagctccctttccacctaaaacctccctgcattctccccttttctcccttttctgcctttgctaaatacctgttctggtcagaccctgtgctaagagtatggggctacagagatataaataaaccttgtgccctggccctgaggaactcacagactaccagatggtgactgacatggaagttgaaaaataggctgggcgcagtgactctctcctgtaattccactttgggaggctgaggtaggaggatctcttgaggctaggaactcaagactagcctgggcaacatagcaagacctccatctctaaaaaagaaaaaaaaagttgaaaaacacacaagacagtccctgagaaataaagagataacctatgtttacctgtccaaagaatgggttgatcgtagctcacaggagatggaatggaaggctttgtgggcaatggtagggagaagacagtaggaattgaagaatgggaatgggattataatgggaagaagcagattattagtaaggcatagattagactcttgatttgcctattctctcctctttttctacacaatgattcatagactcacttagtggtgtggggtacagcctagggctctgcgggagggacccgacaattcttacatctactgcttcagctacttcttctttctcaaactccacatctatattcttaattatctcctggcatgtccatctgagtatctccaagacacctcaaagtgctgtcatttacacctacacgttcgatctcgttagtaaccacacattctatctctgtagtaactctaatgcattttacagctgaggaagctgaggtctagataggggaagtgaattatataacaaattggggcagaggcaaacatagaaccaggcttcccaacacatagtgtgggatgcctcccttggtagcacaagaatttctctacacggacccttgtgtttaatcttaaggcctggttatttggccttggggtattcactgccctgatggcaatgccactatcagcttccaggatattgtgtgggggaaaactcaggccttggaactcttagagtcaagagttccaagagtctagcttgagctagatcagggccatattagacatctccattgtaagagatgtttgcctgtaacaaaacagaaacaatatttgctgcgtgaatatgaaagctgtagtgagaaagtgtggtgtagcagaaagacaatgtagttgggcaaatctggatttaaacccagctctagcaagttagtgtcccttacagagcctcagtttcttggtctacagaatgggaataccaataacctatcttatgtagtagttgtgaggataagagacgatgaatataaatgcctgatatgttttatattttctctatttcccttcctttcttatacggattaagggaagggagatattatcatacttgaagcttatcagtaaagaatcaatccttccaagatttattgagtgacttctgtatgctggttgatgttatgctgtgcactggcatatataggcaagtgatgatcactaggaaccttaaagagtaaatcaaccgtgttagaatcatcttcttttatcaagcttggtagctcatggatgtggcaggtagtatttccggactttatctatacatttgacaaggcagagggttggataggatggatatttgtatatttaagtggagtcaaaactagttgaaggaatccagtggtactgataggtggaacagtattaccttagagggagggagtgactgttagatcttatccttggccttggttattcagtattcttattcatgacttggatgagaatatgaagctgggcaaaataatagatctggttccaaattgaactggataaggtagaataagaaaccaaatgaaataactaggctcaatctgcatacccaccttaagtatttgaggtactggaagtgctcgttgcatggagtcttgtttgaataaggatacctttgacttttggtaagaatataaaggggatattgaagttgagaaaccctaggaaaccaagattaaaagtcattaacaaacaggggagacaaagaataccccaggctctggtagtggctctggaggaggcaggtgtgttccaggaagtaaggcaactcactgtgctgcagaaatagctccccttggaacctgaaagacaggagagtgatggcttacgtatggctagacttgtagcctgcctggaggctaggggatggccgctagaggaccctcaattttctttcagagagcctggaataaacatatgaaggacatggccaccaccctgacctagtgacccccctcccttgggtggaaataggatgtgttaatctgtctttgatcccatctcatccccatgttctgctgctcagcctttctgtgaggagctatgatggtaactcttcttgtcaaactataggcatcagtatcatatggtttctttttctggtgtcttgaccttcccttaacttggtggctctacctgggtccttttggatttccaccagccccatgtccttactatgtccaaggatcatgccagtcctacctccttctctgctgtttaagggcaacttgctgtgcacagagggtcattagccctggcataactcccttttttccctctttctctgactcccacatccagggctcctctgagcccacagcaaaacctagacagaggatgcaggagtagctgtctccttcttatagtgcccctttcaagtcttttgtgctgtggcacagagcccagatctggtataccaggaacaatgttagttccagaaatgcctctctcctgattggctaagtttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctgcccctcaatttctggtaggtataatgtctcatccatatgaatgtattcatgctatcctgttctagagtctctggatttcacagtagcctagaaatgttctccatagattgagacttctggacctttccctgatctgtgccaagaatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggctggggcatattgagaaggcactagttctctcctcttcactgcatcttaagaaagtgtgatttaataagcatcctgtattgctgtaaggcctctcatttcaaaacaaagccttggctagcagagagatagacatagagcttactgtaatagtgtatggcaagtgtgtatctaagaagagaaactaattccttctcagtgggagagtgtgtctgttatggaaggcttcatagaggagggatgcagtggagtctgcaaggctaagtgtgcagtgggcaccctaactcatcatgccctcccctctctggcagtgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggtaaggcctgccccttcaggaaaggtgaggccctgccagttcttgggaacctcctatttccacctgggtgtgagccacttggcccctgagaccttgtcagcatggcagcccaggctgcatcatccttccaaaactgcattgcaagtttaggttgctgatattccaattgctattgggcagttattcctcctggggagaaacttgtttctatcttttttgcctcttagcttcagagggagaaatgtgtagctgccagaggtcttgagcttcccattgcttgttatggggtcattcttccttctgcctgtctctggactgcttctcctagcatataaatagatgtaatgaactgttctttactgttccccaaagaaacctcaaaaccttccttcttactgtccttagttctttcttataaggagtctaaatctcataaacactaacttgctatataactttggataaatttctttccctcccaggatttatttcctcattggtaatatgaagggattgaccttggagaatgctaaactctcctaggagaacacttccaactcagatggtctgggattctgttaaaataaaatgtgacttcaaaactatggcagaagatttaactgtgaaaagagagtgcccgtcagtcagtcagtcagtcctgacgtctaggaaccagttctgtgatggcagttatgagaaattcactggtcctgagaaaaaaaacttacacacccacaagaagcagcagtgagagcacacttaatgcagacttagttccagactcagcttataggataagaatgctaatgtctagaaagacaaagaggtggatgagtggatgtgggactctgaggaggtagcctttaaagatgggtagcgaggtcctaggtgttaaggttgagtgtatagggtggggtcagatccctggaaccttaagatgcatgtggggaagttagtaggatgcagaaggcaatagagagtcaaatcaggtttttttggttgttttgttttcgagaagaggagaggtctattcaagactgtcttttagaaaatgattctggaagcctagggactctagttgggaagtctttgcaggaattcatgtaaaaggaaatgaagtcttgtcttttcatttatttctatttattattattattattattttgactctgggtcttgctctgttgcccaggctgaagttcaatagcatgaacatggctcactgcagcctccaccccctgggctcaagagatcctcctgcttcagcctcctgtgtagctgggtgcatgccaccatgcctggctaatttttttattttttgtagagacaggggtcttgctgtgttgcccaggcttttcctgaactcctggactcaagaggtctacctcagcctcccaaagtgctgggattacaggcctgagccactgtgcccagccattgtgttatttttaaatggtaaacactatttaatttggaggggtagggacaagacttcttgtgagccaggtattgttaaatacttaaatgcattattacttttaatcactatggccctttgaagtaggtactattagagttggggaaatgaaggctcagagagggtaagtgctttgttcagggtcatatatcagtaagtagtgaactaggaattttgacactccagggtgctgcctctactgaggtagcagacttattggatttatttccatgggctgggcttctagggagcaagaggggtctgatctctaagctgattcctggctactttgctgggccccttgttcttgggccctttgccagttaggagctaactgctgctgtctgagcagtccccatacctcatttgtttgaaaaacatgtactgtttccattccaaaggcaaaagaatctaggcaggagacattccaagtttggggataaaactaagctcccagcactccctgctccctaaagcttccagagctaaatgaccactgtggcacttagaaagagacaaagacacccctccccttttccccctagagataggcttgcacacatgcacacatatatcctcctctgagtgtccagagcccacatgccacctggttcctccttgtattaacagacctgcaatgccagctttcacagagctttattacagagttcctgataatttatgtgaataaatataattctacatatacagtccagttaggatttcattgagtttcaagataattatttgaggcaggcaggaattttgattcccaaaacaggcaaaacttgctcatagtcacacaactgcttagagccaggactaattgcaatgctaattgttgttgccttggagtggggcagtgcttaattgtatacttatttgctcatttctacacccaacaatgattattgttctccatctctaacagaccttattggaactatgaaagggtgtcagtcttgattctactttaaaggagctcgctattattataaaggacagacatatcatagtattggcttttctcaagaggctgctttcataaaaggacagtatttcagtgaagaagtgaatccttaatggtgtaactttatatagttgggtcatggaagagtacagtaaaggaggatattcagcaagggaaggagatggcaggaaatggcgcctctgatttgtctttgcctatgcatatatcgccatctggtgttcattttcagggggttcaactccctttctcttcagggacaaattaggcagatcacaatttgcgggaagcttgcagcctaacatttcctcttcttacctccttgcttgttccatgatgtcttttgaagtctccgccactgatagctctggacttagaggttttttttttttttttttttttacagattgagttctgtttgtttcatctacttaattatctcagtggtcagtgttctctaggggtccttcttgttctgtagtctatcctttcttttctatacctcaagtctaagctatatatcttatctcttcttcaccatcctttctccttcctaatctggtcccctggtaacctggtggtttttacttagaaaggaagaccagacagtaaagtccgttttctcttccaaagggattagcaaactctcagtctttgttctgggtgtagcccaagtctctctttctttccctgactcctttcaggcagagctgatgactccatcttttgggaagacccaagaccttatatatctatatctatctctttctattatagaatttgtcacactgaatacagttatctgtctacttgtctttgttggagtaaatcatgagctcctcagtggcagggagagctttctgatttatcgccacgtatttagggcttagcacagggcttggcacttagtaggcacttgaaagaactcggtgaatgaatagatgaatgaatgagtgtattaacatagatagccgtgtggaggaaagaagtgaagaagcgggaaggcttgtttagctggatggaaggttttgtcggtgaactgagggaatgtgtgtgacggtgcaagggtagacttacattataactcatgcccttgagatcttatccactaaggaagatacttaggaaaggaactcagggcctgggggcagcaggggactctcctgagtcctttggcataaatttaatttgttttgtgcttctgggaacagaagctcaggagtccaagaggactcctagctcaatagttcctcctcatcttccctaatccacccctctgctaccaccccagtcatttctcagccattaggttttccctggatctttttgtcaagcttgcagggtattctacattcattgaactttctagataccactacataagaggaataattgtggcatttgaagtcacacagattggaattctagcctcagttcttcctacaagttgcaagactctgtatctgcctgtcccaggctgataatgataccaatatatcattatctgctgggaggacaaatgggaaataccttgtaaactggtacttgttatgattttagtatgagatagtttcgaggagggattcagatgcctgagagcctggcttcatagccttgattactggcagcaaaatgatggtcagtgtgtgaattaggtaatgactgtggtttctatgggccttgagctagctcagagccagacacacagcagagcagggagaatatatgctgagagttggagctgtcattttcctctttgatgccatgactcatggcatgttggctggcacccccttgcctggcctcctccagctccctgcattgcccccccaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggtaggagagtccacaaattcctggacaccttgacgggtgggtaaagggcaggggcccagggtctggctagaaagttacatgtgtgaggaatttgaaatatgatccaaagactatgttctagagtcactggactcttaccaacaataagagttcaagttgtaaaaaatagtcactatgggccaggcacagtggttcatgcctgtaattctagcactttgggaggccaaggcaggtggatcacctgaggttaggagatcaagatcagcctggccaacatggtgaaagcccatctctattaaaaatacaaaaaaattagccgggtgtggcggcgggcacctgtaatcccagctacttgggaggctgaggcaggagaattgcctgaaccccggaggtggaggttgcagtgagtggagattgtgccattgcactccagcctgggtgacaagagtgaatctctgtctcaaaaaaaacaaaaaaagaaagaaagaaaaaaagaaaattataaaaatagtcactatgattttcaaagaacagtggataataggtgataacagttattttgttccttttttgaggtatttacataaagtgtacaagtcataagtatacagctggcaagcttttgcatatgcatgtacctgtgttactaccacccagatcaagatacagaaccttctcagcaccccaggaaactcacttttgctaccccaattaatatttcatccaaaagttaactactgtcacaacttgtaaaccagattagttttgtctaattttgaacttcatataaatggcattatacagtatatactcttttgtgttttgtttctttcactcaacattatgtctatgagagtcatcaaagttgcatgtagtgatagttggtttatttccattgctgagtaataatctattgtatgagtatactttaatttatccactcttctgttgataaacatttgggttgtctgcagttttgttgacttttatgaataatattgctatgaaccttcttgcatatgtctcttggtgggcataagccctcatttctgttggacatataatattcatgtatttagctttattagaaactgtcaaacaattttccaaaatgattgtaccaatctatactgccacaacaatgtaagagaattctagttgatccatgacctcagtatttttaggcattttaattttaaacattctggtaaatatatagtagtatcttgtgattttaattttcatttccctaatattattaaacacctttttataaatttattggccatttgatttgggaatctcttctcattttaaaaattggattgtctgtctttttcttattgatttgtaagcattatttatatattttggatattagtcttttgtcaatataaatacacatatatatagaaaatattttctctcagtcttgacttttttttgctttattgtcttttgataaacagaagcccttgattttaatgaagtgtaatttaatcagttttttaaaatgattgatgcagtcaggcgccgtggctcatgactgtaatcgcagcagtttgggtggctgaggtgggcagattacttgaggtcagaagttcgagaccagcctggtcaacatggcaaaagcccgtctgtactaaaaatacaaaaattaactgggtgtggtggcacatatctgtagtcccagctccttgggaggctgaggcaggaggattgcttgagcttgggaggtggaggttgcagtgagccaagatagtgccactgcactccagcctgggtgacagagtgagactccatctcaaaaaaaaaaaaaaaaaaaaaaaaaaaaaaaattgatgctttttgctttttgtttcttgttcaagaaatccttccctatccccaagatatttccctaaattttcttctgaacctttattgtttgtcttttcacatttagggatattatttcaaattaacttttgtatgtgatatgaggtaggctgtcaaggatctttgttttttttcccccaagtaaggtgatcattcaggaatctcttttttttttttttatttttcaggtcaaaaagttttctaatttttattgtggttccttttttgggacatggttatctagtatattgcttgattttcaaacatgtgaggactttttaagttatttttcttttgctgatttctagtttaatttcactaagatcagagaacatatgctgtgtgggtgtagtcctttgaaacttgttgagacttggtttgtataaaaaaacaactaagcaattcagttaaaaggcaaagattgtcagattggattaatgccaaaactcaattatatgctgttcgtaagagacacattttaaatataagaacacaaaaaaaggttaaaggaaaaggatatgagaaaagatatatgttacaaaataaagcagcaaaattaagcaggagtagctatatattgatataatatttatattaatataaaataggatttaggtcatgaagtattgacctaaagcagttgctaagtgaaataaagcaagggtagctatatattaatataaatgtaatatttacattaatataaagtaaactttaggtcaagaagtattactggactccaaaaatagatatttcataattataagtggatgaattcaatttaatatataacagcccttaatttggatacatctaatgatgtagtctaaaatatgtaaagcaaatattgactgaactaaaatgatactagacaaattttataatcaaagttagagattttaatatgcttctctcaataagccaccaacagcatccataaggatataaaaaatttaaaaacatggttaataaatttgaattccttgacacatatagaacactttgcctaactctagaatatacattctttttagcacttatatatctcttaaaatatacttctgctccattctctcctctccttctgagaatctaatatttatgttagatcttttaactgtattccacatgtctcttatgctcagttctgttcttttttctctctgtgctttggtttggttattttctattgatctatcttttaagttctttaattctgcattctactgtaagcattctggtgtttaacccatccagtgggttcctactctcagacaatgtatttttcaattctagaatatccactttactcttttataggttctagttccctgtccagaatttctatcttttatctattgtatccatcttttcctgtatttctcttaacatagcaatcataattattttgaagtccttgtcttataattcttacatctggatcatttatgggactgcttatttttcctcttgattattagtcatattttttgccatttatgtctaataatttatttttattacatgctggacagtgtgtataaaaaaacaatagaggctccagatgattttctcttccatcaggtagttttccccctttcttttgtgaagtatattaaggaactgatcacctcaagccaatcagagatcaagctgcatttgaactaggttgtagttttagtaaaacttggtgtagctttcatttgtcccagtttctcaggtatgtccctccctgacttttaaatggaaagctgttaaatttctttctcttcagccctgaaagactgtgagagatgcagttctgccacttcgtaggctgttttctttgtgccccagtggagatcttctacatgggtccagcccaattttcggctgtcacctaaaatcatcaatgtctcccaggaagaaaatgactggcaattgacaaatcatcttagaaaggctttttttctctctgacttttggtttatctagtctagtggttttcacactttttgttcttaggactctactttttttttttttttaagatggagtctcgctcttgtcgcccaggctggagtgcaatggcacaatctcggctcactgcaacctccgcctcccaggttcaagcaattctcctcctgcctcagcctcccgaaaagctgggattacaggtgcctgccaccacacctggctaatttttgtatttttagtagagaaggggtttcaccatgttggtcaggctggtctcgaactcctgacctcaggtgagccacccacctcagcctcccaaagtgctgggattacaggcgtgagccaccacacttagcgaggaccctttactcttaaaaactatttaggacctcaaagaacattttgatagggggtaatactgttgatatttaacctattagaaattaaaactgagaacattaaaaaatatttattaattcatttaaaataactatatagccaggtgcagtggctcacgcctgtaatcccagcactttgggaggccaaagcgggcggatcatgaagtcaggagatcgagatcatcctggctaacacggtgacaccctgtctctactaaaaatacaaaaaattagccgggcgtggtggcgggtgtctgtaatcccagctacttgggaggctgaggcaggagaatggcctgaacctgggaggcggagcttgcagtgagctgagagatcgcgccactgcactccagcctgggtgacagagcaagactccggctgggcacggtggctcatgtctgtaagtaatcccagcactttgggaggccgaggtgtgcagatcacctgaggtcaggagttcgagaccaggctggccaacgtagtgaaaccccgtctctactaaaaatacaagaattagccaggtgtggtggcaggcacctgtaatcacagctattcgggaggctcaggcaggagaatcgcttgaacctgggaggcagaagttgcagtgagccgagatcacatcactgcactccagcctgggtgacagagcaagactccatctcaaaaaaaaaataaaataaaaataactatatcaaaccccttagatgttaacacaacatattttctaaatttttcaaaataaaaacaattttgaaaacacaattttcataaaatgcatacagctttctccagatgttgtgttggatcagaattgtttttctcccatgacctaccatatcctactgggaagtggaagtcaggtgataacactttatttaaaacatatagataagtgtttattaactttggctgcatattagaatgacttggagagcctattttaatgcccaggcaaacccccccagataaatgaaatcactgtctctaggttgggacccaggtatctgtgtttttttaagttcctggccaggcatggtagctcacgcctataatccttacactttgggaggcaaagggcaggcagatcgcttgagcccaggagtttgaaaccagcctgggcaacatggcaaaaccctgtctctaccaagaaataaataaataaataaataaataaatacaaaaattagctgggcatggtggtgcacacctgtggtcccaaagctactcgggaggctgaggagggaggatcacttgagcccgggaggcagaggttgcagtgagctgagactgcaccactgcactccagcctgggcgacacaatgagaccctgtctcaaaataaaacaaagtaaaaaagttccccatgtgtttacagtatgtgacaaggttgagaaccacagccataaaataaaaggacaagaactctgacttgcccatctcttgtcttcccatcagacatttattactgtgcatggcatgatatgtctctttctgtctgtctgtcttccatcttccctattccttattttgtagttatttctctctttaaccaaacagtttttttttttttttttgagacagtgtctcactctattgcccaggctggagtgtggtagcacgatcttggctcactgcagtcttgacctcctggactcaagcgatcctcccacctcagcctcctgagtagctgggaccacaggtgcacaccatcccaccaggctagttttacaattttttgtaagatgaggtctcgctgtgttgctcaggctgctctcgaactcctgggctcaagtgatcctcctgctttggccttccaaactactgggattacaggcgtgagccactgtgcctagctcccaacagtttttgagccttgtaggcctgcccctttgtatgcctccctgactatcatgcttctatttgctctctttttttctcttcttcatccattcttcccttcttagcttatcccattccttaaactgcttttaatatagaacttgatcataaattttcagacttggtatattagtctctaaggtatctagtcttcatttagagctataaaaccaggaatgggctatttttaggttttttttttcagggaacagaaaccaagtgaagattggcactctcattgcctcttaaaggaataaaggtgttctgtccctagctgaggccctcctggcctatcttagctgtggagaggacctcaggcttgctatgggatgtttacctcattggctgaagctggggataataagactgctttcaatgcatcttctctgggattctgttcaggtaggagaattggagatcacttatgctggtagcttggatgagacagcaagaaactcagtgtacataatgtctgtatgtactttcaagtcttttacactttagtgctttgtgactgcctcattgtgtgctccctgcagagaagtcggttatttctacttatacattggtcctctcatgtcttggcttctgttggcaatgcctgtgttaggtgtgggcatgctcattatcttcccaccttttacagagttcttttcaaagcccacttgctctactccctgagagaatcatagacgcagtctctgggctagagaagactttggagagcattcaggacaatgcccttctgaagtaccaatcatttttcagttctctctgacatgagctcttcacataactcccatgacagggaactcattctctcctgagatcaccccttcactgatagtttggatttgcatgggagaaagtccttcctcacactgaattaagagccggtttaggaagcacagggtcacacaaccagttaagcgacagaccagggaccagaactagattttcagattcctgaccagtgctttttctgtcacactgtgatgtcttgaagtctaagcacagaccctgactcttggtaagatgattcactagctgacctgttcctgaagagatcagggaagactgctggaacttgctgcatgaccaggaaagtaagctgatgtgatagaaaagaatgcctttgtctgggaacagaaacatctcaatttgggttctggttgacactgttgaccttgagtaggttaattttcttcgctgagcttgctttcttctatataaaatacggaaaataatccttaccttttctccttcctgggagagttgtaaagcagataagaagtctgagttctgaagcatcatacagagatgttggagagtcttagtagcagtaaatgaactcacatccttttggctgcctaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggtgagaacagcccttctattgtcctcttttctcctttttgcccttctcctttttacctgcatatcttcctcttctctccctctccctgttcctcccattgggtgaagagatatcctggtggtgggttctgtttctttcctaatgttcagctcctgacagtgtcctcaggcttctggaggagggaatgagggtgtaggggcattcctgcctgtcttctgggaaagatgaaacaagtggaggcaggcagagggaaagctctgccagccccaggctgccatggggacagaggtcctcctggggcaaaagggctatcaaggacccctttgcttctcccctcgctttctctattttgtccccctcctttttcttctaccttgcctgcctttctctttttcctctttctcttccctttccttgtacagcctcagttgtgctaggaggagtgggccccagccataggggaaggcctttctcatttattccattctcgaatccctgctctttttgagctgggggcctcatctttgcaggctgagaagataaaaaagaagagaaacacactctttggcaccttccacgtggcccacagctcttccctggatgatgtagatcataaaattctaacagctaagtaagtaacaccagttatctactctggcaatgtccatatcatcctcagaatttgagggcatacagggcctccaacaccaattccatttcctcattggtggagggacagctctggtctcctgcctcagcctttatttatctcctgccttgctcttaagtttgagtttattgtgtgttttattcacacatattctcaaaacttgttcctctgagaagaggcttcattcctattggggctcacaccaagtccatgcctgcagttctctttcctctgtcttcaggcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtgtaggtgacctctttgcggggatgaaggaaggagcctttgatgtacaggttgagaagtctgtggcctctgttgtgcttaaacagcagatggggcagatacccaggaagatagttcaactcatgaccttggtcaataaagcacaatttactcaggttatttctttatagttgtccttttggtgttctttccttgttgtatgctctgtgtgcccctttgggtctattgtgctaagtgtgtctcccttcattctttttcactttattgtccctaactaccactctatctacctttataaaaaatatgtcctttagtgaatttcaatgtaaaaatggcatttattctatttattgaacttatttattttgatttttgttccttattcttattgctaaagtagatgaatggaatgatgtttctttttgtgtttttgtgagaggccctataaagaaatagtcccttaaagtgatatagtcctaaatcctctaagctggaaaggcattcttgcccaggagggatctcctgcacaagcatgtctggctttccacctggactcttggatcctacccgctcttcctctgtcctggatcttccctctcccttttctcccctgcaagtgatgagagttgagtagagcagagccaaaaggaacaacactggaattcttcagtgaatgaagggagttttcccttactggcccacaattgaatttttctttggatcagatgctattttaagtaagtagaatagcccttatggtaaagctattgtcctaggcccatattctgccagttcagcgggagggcagaaggccggggctgggttaggggcttactttcagattctttaatcaggctggattcccactcgagacagaatttatttgtaattttatcaataatactttgcccctggccaagcctctttgttcttctaatctgataactcgttaggcctttaatcaaaggcttaacaaggacaggatcactgacaggcagagcttgatcctgacttgctgatctgaaggcttctgtgttctccaggctgggagggaccttaattagctctgagctacccaatccctgcccccagcccttcctttattacattgatggcaggccgaagccctccataaatcagattctcttctccttttggcctggctgttgaccctagatgctgcctggctgatggggcgtaggttcagtgaccgctctctctgctctacatccgccggctcggatgatcagtccctctggaaataccccggtttgaggagcccctttggggcattttgtttttctgactttcgggactaaatcaacactcttaccccatgggtcccttctcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacctggtagcccttcttccatctgggctgggagggaaagagggaaggacaaatgacccctttcttttctctttttcatgtttctcccttttcttcccagtttcccccttctttctcccccttcccccccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttctctcatctttaggtagaatgcagggaagcttatctatcaggctagaggagaaagaataaaggtctgcactctcttttagctgggagtgagcccaaagggggatgcactagcatattcctaagttacttggtgcccatgtatcccttcactgggcatagtggccattatctccaggaccccgatttgcagcctgatccaagagctggttctttgttgtttatgtgcttattggaaagcgaaaaagagtgaacattagcataaaaagcatccatagtcccaccatatttgagcaccttctctatcactcttttctgtgaaattttttatgtggttaagataatgatagccactgccacttattgagtgccatgacctgtttcaggtgccttaaagacattattgtgaagtctcagaagaaccctgcaggattttagaaattaggaattaaaatggggaagtcagctgctcaaggtcacagctagaagtgaaagtcctggtttcaacctctagtgtttggtattccaaagctcaaggctagtacctataattctgtatcctttttcccctctgaacattttaataggcatttttccattttcttcaagtctttttataagcatcatttttaatagctctatagtctcccagaaactggatatgttatcattttcccattgttcattatttatgtttactttcatacaactattaataaaaagtaaacaattatgtttacttctcatttaattattaataatgatgaacatgtttatgtataagtccttgtctatgctgtgaattatttcctgaggttggctttctgaaaaggctggttcttagtgctctcccggaccttatcccaagcccctatcctacccttccttgcttgtgtctacccactaactgccttgccacttccctttatagtgatattgcccataggtctccttctattggaattgccactaaaactgacctgggcacttcatcttcaatttcccatccttttaggacccctggtgggaggtttctgggaggaggtgccccattctccagattggcattagaggcccagggtggtctccagcaagcatttattcatgggcacctccttacctgccagcccaaagtgggctggcccctcctgacactttctttattctccttgcagcccctagcctgcagagcagtgttcggcagcgcctgacggagccacagcatggcctgggatctcagaggttggtagagggcgaggctggccacttcttgacaagccgggtatctctgcggcgaatgcgcagcctttcatctggacagtctttcagttctgaaggctacgggaccagctctccatctgcctctgctgctgcttcttgctcctcttccatcaccaccatcaccactaccaccaccaccaccaccaccttcaccaccgtccatgtccaccctgtttattaccaccacagcacttcctatttcctccagatggagccctaccctgacacacccccttctgacagcaccgctgtgatgcctgggcattcagagagcttggggtatcagctgtctctcttttctttcttcccttccttccctttctgctgcttttaccttggtttctgcctgccagctgctgcttgatcaactctgggggtgtgtgcagtggggaatcttcttatcctgtttgttcccagctctgggattcctttttaaggtcagcctactttctccccttctgtgtttggggtttgctgactctaaaaatgagtaacgactttcttccctcatgaccctatagcacttttgcctaaactatgcactttcacattagttatctcacttgggccctcacttcctttactccttcaacaaacatttactaatgcctactctgtgccaggctctgctgggcataggggttcactggtgataagatacaatcccagccatcaagaactacaatcttgtctgagagagatacataaataattatggaaaaatttattaagtgctatgggggtgttgaggaaggagtgactaacagtgtgtacctgggtggaatgcttcaccaaagagatgaatttgtgctaacatcctgtgtgaagggaaaggagaaagagtattctaggcagaggaaacactgtatgcagagacatggagattccagagaatacaatatatttgtggttagaacactggatatgtgttggtgggaaggagaaacaggtgaggctagaatgacgaaggctccgaaagggaagggttttggcctctacccgttaggagatggagaactacaaaagggtttctaagagaaagtgaatcagtcacatttgcattttagaaataacattttagtggctgtgtgaaggaaggaagtggaagactacaggaatttggaaaacattccagtagaccactaggggaggtaatgaggacttgggataaaaagacatgataaatttggtaactggctacagtggtgaaggaaagggaggatctagtatgacactcaggtttatagcttgagtgactgagtggacataacgtccttcatggaattcgggaaccaagatagcggacataggttttggggttttggacaagaagagtttataggtggggcaggaattaaaatacacattttaagaacagtaagttaaggttctaaaagggtaagtaattccctccaggtctcatagctagttgagagcagagcacagattagaacttggctttccattccagaatactccgttggatatttttgtcttttcacaaggtctcaaaaagtgtactggaaaataattggtgaaaggtttttcttccacagctttgtctggcagctgcagagactattcttgctaatacccaagatggtagactagaatcagagatagtagccttgaccttgcctggaacaagcttaggagaccttcagaaagtccttcccctctggaagtacttctcatctctgaaatggtgaccacagcccagtcctggcctctgggctgcagtctgcttactctgttgcttttttttagttctatctcactctggatacccatttattcagctctgccccttaaacctctggatagttatgcttgagggctgttcctttctcttgcacaaagggattgcccttactaggattattactcagcagagccactcatatccattctcattctcattttcatccaaaagcctaggaagggagactgctccttccagtacagatggagaggatcaaattgggttggggacactaagggatgctgtgaattccatgctccaaggtttaagctgagggcagtggggaggaagggcggagaggtacctgtatccacctggcctgttcactacttaattttcttttgcaccacgcaccagaggatcatctctaaaggcaaacaggctctctagtaaggtcagtagcttgggatgggagtccgaggcagcccagcctttggggagggacctctggcctgattgttctcagtgattcagggagggaaggtgagcctgcctcactgggccttttccctcctatatctccctaggcttcctcccaggttcttatcttgctttggcagtcccaacttttagctgatgagagaggcatagaaggacaggaatcaggctgggtgcagtggctcacacctgtaatcctagcactttgggaggccgagagcggaggactgcttaagcccaggagtttgagaccagcctgggaaacaaagtgagaccctgtctctacaaaaaaaaaatcaaaaatttagttgggcatggtggcacatgcctgtggtcccagctacataggaggatcacttgagcctgggaggtcaaggctgcagtgagccgagatcgcgccattgcactccagcctgggcaacagagcaagaccctgtcaataaataaataaataaaaagatggataggaatcaagatgaaataggggtctggtccaggagaagtgaggctgggagggccctaacctcctgatttctcctccttggtgttagagagggtaggatcccagaatcttcacttcctcagcttagaggaccctttttctcagtgtgattgcttcccagaacttccttggcaccttgctcattggtttataatagtgtttggagaaggcaagatatggagaggatcatcttggggcttagagaaacaaggacaagtttagaagcaaggacagtgtcagatatatgaaaccaaatatgagactgaatatttgtaaatactagaatatgtggctaaaacagtatttgtagaatggaagctgagttggaattgttctctgctgcctgctgagtccaggaaggtactggcccatggggtggctacttagttatttgcttccaactgagaattaaatctacaatagctatgagccaaccccctgcttttgcctgtttcaggggcctggtacccttcctaacttctgaccctcagcctctttctttctaggtcctatggtggtctccttttccattcatgactcttcccctttggctagcagacgtttaaacatttcccttaggtctctcctctgcttttgctgaggttctcaggcctctaggaaggcagaaggaggattcaggattggcagagagagcacctccatatctacctttttgtctgtagagcaggaggagtggcatctggaattgattcatggtcttagcaaccaccagctccttaaagggtctcaagttcctagactagcctgtgtgtgtgcatgtccagtgtgcggtggcatgtctccataactcagccttgcaaagaagcctcttgcgaccggcccgtacataggcctttcagcttggcaggcctcatcatcttcattcccacaataatttctacatttccaagtgctttgccagcatatttgatcctccaaacagtcttgtaagataaattgaattggtattatcttcattaggccaaagttaaggactagcaagtttagatgacttgacttgtccaagatcacacaggagtccagacctcttctgaaccactgctctttaaaggccaacatcctgtctttctatgcctccctacattctccgtcagcagagttctgaaagagaccccacccttcctgccgcaccacagactttggtttgaactctgcaatacctatctatgacctcctttgaatcctatgagatggttagaagaggcagcatcctggccttttggggtgggtgaaggattatttgcaaggctgttctaaccttctcatctccagcctgggtcaggtccactgactgcatgtgccctgttccttggggcctggcccagactggataatatcctaaggtgtgacaggagtaagtggggaaggaaggcatggaaaatggtgactcggagcaggctgtaggttctgtgttagcttgagtcccaggaaatacagccagctatgagaaggcagagattttattgaggatgccgcctgtggaatttaagcctatggctgcaccagttcagagccagagcattcaccactggtggggcccaggtattggaaaaccatttgccagacagatgatggtatgatgacatttgtttttgtttcttatctgtttcttccctccctatcacttttccctttcttgtctttctctcttggcccttctttctacctgcttatccttttgcttttcttcctctacaattctactctccttttcctgtctcttttccaatctatcctcattccctcctcctgcctcctctcttatcctatacttatggctgctcaacttctgtctattcctctttcctctctccttcccacctgcctgttcatcctatttctctctcctgccgctctatccccattttcctaccctgtccttgtcttctcgtgttgtccctctctcctcttcgcctttcccctatcacctcatccaatatatgtccctttcttcctctctgccccatgtcttgcagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccact
